United States Patent 7,365,185 (GENOMIC PLANT SEQUENCES AND USES THEREOF) - sequence listing, part 68

SEQ ID NO: 73582 - DNA, 47126 bp, Oryza sativa
  unsure (1)..(47126): unsure at all n locations
tatattagtatatgtattatagatctataaaataaatttgcttagaataagttttctaagcaatgcggatacagaaaaactttgggtgaatacccaacatgatccttgaactcaggggcagagctagagtgaaatggagggtggtgccacttagttaatttactcactttagatcaagtttaagcttatgcggatgcctaagtttgtattgaggagggtgcatatatggtgaaaatagatgaggtatagctaatttttttttaaccaggttcctggacaccccctattatatactagctccgcccctgcttgaactttcgtttaaggatcaatctagtctctaacatttcgtattgtccaaacgagtaccttaagtttattgtgtgattcaatatagtccttagaccctctaaacatgccatgtgtacatgccacatcatctatgcatgcaaattcaatatttaaatgtcctttacacccttatgttttcataggaaataaagaaaaactattgagaaaacacacaaaaaaaaaagcttttgaccattggcaaaaatatgtagcattgatagataaaaaaaattgacatttttctttgttttatgattgcttcttcttgtttttcttttctttatttgatagaaaattgaagcttaaaaatggacatttaaatattatcttacatgcacgaatgacgtggcatgtccacgtggcgttttaagtgggtctaaggactatattaagccgcatgataatctttagggtcttgtttggacatttaaaacatcaaggactaattcgatccctgagcaaaagttgaaggactaaactggctatttacccaaagactttggaaaaatggtgatttaagaacagagcctcagaccggttaacatttgatgcatttgtcagctctgggccatcgaagcaaaacacggtggcccatactccacatggcagaggtgtttttgggctgggcctgcggccactttcaccatcgccgctcggctacaggactcgaacacacacaacgatagtcaactgttatggctctcatcctctgccaaatggtccagcttctctctgcttcaccttcacggatcccgtcctgttcttttgtgattaggccttgtcagtgcaagtttcaaaagagtttcaatcttatcaaaagatgatataacatgaaatttattaagagagaatgaatgagtttcatttagatgaaattaatattacacacgaaacaatgaaactgcgttgggactgaatcatttcatcatatgtcttggaaaagaaaataaaccccattataagtttataaccaaatagtttcataacaccattgaataattaaatgatatgggtagcatatgagaaactatgaaatgaaactgtgtattggagacttttgtttcattcatcaacccaaatatttttagattatgcgacactcctgaaaagaacaaaatgaaacacccaccgggaatggtcttaaggtatagaatttatattggttttcgttatcacgtttttcaaactgctaaacaatatattttgtgcgagctttctttatagaagttgttttaaaatatcatataaatttatttttcaactttgtactaattaaaactcaattaatcatgtactaataggtttcttgttttccatgctctaacttcatctttattttcaatagaaagaacaccaccatagaagtatgtcaatcaaagtagaaccatatataaatattatatagagtatatatagaaatccatagcaaagagaacacattataaatccacaatatgcacagtttcacagccaagttagactgataggtgagataggatggttcttgatataggatatttctataagatcctggttgacattatccatgaaaaaactaagaaaccaatccaattcatttttttctctcgctgatatataagccatcacttggaaagtaggaccatcccatcccccattttaaacggatagatcaataggactctatcccatctaaagaatagggatgaacctaacccttttcataccgatcacacaaaggaaactataatttattttcttaaaccctaatctacactaagcaatcaataatgataaatgttttaggacagaatgagtaataccatggtctgtatagggctagaataatcctactatcccaacaatcactacaatggttcaggtcatcagtgatgagctcagactatcacctcttacgggtagggcactggtgagagataagtggtcaatgatgactaaacttatctctattatgggacacctcttatgagctacaaatggtaacccgtcagaggtgatgttgacccctttgactggtgacatcataactcgtcacaggtaacacctgtgacaggtagcacaatgcggcccatcaatgatgtagattaccaatgaaaaaacaatatttgttccattctattgctcattcagttgcattcatctcacaaattcacaaatcataaaaataatcacaatcacattctcaatcacacatccgagcatcacggaatcaacacgaaacacatcacaaaattaaccagaatagaacacggggcaaaggaggatatatccagtggtccccaactacctggacaccggatctagcgccaaggagctcggcgtgacggaaaggcggcagtccgtgaccttgggcgcaaggtgaaggaggctagagctcagggatggacgagacgagcagacaatggcagcggcgaccgacgctcgaggggccatcccgatccagtggctcctaaccacctagagactagatctagtgcaccagagctcgaggcggctgccgacgaccttgggcggtgggtgaaggaggcagtggccggagcttaggggcggagagacggccgacaacgcttgggggtgaatgagatgagcagacaatcggcagcaggcgaaggagacggcgatgcttgtggaggctgaatccgatggctgacgatcgtgggaaagaggtcagtgcggctgatggtcggcggttgcatgagggcatgggaagacagctcctaacaatcgacgacgacgataagtggtcggagaagaagaaagggagaaagagaaaagggagagagatcgggggagagagatcggaggaggagaggagaagggacgggaggaggggaggagaaagggcaagcaggctagcgggttggcaggcccggggggatttttttttagtcatcactaacggttataagaattgaacatatttgagtggggtatctcatctgtgatgaatgcaaactcaacacccatcatagataagaggtcatctgtgatgggcctgtgtgtgagctcatcagagatgttatgtgtcggtccttatataaatctatcatagatgagttcttacatgtggctagtcatttccttgagcttcattacaacgggatttagtttaactcgtgtcagagacaaatttttttggtccatcgtagatagaccgtcatagatggattggtctggcgcaatgaattgtgttgcttgatctggatctattggtcaattaaaatgaagtgctcccagctgagtttaattcttcgggtgtggtcggtgagtatgccagatatccctttcacacacactgcttgcagcagcattagtgtcaacaaaacgtggttggaaatccgtcaaaaaaaaaaacgtggttggaaattgccggtcctttcagaatcggtgtacacacaagacgatggtactcgctcgggagagtaataacgtaagagggttagatggcagtattacggccatattcagtagagcataaattgtaaattcaacgatgaagattattatacgagtagtatttgaagcctaatcttcaagctcatctatcgaaaattattgccgtgcttctaaaaatgaaatttcttccccgaaaaaaatattcttaaaacactttattctaccatattatttatagtactactctccctccgacaaacattagatgtccaaaaacatcaaaaaagtcttttcatcagaggttatttttcagtattaacatttaaatcgttaagaatacacaacaccgtcgtttctcttattcgggaaaaaagcgaaacaacatatttacaaacgaaaaataatttataaataaaacttttatatatgtgtttttagcgatctaaatgcaaagatgaaaaaaaaacttcgatgaaaaaaatcttaaaataaactataatttaagattgaaaatttcaaaatttggttgtgataaacatgagcgaaaagatgagaccccaaatttttttaattaaattattattataataaataaacgagggccctcaatgttggctggtggctgcaactgcaagctgccagtttgactacaaataccaccgcacaccgctggagggaggggaaccttccagaagctccagattccaaaccagcaggagtcgcctcgcctcctccttcatcctcctcgtcgtcgccgcgggggtcgcctgaggtaggaataccaacaaccccccccccccccccccacccaagcaagcttctagggttttcgaccgcgcctcgcttcctccggtttcgtgggaggcggtgggtctccctccctccctgcgtgtggatctcagatgggatcggtgtttccttgttggtcttgctgcttcgcggggatttggggcttcgggcgggctgggggtggggggggggattgttgtggatgttgattgatcgatcggtgttgttggttcggggcgattggttggttggtggggaggaacggctcgtctcgtgtgtttgaatccatatgcaagttcaagtgatgcgagagtgttttgatgcgtggacctgctgcttccttttttttttttccttttgagcgatgattcgtgctgctgcggagggatacggatttgttagttgccgattactagtaataatcattggaattgtgtactgggctctggctgctcatgatgcgatgggctttgtgatatgttcatgattagatttagacatgttttttctgcaagtgtggagttgattgcagagtgtccttccctgatatgtcgggggattgggtggatgtagagaattgtagatttgggagttattggactagccaacagacagtttcctcgtgaattcgatcccttcatgcagaaatgaatggagggataggatgaaatggggtgagaagaatggatagctaagattgaaacttaccctttagatgggtgggaaatcatatcccaaaccgattttctagggataattcctctatactagacgtgtgttttgtttgtatctagtatgtttgcagtgggcagtggcatttgttctatgatgcctttggtttacatgctttggaaaaaacaatagatcattgggccatattgttatctttttctgactagtagtaaatgatgcgtctgtgttgcttctgctttaacatcttttcaatcttcactaggataatttcatagttcaatatgttctttgggaacttggttgggttttaggacctctagaggctacttctgccacttgctaagtaactgttttgtggaatttgtttacagatcacattaacaatggtgaaggctgttgttgtgcttggtagcagtgagattgttaagggcactatccactttgtccaagagggagatggtatgccatcagtcatcaccattttcatgattgtcttgaattgaattttagtccttgaatcgttgagatttactggcatgtttgattcttaggtcccaccactgtgactggaagtgtctctggcctcaagcctggtctccatgggttccatattcatgcacttggtgacaccaccaatggttgcatgtcaactggtaattattattgttattacatatatattggcttctcgcctgcctagatgtaccatcaggattgatacaggctatcatcatctgttgaattgattacttatgatgcacttgtttcataatgtagggccacactacaatcctgccggaaaggagcatggagcaccagaagatgagacccgccatgctggtgatcttggaaatgtcaccgctggagaagatggtttgttctttttccctttattccgaatttttatttgttccatacctgttaatgatttaacataaccatattagttgtggtcttgtagtccttaactcattgtcaatttgtagtaatactttattccgaatttttatttgttccatacctgttaatgatttaacataaccatattagttgtggtcttgtagtccttaactcattgtcaatttgtagtaataattgttgctgagagtttatttctctgctgtcaggtgttgctaatatccatgttgttgacagtcaggtaagtaaacattcagaaaaagaacattctccgtcatttgatttatggaaccaataccacacatccccttattattctgctgttaccttgtcttttccttctttctttttcctgtgtgttaacatggataaccatttatctgtgtcagattccacttactggaccaaattcaatcattggcagagccgtcgttgtgcatgccgatcctgatgatcttggaaagggtaatattacagacaactgtttgtgctcatttattttgtctgtgtgcttgtgtgctccttttcttctcttttgctaaggaagatctcactactgttgggtctatgatgacaacaatcactttctattgaatggattgcataaacatgctgagttagtagtcagaaatgtgtagggtccttttgttttatcataccaagttgcacacgactgtgttgtaggcatttttacctttgggggtaaaggatatctgaactttacatggaaaatttgaataagttgttctgctatgccaggcactatttgacttgaatctcctatctgtgcacttcaccataaactatttgacttgaatctcctatctgtgcacttcaccataaacctatctgtgccaattctcattgcagtgagccagttatcagtgcagcttaaataacattcattggttttggtgctcttttaggtgggcacgagctgagcaagaccaccggaaacgctggtggccgtgttgcttgcggtaagttcagaggccgtacaatccagcccacctgaaaatcagcttcgtgtcacatattgatcgactcaccacttcatctccttttctctaattctttcccaattttacttcagggatcatcggacttcaaggctgaaacctggaggtgtgaactcaccttccatctcccagcaccagaagcctgaaactctacgagctcttagccgtttcgtctttacctgagtggctactctagattctacaataagcacctgatctctgcgcatggtttttggtgtaccattctgtcgcccgcatcgttggcgcccaatgaactatgtgttttgtgttaaaccttaagctgaagggtaccatttgtagactcgatgttgctctcttcctcggaatgtcgttacatctgttcgctcgtttcgtccgtacttttgcgattggtcattgttcgctcgtttcatccctctgcttttgcgagtaaacggaacgcaagtaagattggcaatcagtccccgagtccaattgtgtttcgcttatgcttataagtcaaaaattaaaatttaaaatttaatttggagttgattttgtagttttctcaatgtagtttattttttagtatttgttttttaattgcaaaggaaacgtatataaaagtttttctcaatgtggtgaaagagaggatcggatcgtctaggctattgcccaaaagcgtttttctacggggatacggttgtatttcttcaccgatggctaggccagttgcccggttggtctctgccatccaagtggggcgcagcttaacgcgtaaaagtgcagttgaaacttgaaacgagtcgaatagaacgtgcacagcatgttaataagtacacaagtacgaaacgtaggggaaaaaaaagaacaaaaaaaagatagccgggggcattccgagaatcgaactcgggacctctcgcacccaaagcgagaatcataccactagaccaaatgcccttgtgtgatagattacaaacataaaattatataaatttatcaatgttccagtgaaacatataaccaaaattcaaggacacgcaaacacatactcacctatctgctagtgcggccccttgacacacgttaagaaggcggagaaaatgtatttacgtggatgtaatattggtagacaccagcatctgaatcatacaacgacagtttatacctacgaagtttgacaaatgtcacaactcacaatatcgactcatcaagccggtacgaatcggtaaatcggtcaagcttaaaaataaattgaactgaaattcaatttttttttggtagaaaattttttcgggtttcactcgttttcgtcgataacggagatgtaatcatgtctatgcatcgacaaaaccactccaaagctgttttcagttaccgaattgctttgtaaaccgcgtcgttattagatgatccacaagcattacaagatctgttctaactacaaataaagattacactggaggtggagtcgtcgcaacttcttcaatgacactagcaatggtcgcagtagagctgtagaggataagatttgagagcaaagagcaaatccattgttgtcaacttggctgcgcctgcgatcgatcgttggacgcacgacgagaatcactcaaccttcagttgagccaggaagcttcagccgcgtcaacccttagtcaaaaagtagagcgaaaaatcctgcaaaaatccgtcaaatcctgcactaaactcgtgcacatgagatgatcataagcaagctataactacgccatggtgctagccgtggcagatcgaaatgcgcctagtagaaaacattgcatctagaagggcatgcaagcacaagaaacgtttttgttctctctaaaaataccttgcgtgcacacatgactctgcaatctacatcgatcttttgctgaaagtatatgaagatccacaaggcatttttttacagatcgaggaccggaagaatggactaacgtaagtgttttacgaggaagttgcaaataatttttacataaacctcactatgagtcaacacttggtaaggacaatttttcttcttttctgcaagaagaatcaaatatttagataaaaacgatttcatacatccaatcagggctcgcaatatcatttgaattccgtcacccaaaatttaattttaattcattcatccaatcaatttgaattccaaattatattcagctttttattgattggatgtttgaaatcaatttcaaaatttcccttaaaattcatgaaattgatttcgaagtcaactaccataagacttcatacctccaactagttatgttttttctaaaatcaaaatttcccttcaaattcatgaaatttgtctgttttgttccaatataaaattatgaacacttgtccaaacaagccacacatagctacttacaccatctgtctcaaaataaaccaacttctagatatgtatctgaatataacctagatagctaaaagttggtgtttttttttaagggagggagggaatatagtctatagtcccttgcaagaaattgtgcagggatcaaaatcaattgcactccatatgcattaggatcatgctagttagtgtttatttttaatgaagatgaagacagagttatagcacgaaaaatatgaaattaaactattagtgcatgattaactaagttttaattattataaacttaaataatagatttatctgatattttcaaccaattcctactagtatactccctccgtactcgtaaaggaagtcgtttaggacaatgtttaagtcaaaccttgggaatataagggccgttttggtttgataccaaaatgttgccataccaatgttttggtagtttaaatagtaaatgtgatgatttggtttaaagccaaatatttggtaatgcctatactcaatttggcacaattctagaatgttcttcaccataatttgaaatttggctctcaattggcatcaatccaaagacactcatttacaattctaccctaccaaaatattggtagtgccaaaacttgcctagagtttggcactaccgatatattggtagggtactaaaccaaacaagccctaaatcataaataactctcaagttgttgagtttgaaaaagtaaaaattatatgaatagatttgtcttgaaaaatactttcataaaaatatacatatattatttttaataaatatttttatagaaacaagaagtcaaagttgtattttgtaaatcgtatcactgtccaaaatgacttcctttacgagtatggagggagtatactataaagttttcatacgaaatgtacagtttaaccgtttggatagcgtggtgacgaaagatgaggtgaaatttgtatctttatataccaacagcaaggacagtcattgggacagtttgaggcccatggcacattgctttttcctaatttcggaaccaaatcaatcaggaacatgtgggaaacgtacaaagatgggacgctggaatccaaaagaaaacgtaaccgaggcaaatcccgtccttccttcccgtggccttctagaaggcagcccagccctgcactgcacagctgcacatgccgtttgcctaaccctcgtatccttctagaaggagatcaggaggaggaatcaaatcagctggcacctgtcagtatcataaagcctgctgttttcctctgcaattatgcatgcatatccatctaataaaggggttgtacaattaatagacacagtgttccggctggtcggctgatgccttccgagagcaagtacaatagcagactataaactagctataaacagatatctaagacacaatatgcatatgatagatgagaacatacattaatagtataatatatgtttataggtaactattctataaattagctattaagttgactatagatgatttagagctagtagttggctatactattaaacttacttcgaagaatatttatcatatcgaaatgaagagtaattgtttgcaatttaattaataaattataagttatccatttgtcttttctaaaatataaagtagttatattttaaaacagattgagtacataataatgagtggattgtaaattcacgcagcacgagggaagaggggacgaacagttctctaaatttgaagagtactagtaaagataatgatcaaataaacactataatttcacaaagttcatagtaagagtttgttcatttactctcctctgaaatgtggcaaacattttacctatggactatatggcaaacattattctgctgtacgtgttctaattttttaacccaactgatcagacgagaataatacatagcttttccaccgaacaatggttgaccaatatattgatattaacgacctgctcgaaatataatttgacagcgataagcacacgtgatggtaactccagtgtttatgggtgtcactatgtcagagcttactaaatgcaagattagatggagccgataacaaatggtgcatgtagaagggatacttcgaagtatatagagcattggagcacacttttcacatcccttcttctaaagctgcatctcattaccaaaaagaaaaactgtatctcattttgaatttcaaaataaatttaggcaggctttccttcatatatatatgtagcttccgttgtcaaggtttactttcagatggtgtgttcgactgttattttcgcaatagttgcggttgcagcagttcaaaattactgtagcttacagtgattttgaactgtcacagccgcagcggttgcgatagtcttagctacccaacatggccataatttgctaggaagacaactcaaaaaacctaccaaaaattatttttctgaaaaaaaatcacatttcatttttttgtcttttattaagtcacaatttgtttttttttcatgaacgcgtaaaaagattgcatatcaatatattagaagaaaagagttttagttacataacgcaatcagctagaccggcttatgccagaggaagggagaaaagtcaaaataaaaaaactgaagcttagaaaactacggtggctaaacacaaactccaaacaacggtaaggggccaagctatgttacactcctaacagtccccaaaagcagcaacacattttgttttttgatcactgaacaaccaaattgctactccagcttgaactgcttgcttggcagctgcggccgcttttaattattcatcaggagcaagcacagcttttattatcagttaatattcggcaaaacgtgcatgcatgtgcacgtagtacacagaaatactactaatattccctattaactaccactacttggctaagccaagtaggcttctccacgtgtgtatatatatatgactatgtgcacacgtacacgcccaaacttaaccaaaatccacaagcattttcttttacccaccaaacaaacaaatcgatctcttgtgtctcatggccaccgtgcgggcacacccgccggcgccaccgtctccggtgcaggcgccggcgccggcggcgccccctccggtgagcgtcgccgcgcggccgcaggcgccgtactactactactgccacggctggaaggagggcgtggcggagtcgcgctgcccgacgacggatgcggcggcggcggctgcggcggcgaacggtggcgtgatcgagctctcgtcgtcggacagcagcggcggcggcggcggcgccggccgatgggacgatgacgacgacgggtgcagcagctgcgtcgacggcgacgatggcgcggcggccggcggcggcggggcgggccggcgccgcgacgaggaggagaaagggaggagccagcagttcggcagctggtggagccgccatgacagcagcagcagcagcagcttcctctggccgccgccgccgaatgacaacggcgacgacgaggacccggcggcggcggcggcgaggcggcaggaggaggaccgcaagttctgggaggcgtgcctggcctcgggccttccatgaagcctgaaagggtagctatagcaatcgagtatcggatgcgacatacaaatccgtataattctagattgatatattatgatatcggaaaatccgtatagtcgtagattgatatattttgatgtagattgatatattttgatgtcggatgggacgtacaaatccgtatagtcctaagttgatatattctagctggagggagtacaaaactgaccagtaacgtatgtgtgcaatattgcttgttttttgttcagtataaattggttttgtgtttctggattaaacaaacagttttaatcagtaacaaaccctgtggttttggcaacgttgcaagctacaattatgtgagtttggtgcgtgaggtgatggaaagagaacaagggtggttaccttaccttacttagtactagtagttgcttaggaactaacctcttgttgttgatacatagtgcgtgagtgcaatcaacgtgtaggacagattgttcctctccccttttttctttctttcacttttttgcacaaaaagaacattaagaaatttcgttgatatgtaatgcgtgttagcgttgtgttttcccctttacttccttttatttctctatgtaaatagagagttaaattaacgcacatacacacgagtgtacctcccctaacgtaaatcgacgcctaaaatcagattttacaaataaatccacgacaaatttgcatcgcatgcatgtaagtcatgtagctcaatcactaccatgtactagtgttgtcctttgaagacttgaacaagaatggtttgaactttgaacaataatggttggtgggaagcgccaacgtgcttaattttgctgcttccatgactccacccaccagaggcgatggttcttcgatgtttctcattgtctgcgactgcatctggacatctcatctggttcgtctgaacaagaacaactgggtaatcacagtaacaaggggtaagtgaggatacgacgtcgacagaggcgtcggaattaagattcaaagcctaccgttaattttgattaaaaaaaatagtaaccttggattatgtcattatgccttgcaaatgatgcaagggaagtatctcaagtcaggcatggttcaagaagaataaacgaggttaagaaagttaacttggagaagttgaaatgagcaagcggatttgacccaggatttgcattttcgatttcagccaaaaattcggttggaccaaaattttgtgattttcggcactctttggatagttttttttaattttaataaattttgactagatttgaataaactttgaccaaattcaacaaacatttgagaaaatccgaaaatttcggttgatatattgattagccggtgggggtctaaaattaccgaaattacaatcattgatttgaccatagaaaatgtgcatgtaggatcaggttatgtcagcacaaattctcccagcaacggagatgcatgaaacgcacaacctcgcaatgtaaggtcatatgctttgtaacctgcaagtccctgcacattttctcacagttacagggtatcaatggccttacctacaaccaagccactcaggagctgtgcaaatactgcaaaatgtgtatcaagttaaacaactggtaataaagaaacacataaagatgcgatggtaccatccaaatggcaaactgtgtagtatcaagtgaacaactggttataaagaaacgcataaaagatagaacagtaccatctaaatggcatcatgtcttaccatggaaagtgaagcatcctggggacagagttgcttgtaccctccaaaagagaatgggttcctctcatagcatggatgatggagccccaatcaaagaactcttgcaagtaggggagaacaccgtttgtatttgggcaccgcagagtagatagtaatctactccctccgttagccgtttaacatttttcctagtcaatcttctttaactttgatcaaatctatagaaaaatatagtactattttcaacacaaaataaacatattatgaatgttagatttaatgaaattaatttaatattttaggtgttgctaattttttctataaatttgatcaaacttagtaacaaaaaaattaaaccataatatgaaatggatggagtacttagtattttaagcatatctgctggctgtcgcagagacgctcaaatcactggaccagtttgagatgtcggtcgcctgaatgggacaaccgcacatcgctgtcggttggagatactgttctccaattcagaattcagggtcgagcaacttgaatgacatgaactggcaactagaaaaaaggcagcgttcgtttggaggacatcgagggagaaagcatctcgttttccgtacgcacgcttcccaaactactaaacggtgtattttttgtaaaaattttctataggaaagttgctttaaaaaatcatattaatccatttttaaaatttaaaataattaatactcaattaatcatgagctaatggctaaactcgttttgcgtatcttctcaatctcctcaatccccttcttctcaaacacatagtccagcaaaggtctcaagaagaagtcagacagataacagtcgcaccaacaaataagcaatttgagcactgaagaataatatatcttaaagaatcagaccagcaactagatatcatatgctgatatatatgataaaataagttattgttgattcatcttttaggaaaatagtttcttgcaatttctagaattggtaggaagagctaacttactggattttatttatgagagaagatcagcagaatcacatttattctttttgtcatcattcgttcagtgtcattgtttattccatttttgctatgcttttcccttgatggttcaccattcaactggaccttaagataagttctctgcacttttcttgattacaccttccttgttctagccctgaaattacctcccactacctacaactagatgttgatagtttctttaatgactttattataaccgatagaaaagttttttgggtttcaactgattgtcacgccacatttggaatcaaataaagaaggttacttgaatgcttgcttactttattctgtccaaaggcaaatctatagtacagccaatgttttgtatctgaaatgtaaaggtaacctatatacatgtgttggtctcttgattctgtcaagccatcaatctactacctccattttaggataaatgacagcgttgaatatcctgttcaaactttgaccaatagcaatttctatgttgtcattgttggtaggttaaggccctgtttagttccaaatttttttttcaaacttctaactttccatcacatcaaacctttcatacacacaacttttctatcacatcgtatcaatttcaaccaaacttccaaacttcagcgtgaactaaatacagcctaacaatcacactgcttagatttatttcgcatcatactgccataatggtattgtggagttccaagtatataaattcttttgttgaaaaaattgtggtcaaactgtgtatagttcactcaacactgtcaatttggagtacataaaagggatgtagtataatttagttacctgaagcagtagagagcacacacgtggagtacaaaatgatttcaactatgaggtgaaccactgagcaaaatcatcatgaaaaccaccatgtatctgctatgctaatgaagattaaggtattccggagattaaaaaatccaagcacgttggcatgaagattattagagcaagtttaatagtatagctcactactagctccaatttatctatagccaatctaatagctaattcatacaataattatttactatactattaatatatggtcacacctgtcatacacatattgcgtcttggaatccgtgctgcagctggctacagatttgtagcacgctgctcttctctctcatcgtttatctcattaaaatatgtttatagctaactaatagcctgctatctcattacaagcacacagacttacccagtagcttttgagaaattcaatgaatacttgcatgatttcataggattctgtccaaacagtttcctgcttctgtttgaagggtctcagtctctcagcaaatcttgacacagattctggcattgataggtagcttttccacaaagcagaatcattgttgctaccagagtatcaacagacataaatagtgatactgtattactgacctcttctctgaattcacaaaaacaagtgagaaatcatcaacatcatagaagtaaagaaattgcttcccatgctgctgatatctctgtgtatgctcccggatgaatcttcctgtattgactatagtattgcaaatttagcttcataagaaaaacttcaagaatgtttctgtttcttaatgtcaaaagtagaataataacatgatatccccaaccccaccagtatccttttatgttctcagtctagaggaaattcagctcattaagatctcaacaaaaacgccatatctttatttgatctgcagcatgattgtacaaagcagcacagagaatgtaagccgattaggaccggacatcattagggctttgaccacgactacacccccttcagcttgcattatacatgtatttacataaggatcaccaaagaaaatcatctgaagttgacagccaggtccatttgcaaaatggtgatccaaggttttcaggaaattcaccatctgggagaaacatctctacagtagtcgcatacacaggtatacgagtgatgtaatgacccagcagggggacaataggccagaggctgatgctgcatcgtgttagtgcaaatgtattagaaatttaccaccaaagagaagatattgagttcttttagatagagaagggagtgaagaagtcatcagattacatacacaaaagataacagtgtaaagctccatttggcatagcagtgggttatcataatctcgtttagtgtaaccgcttttagtcattttggtgtttgacaaattactttttatttaatccattttgcaagcaataccattattgtgttccaaaaatatggaacaattgggatagttgataacaattttacctaacctaaatctgttctgcgaaaagtataacgatcataggttttcatttccatgacaacttaaaacaaataagcagggcaacaaagcaagcacagaaaccacaaactaatcctttaaaaaagaagagttcgtatatctttgcgcttgtttcattctatgccaggaaagttcactttatacactatattcagatctgaagaaaatatttgttatccgaaaaaggaattaatagttagcgacataagaatattgtttacggaagttttagttgctgtaaataagacatgtatgatgtatgctgacttcacaattctagatggcattttgtggagttcatgaaacatgctttactggcaaaaaaaggaaaatcaatcatctttctttttttttgaacggacaaaaaaaatcaatcatcttgaaaacaagacggtgttccttaattgtcaggattttcatttcatggatacaagatgcggtgtcatggtttttcattatactaaaggcagggtagtctacctcaactatcatcctacacttgtatagaaaataaaaagtgtcaagagttaagacccgtcataaattcaattttgcaatggcaatagatgatctgtcagtaatggtaaaaacatctatagctgaccttagttaattacttggagggagagatttcaagcttgtagccccaaattttagttggtaaaaagaaacacgaatattagaaaatgacctaatatcaaataataagaaggggtgaggtttcgaacccaggttatctagcctaccatcttgtgaagctagccggagcccgaaaaacctttaggtgtttctcaaattatagttggtactcaactgatttatgcgcccaggtggtcagatgctagccagtcctcaagttttaattgaagtctataacaaatcctaatcctgttatccaaggttcgattaagaagacaccaaagaaagaggcaaacaaattgtggacgagccgacggcggcacatctctgagcttgttcacggcaagggtgtagagattggaggaggccgagcgctgccgaggctgtcggccgggtggcgatggcagtgtctcggaggaggagaggctaggaaacccgctctcgctagtccgggcgccatttctttggcttctcgagggagcatggttgcgcgagacataaggcagcctaatcaacacgttacgtcagctaaaactgtcgtagaaaccattaggacccccaaaaaagaagtaaaaaaaaagtaaattacacccacagtacaacaacttgacatatggatgcgatatagtgcaagaacttgataattgaacgtccgagtgcaacaacttgacaagtggttgcgttctagtacaagaacttgacaatttaatattttggcgaatcaatttggctaagcatatgctaggtaaggtttttcacgatgtcaatatgccaatacacagtaatcctatggatattaccttataatattgagtttaatttttaagaattatattgcacatacaatttacattcagttacctttaagaatttttttgttttcttcaccttatcaaatatcaaccgaaatataatagtttctacatccagtttaattgactttcagttattaattattaggataaaaatataaatatgtttatacaaatccacgctagtatattgtcaagtatttaaaattttgaatttatataaaaaaatgctccaaataattaagttatcacaacttcttaatttattgtatcaaaatcgtacctatcttgcaagttgttgcatttatacgatcacttataaagatcttatactaaattgcacattcttgccaagttgttgcactataacgctcattttttaagttattacaccaaattgcatccatctgccaagttgttgtaccgtgggtgcaatttacttaaaaaaaaagtctctttcataatatctcgcagaatttctacatttctgttccccaaaaggggccatgaaactggcatgcaggaatccttcttttatgccaagcaacacggaacgcgaaaaagtaatcacaactcacaagcgcaaaacaagtgcttcattatttgaggaacaaagatgatttttttttgggacatggctcgttcaaagatgtcgtcatgattggtttcaagtgcagtttggtcgtaggatactttagcctaatctaaatcgtcgttgtccttccagccgcaattatcctaaattcccaatcaaaattcaaagccttttcggaagcgacactgccatccactggaagaagaggggaacaaaacaaaaaacaaaacgcagcaagattcctcgcagtctgcatcatcagcccatgccgagccaggcagctgaacccaaaatcattcgagcccgtacgcatcacgcacagcaattgataggttctcaattccagcgaaaactggtcggatcagttcaataagacaaaccactcaatatcctgttcatcttttttaaaaaaaaattcaaactgtttttcttgttttgacaaaatctatccaactctcaatcttgttttgccggtttaccaatgttttccgaaaaaaaaacccggagatatcggttcggtgaccggactgtcaatcctgaacccagctcaccaccaccacttgtaggcttgtggcagcaacaagctgaaaatgacaaggagaaatggaagaaaaaggcagagtctcgctgtgatcacagctcactgttggggagaatgaaaaacggttgtactcccttcgttccataaaaaaccaacatattaccagatatgatactccctccatccaaaaaaaaaaaactaacctagaagttggatgagacataatcttatgtcccatcgaactcctaggttaggttttttttttacggaaggagtacctaaacatatatctatattaggatatgtcacattgatactgatacgttttttatgggatggatggagtactaaaccatttgctaggggcataatacagggatacaggaggaccacgtgaagtttccaagtgattaatgcactgtggatagacaaggatctgtctgaagaaaccagcacggatggatcaggacaggaagagggccatcaccttccccatgaattcatatcaaatcaaaggcttcacatcataaccaccaagtccagttgagataagctcaagaaactatcaagaggagaatatagttatcttaatctaggtagcaaaagcatatggagtagcagtaatcaagagaacatcaactgcatcagctgagagtttttgagctgcaggtcaagtttccagctgcaaaaatctgatgaacacttgacataacagtattgtcacagagcctaccttattcttttggataactatccaatgctgcctgcatcattgactggttcttcacatgaggcagtgaccctattggttagtggagtcaacaagataacaagggtaatatatagtttaccatgacttaaaaaggaaatcctacttaattaacgagagattccagggcacagcacaagtggtctggcaaatcatttagacgccagtggtcaatactatacaagaaccaataacatgccatagcacaacagcgcaactgttcttgggaaactttgtataaaaatcaattcatgcctatacattgagaaatcagtatgaagatggcattttttttttcaaatagacaggtttaagagaaaacaggattgtaagcagttcaattcaaccttataaaacgcacaggcaaatagtaatcaggcagaatatgccaacatggatgacacaaggacacaacctagcattaactagtacttatttaactgaaatttcaggcaacttgcttctatattatatcatcatgcttgctaccattgatcccttgagatttacagctaaaaaaacgtcttaatgacagttgacagaagtatattctgctgtagaacattaagtaatacaacattaagaaaataaccttctctagctatctaaacaagtatcatactatcgttaaccttttatgtaaacagaatagtaaaagaagtatctgatatgaagctgtggaaggatatacttgcaaggaaaagcattccgtggtgatcataacaagccatacattacagattggacgataagatgccatgcataacacccattttatgagcatcttcgattaaacagtcttgaggactccaaccagattaccaggctaatctaacgagagctagagcttgatgatcggaaaggccataggaacgagaacggattccttctcctttgacgtccattggttctcccattgctacttgaactctgactttggttggttgatcttgtgcgcgagcagctagcaccagtagagctctgtggtggcaactcatatcggcaaacagggcaggaattgtgctgttccagccaaggaactatgcaatcagagtggtataaatgcttgcatggcatctcccttgcttctgatcccagctcaaacttgtccttgcagacagggcaatgtgagtctccactgagatgcctctgtgtaatcttcacagtaggcatagcatcaatcgatgattgagtggcaggtggcggccctcgtcgatcattctgagttaattgctcaatcagatcatccagtccaggtccaacaaagtagtctgcaatgtttgctctgcgcatgccaacaccacggcgtccattgatgaatacatcaaaaccattgtcttctgagagatgaccaggaagctggccacggaagagcaaccatggccctgagccaaactccatctccaggtcagaaaatatgtttggccttcctctcacatcaacttcccggttcgttcccgccatgccatgcctcatcacagcagagattgcctccatgataccgaatcttggatcacgatggaaatcaggatccatcccaacaaagtggcgcatgagagcatcaacatcatccatttcagacacaaaaccggaatcacaatagggacactccatatcctggccgcggggcctcacccgctgtctacattggtagcaccagtatgattgcctacctcctgacatttcttccaatcaacgtactgcttccccaaaatccaaaggtgtggtatacctcctccgcactgcaaaaaatggcacaatttctaacatatcagggcaacagctccactagtaatgttacataagcatatcattccaatgcaacttacaaaatccaacaagactgaatacatgaagtttcacaatggtaccaaggcatatagacaagtcaaaaaggcacacagatgggcacctaccatccagtaccagtccaaatcactgaactgtcaaggattacttagaattattcatcaattatcacaaatccgcctaatcgaagtaataattcgctcatgaatgataaagcgattgtttccgaagatataaatttttcgcatgacatttgttaatgaataatcctcctaattaagacatactgcaacatgggaaatttatacatgatccaaactgatgatctttgcctgatctttgcttttttcagataggaattcttgaactcgcaacttctttcagacacatcaggtttccctcttatagagccagggatagtttgtctcacagactaatactagatacttatgttcggttcataggctgcctcacactgatttattcccaaaaaaaaaaaagaaatcaaactggatcaattacactagatgctgcaaccaggctaaaatccaagaacaggctaaattcccactcgcccgtagatcaatcagttcatggtaagactaaaaactctacaacagccaccttttccacacgattcactccattcaaaatgaaaaaaaaaaagaaaaagaaagaaaagaaaactgattgcagataactcccaagattacgcggcccgagcaaacaaattgaatagaaaaaaaacacgcacacgaatagcggtttccgctggttcgattacgataccagataggagaggaggaggcggcggcggtttgtggtggcgaggagcggtgggaggaccggaagaggggaaggcgagatgaactccaccacgaacacacgaacagaaaaggcgaaaaaataatattggaagaagaggaggggatggatccagagagaccatattttatacccactcgagtcgccgagagccccactctcctccccttctcagtgctgcggtggcgcccacgctgtcctcccgggcccacatggcagtggcgtcaggggggaggtgggccccacaggcctcgattcctgagccgcgtcgtccccctcgctttccgccgcgagaaagatgcctcctcgccccgtagcccacggcctgcccggggccagcgcagtgactggcatgtggggccagagtgcgcttcgggcccacgtgtcagtgtgggctttggacatggtgggggtgggattttgcgtcggggacgatgtggagcgggggaattttaaaatattcggagccacggaatacgaggctagatcggccgtcggtgggaggaatggacggcccggatgggatgtcccgtcacgtggttgcctcgtcaagctgtcgagggcggccatttcggtcctcaccgagaaatcggtccgggcaatcgcgcaaatgggaaaaaccgaacttatctaaaaaaccatgttccggttaaccgaaccgcagtttgatcttcggtctaaaccaagctgaccgcgcagtggcactgtggcagatctcgcattggggtgaatctcctctgcggtattaacctctgacttgggtcaatgacacgtgggcctaatgagcatgggtctatatgtcagtcactcaaagtcaaaggatagtactgcaaatgatatgtttcccttgcattggaccaactgcggtcttattcggccatccgggtaaccaataaataagagctaagaaccgagaatttgattggtcttctcacagctaagaccgaacaggagaccagtgactaatttatctgttttttttaatcgtgatacggttttttcattgtcggtcttcggtcttgatttttttttgtccacccttagtagggagtagggtgtccaagtcctatttggtggcttttaaaaagtatcgcttctcaaacaattcaattcagtttgtcacaatgagtccaaattaaagcaaagacaagtgtcaatttcatcggggtctttaaatatctttgtttttatagttatttttaatatctaaaattgtaaaatatgttttttataacaattatatatcagttttaaatttaagtcattctcttgtaaaaatggaaataaggccggcaaccaaaatgtaattttaaattcaaaattaagatatatagcttttaggataaaggtatgccaaaagccggctctaaatatcaacgttctcaattttttttagataatcaacgttctcaattcttgcaacatttttgttataattgaaattgtcgacgggggttaccagtagaccggatatagagggtattggggtacgctggtacgaggatctacgtaatacgacatcgagtaggcagaaaacaaagattatactggttcaggccccttgataggtaatagccataatccagttgatatgggattatatgatggaaaccacagattacaaagggaatagtggaactcgacgataccgacgagatcgtagtcgagttgattcgactagatcacccggcgacttggctcctgtaggctccggcttcgtaggctgtggtggatgtgttggcggtaagattcgatgcccaaggtcctccccggggggtcccttttgtaccacaggtcaactggtctccaagtaagactcggagacatcggacccgatacgatacaatgacgacccagttctatccgagtaggactccttccatctgtgaactccataatgaatttccttaacgtatgccgaaaacgtccgtatacgcgcaagtataccatatcaatatgtgacgtatatcgaagggtaaagggtataccttacccgtaaccctgacagtagcccccgacttctgcttatatgaactcgtgaaaccgatcgcgacttctgatgtcgaagttgtcgtcgttctcggtgtgaggactgagagacaaggagtgatcgacaacgccaggtgaagctcaacggtcatgagtgaatttaaattgaagtccgaaaaactgccgcgcgtaacggacccagaaatttccgacggccatctctctcctttccttggaattcgcaccgtcggaagtgcgtctatttaagggagttttggggatccaatttgaagtccgcctgttgtgaaaaaactctccagcccccaagcgtccctcgtcttctccgctcccgcaaaaaaccctagctagctcatctcggtcctttctccggcgatccccggcggcaatggatctcgacaagtctacctccaccagcacgtcgctaaagaagttgcaggaggatggcgcccttcccggtcgcgggaccgcggagagagaagtaggaggtactgaaccccaacctgtcctaggtcgcatggttgtgatcgaggactttattctctgtggttttcttcctccgccttctgaatttcttctcttggtcttgaatttctacagtctttccttgctccatttgaaccccaattccatcgccttcatgagtatcttttcgcatctttgtgaggcctacattggggtagagccgtttcttgacctcttccgcttttactatgagttgagttggatggaacccaaaaaggtgtctggatgtgtcggtttccgacttcgggatggcctgaagtcgcgatacatcctcttccagtgcccctcatctcgcagcaaatggcgggggaggtggttctatcttcagatagaagattcggatccggtttttattgttcctgaggagcaactagacaagatttcatcttggaccgccaaactcgccttgaccccatccctccaatctttcatcgatatcattgatgacctccgagtacggggattgtcggggtatgaagtcgctgccgacttcattggtaggcggatctagccgctccaggctcgagcccatccagcctttgattattctgggccggaggacgcgacccgggtttctcctcggggtatttttctttttagttaaattggctcccttatgtgcgtgttcttcccgacttatcggattctggtctcgatctacaggcttggacagcgcaaccgtggagcgccgtgtcggccaactgatgatcactggcccgacaacggcgagcaacgtccaagtccccctttgcgagaaaggggcagccgagcgcgacgttgccatcaatgtaagtgtactcagcggtccttttgcatttttcttccgggatcgcattatgacttcatgaagcgtaggctctccctctgactgatatcatcgggccgctcgtggaccatcaggtggcggcgtcgctgaagaagaaagtcgccaaggaggtgtctgacgctgttgctgctgctgccacaacgagtggcggcaacgttctgaaaaaggggaggaaattctcttctgtggtcggacatcgtcggaagacacccaccccctcggtaagttctcctgttctttcatcacgtagtcagaaaacttccacctcacatcatatccgttatactccaggcctcggacgcgtctcccccgcctccacgtcggcaacggctagtgacgcttggcgagaagcaagtggatgactttgaggttttgtcacttcgtcaaactgttgcagcctgtctcagttgcagcttttcgcagggcggcgtgggcgaaggcggcgcaagacgggtctggagggacctccagcgcgtctcctatcgtggcctcgacggatgtcgtggtcgtgcccaggagccgcgaggcaacacctagcggcccagctagcaatctcgccactggtcgaggtctgccggctgccatcctcacctgggaggagctccaggttgagatggggtgcctccttgaggctggtgctcgcggcattagccgcgagatcgcggaggcgagggcggcggcggcggcgtcggcgaatgagcgcgccgaccggctggcgcatgatttggcggaggttcgcgaggacctccagaagatgcgggagctggtggccggcaataagcgacaacggcagggactcgagcaccgcatgtcggagcgcgagaacaacttgtcggaaatccgtggctcgttgcgagtcacctatactggtctgcaccagctcgccggggagtgcggtatcaagtctaccatcccggcgaatcccgatgagttctcgccgacgacttctcttgcggagctggcgacggcgatggaggagatcccctccaagcacgcggctaggattggagaggagacgtccaacgggatctataccggggcgtgccatgtccttgcgtgtgtgagactggcgcaccctaaactcgatctgcggaaaatcttggatcagggggcggctagcgacgcgcgcaaggatgtgatggaagaagtcggcgatctgggggagtctgttctcccactttttgaagagtaggattttgactctcttgtactccttagtcatgctttgtaaaactttcattggttccaaccgcctttgtgtatgcagtcatcgccttagctttctttagcattttgatcttgagtactttgttgtcgtctgtagagatgttgatgtcgaggatgtccagcagcgcgggcagcctgagttgccagtgatcgttccggcacttgcgttcgagccacatgtgccggagggcgatgtagctcaaaattcgcctgtggaaacgagcatggcgacgactcccttaggttggttatctttgttttcatctcctttactcttccgtctggatcgacttgatttgttgtattctcgtgagagaagagcagtttgacttagtcgtttccatgctgagcagacctcgagagtgcgcttgctgaccaggatcgtcgcatccagtattggaggacgaagtttgaggtcgcggaactcgagaggactatgctggaagtgaagaaggaccaggccgtggagacactccggggccgcgaggtgtggttcaactcgtatctgaagagtttctgcacctccatgtcaagggtctgtagagagctccgggtaccccgtggggatcccgagaaatcggcgactggatacatcccgtggctgaatggggcctgcgcccagcttgagggcatcagccagcgtatcgacgaggccctgaagcaggagtgtcgtcgatcgagccaatatgccgggggcatgtattggcctgtatatgagatcatcgtccgcagctgcacctcgagttcctccatgaagggttttctcgttctcggagaactcctacggagatagatggcctggcgaagtcgatggcgccgctggcggaaaaggtcttccagtctatggactagcattggccttcctggtagtctccgtgtcctatgacaaatgtcctaggggaagagtgtaatataattttggatttttatagaattgtaagaagtacttgtgaaatagaaaagaaatctatccaactaagctttcttactctggatgtattgtgtatgagtgtcttctcacttcgcgacttcgattagtcgtttgagttatacactctccctagcccccagcattgtcatcggagaattcttctcggaagataaggctcttggacctttgacctgcctcggttgaacaagcactgatcctagcccccagccgtgaagttggaaagtttatttccgattacacggcttggttaatacgcatggcgagaactcttacacgaccagatcttacatggtcttttgtctctacaggatccgacaaggtcttatcggctctgggcggccccagctgaagttcccttaggttcctcggaggccttgttaagacagcgtaaagggacatgagggtaggtttcaacgctaggtgtcatctaggtaagggatcatcgggaaggaacactttgattttggtctggacctgaaaaataggctttattgaagctgtaagatgtcttacaagtatggatactattgacttatacatagaatttacgtaattgatgaatgttccaggaatttgccaactcgcgacaatcgccatctgcaattttgaatgcgcctggccgcagaacttgtgtgatcgtgtacggtccttcccatttgggtgagagcttgtttcgccctgcttggctttgaacacgtcggaggacgtagtcgccgatcgaaagcgtgcgtgctcggatgcgcttctcgtggtaacggtgaagggcctgttggtagctggctgctcgaacggtaactcgttcgcgatgttcctcaaacagattcacatcgtcatttcgctgctcctcctgatcctcatcggaatatttctgtactcgtgtactttgatgtcgtagctcggtggggagcatggcctctgagccgtacacaaggaagaagggtgtctccttgttggatgttgtcggtgtggtacgcacggcccatagtactgatggaagttcttcgtcctacttcttgtcatgtgacatgagcttgtcatagacgcgggtcttgattccttgtagtactatgccgtttgccctctcgacttgtccattgctctgagggtgagaaaccgaggcgaagcagatcttgactcccagcctgatgcagtaatcctagaaaacggcactgatgaactgggagccgttgtccgttatgatacggtggggcaatccgaatctgcagaatatccctttgatgaatttgatggcgttgtcggccttgatttcccccgtgggtgtcgcttcaatccacttagtgaatttgtcgatcgccacgaataggaacctgtagccgtcctgtcctcgtgggaatggcccgagtatatctagcccccagcacgagaacggccaagtgagagggatagtcttgagtgcttgcgctggtagccttgtgtgtttactgtgaaattgacaggcttcacaccgctgaaccatgtcgcaggagtctttgagggcggttggccagaagaacccttgtcgaaaagcttttccgactaatgtccgaccgggcggcatgtgacccacagatcccttcatgtatgtcgaggaggagatgtctgccgtcgtcggacgagacgcattttaggagtaccccatttgatgccttcttgtatagatcattgccgatcatatagtagacctttgctttacaggatattttctcagcttctgcgtcgtcctcgggcaactctttgctgcctatgaatttgatgagtggggtgcgccagtcgtctgtggtctcgatatcggcaacgacgcgctctacctctgtagcccccgagctgttgttgagggagaccgggctatcttcaccgcttgcgtctttcactgatggccttgtcaggacgtctagaaaggtgccaggttcgagtggctctcgtctggacgcacgccgtgctatatcatctggttcaatgttgtccttgcggtatacatgtcggacctcgatcccatcgaaccttttttctagctttctgacttctgcgagatacttggataatgtcacgcccagaaattcccgaatagaattccaagcagaatgtgcattaaactccccgtccaggaccagccggggtacacaaacgacaatgttgacattcagatccacgtcttacaaacatcataaaagtcttacagaaatgcagcggaaaacaaaagaaactggagctaagccttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctaaagtggttcatttgcataaatactggcatttataaacaggaatttaatgcgaaaacagttgtaataattaagcagtattaaacatccgctgtccaacgctaacccacgttgcgacaggcccaaccttccacctaaactatccaagttcaacaaattacactagggtgagactaatcacggtgaatctggttgaccgcccataaccgcgggcacggctattcgaatagttttactctgatcagaggtgtacaactgtacccacaggacacagccccacgacacgtttccgtgcgccgacatgccaccacgacataccggaaagaggccgtgacaggacccttcacataaccccctctaaccaagcacaccacacctcaggtttcacccccactgctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttaattaaccaacaccaaagcggtgccgctaatccaacattatcataaaaacctatagtctaggttttaaatgagatctccccattgtgtgctagttgaactaagcatggctaagcaaaccctagtcctaactctaatcatgttataacccaagctaacaaaggagcatggtatcaaaataacatggctgtaacaaaaggtaaccatcccatagtataattgcaaaacaaatgcgatatttgaaagaaaacattaggacatttgcaatataggatcaatatgatcaagtgacaagcatgacttgccttgctctgctgctggaggaacctcggcgactatctcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaaaaccttaaatcatttattgcgcaatattaaccagggctgacgtcagcacggaggggtgcggcgccgacatgcgggacccaccggtcagcgacccgggagagagagaaaggggcggcggctcgcgggcccactgtcagcggcacgggagatggaaggggcggcggctccacgtggcggccgaaccgacggccccgatctacccaagggtagatcggacggcggtgggagctcgcggccgggcgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcagctaggcggcgacgcggcggctaaacggtgcgggagagagagaaaacgaggaggagggcctcaccgacaacggtcgacgacggcgggcgacggaggacgatggcgacggcgggacgagctcggtacctcctaacgaacaaaaggagagggattagagggagaggaaagagcgcgagagagcgagagcgccggccgaaggccgcggccatggcgtcactcaccggcgcacgacggggacgggtctccggcggcgaacctcaacggggaagaggcggccgaggtagatctcgaccccgcgaatctaacggcggcgacggcgcaagacggcggcgagcctagcggcggctagcggcggccgaagtagcaaaaacggcggcggcgggtggttgcaaggcgcggggacgattgggagctcgggaggggtcggcgaaatggggaaaaagcgagagggggtgccggcgatgcttaaataggggaagagagggccggacgtggccggaagaggcgggattcgccggccgacgtgggggagtggggaggagagagaggcgggattcggttttcgaatcccggccatctcgggcgcgggcgcgagcgggagagagaggggaacgggcgcgggaaacgcggcgcacgcgcgggcgtggtcgacgtggcccggggaaggcggagacgtgggcgcggcggcggtttcgggcgcggcggcgcgccgggatcggcgggaggagggagacgggcccgacaggtgggccccacctgtcggcgaccccgagaggagggaggcgggcagccggctaccgggctgggcctcggcctgcggccggcccaacagagaggggggggaaggaaaagggaaatgggccgacggcccatttgacaagaaggaggaaaaagagaggaaaaaagaaaaagaaaaagaaaaaggattttccctggaattaacaatattgcttgctcaattttaattggttaaaattatttctagagctctgaaaattccactaaaaatcctgttaatgaattttgacatgtagaactcaagaaaaattccacatgtccaatccgattattatttgcattactttattagggttttctcctgatttcacctgcattttcttggggtcatttgtaaattcaatttttggcttgggaggaaaacttcggggtgtgacagataactcggggttagagcacttgtaatctttatgcacctggttcgtgactagttcggaatctcctttcatgattagtcgcctgactccgagtgcagctgcagctcttatcccggcgagtagtccttcgtactcggctgtgttattagtcgccctgaagttgaggtgaattgcatgcttgaattgatctcctaaaggtgatgtcaagatgaatcttgccccctgctccttggctattgagtgcgccgtcgaacgccattgtccacgtttcgttgtctatttggttgtctgacctgttatcaggcatagtccaatcggctacaaagtcggcaagtacctgggacttgatgactgttcgtggcacaaagtggacatcaaactggcttagctcgactacccatttcgtaatgcggccgacaacgtctttgtttctcactacttcaccgagagggaaggaggatacaactgtgaccctgtgggcttgaaagtagtggcgtagctttcttaatgtcatgattaccgcgtagagcagtttttggatctgttgatatcttgtctttgcgtcgtggagagcttcgctgacatagtagactggtcgttgcaccttctctctctcgacaacaatgacagtgctaatgaaatatggcgtggcggcaatatagagaaataattcttcaataggttagggggcaacaagtacaggtggatttgataggtagcgcttgagtgcaatgaatgcctcttcggctttctgtgtccatacaaatttgtcttgctttttcagcagagcgaagaaaggttgtcctcgctctcccatcctagcgacgaacctgcttagtgccgccatgcatccggttagcttctgtacttccttgagtcttgtaggcgacttcatgttctcgattgccttgatcttctcgggatttgcttctattcctctgccagagccgaggaagccgagcagcttgcctgatggtactctgaacgtgcacttctctggattgagcatgaggcgatatcgtcggaggctgtcaaacgtttcccgcaaatcatcaatcaatgagtcgcttgacttggtcttgacaacaatgtcgtcgacgtaggcctcgacattgtttccgagttggtcgctaagtgagccctggaccgtgcgctggaaagtgtttcctgcggttattagtccgaacggcatcttaacgtagcagaatactccgaacggcgtgatgaatgctgtcttctcctcgtcctctttcgccatactgatttggtggtagccggagtaagcgtcgaggaagctcaacaactcacaaccggctgttgagtccaccagttggtctattcgaggaagagggaagtgatccttgggacacgccttgttgaggtcggtgaaatcgacacacattctccatttctcgttggcgttccgcaccatgacagggttggctagccactctggatggagtacctctctgatgaagccaactttgagaagcttgtcgagctcttctcgtatggcttgttttcgatctagtgcaaatctccgcagtttttgctttactggcttggcgtcgggtcgcaccatgagtttgtgctcaatcacctccctgggtacccccggcatgtcggacggctgccaaacgaacacgtcagcattgtcgtggaggaaggtgatgagcgcgagttcctatttttggcctagtaatgccccgatcttgacggtcttgtcggggttggcactggagagtggaaagattttgattgcgccatccggtttcagtgtcttgtttgttttgctcactttcttgggtggctcagctgtggcgggtgggctgggtgtgtgcttgaccatgttgaggctccgcttgtcgcattgcactaccaacttagcattcccttgaatagtgattgttcccttcggtcccggcatcttgagcacttgatacgctagtgagatgcgaccatgaacttcgcgagtgcagttctcctaatgatggcattgtatgctgcatcgaattcagcgacatcaaagttgatctgttccgttcggaacttatttgcttggccgaaagtcacaggcaatgtaattttacccaatggtttggacgatgactggggtgtgattccatggaagggttgatcggtgggtgtcaactcgcttcgtgggatccccattgtatccaaggtgctggcgaagagaaggttgattgagttgctgccgtcaatcagaactcgtgcgaccttgatattccgaatagtgggttcgaccacgatcggatatcgccctgggatgacagcagtcttgaggtggtcctcttcagagaattctatcttctgctcagactacttcatcttgggcgcagctccctgccacgtcgaacagacttcacgttccaccttcttatattctcgctttgaggagtatgtcgtggaacctccaaagatgtgcgagacatggagatcagagtctgggtatgctgagtccgattctagagtagccgcttcagcgtccttctcgaccacatgcactcgcttgcctttttccaatgccatgtgtattgcgagcgacttttttgaagacgaggcaatcttatagagagtgtctatctgacttgtgtatagggcaccatgttttcttcgtgtcgctgtcttgtgggtctacgcgcttgggagagtccgcgtattctgttgtgagaacatccgcttgagcttaacttttcctactcttgcaattttacttcttgctcgactcaggtgcgtctttgactggtttcttctctcctccggtcttcggtttgtcgttcttgcgtctnnnnnnnnnnnnnnnnnnnnnnnntcgatcgacaattgctcccatcatatttcactattgctcctggtcagaatctttcaggccatcggacatctcgaagtgaacgaccgaaagctctacacccatcgctgggggcggtgggttgtcggcgatcgtacatccttcgtggatgtctatctgatgttgaggatgaggaagatgacaacgatgacgatgggtcgcttggttccggcgtacgattacgaggacatcggctgggttctcgagaatcctgtcgtcgtctcccgttgttgtttcggcgccgatctccatcatcgtcgtcattatggcgacgtcctcgaccagtatcacccagcacccgccgttcgcgatcgtcgtaatcgtggcggttgtggcggttatcacggtctcggtcttcgctcgaatggcctcctcgttcttcgttatcgtgacgccgtgaagagacgcgatgtcaggaatggttctcattgtctcgtgtgcgtagcgcctctcggcagccattcaggtgatcgcggagatcaccggtgctgcgaggtggaggggtggctcgatgaggcgattcccgctgttcagggttttcaccattagcatcgccagttggtggctgttccgggtgtgctgcagcagcggcctcttcgaacgcgttgctgaggttggtcactgattcccgtaaccgttctgtccatcgtgcgagatcgtcgttcagaacgggatcgtaggtggtttctcccagtattgcattgacaaccctgatgtgctgggccggtggtcacttgattccctgcttccgcattggcgcgcgctgacgtgctggtctcgtcgataaccaatacctcgcgcggcgtattcgttgacgatgagccatagtcttcgagcaggtgcaagactgatggttcgtggggatcgatgtcgattactccaacaaatcgatctaaaattagcgtcgctcctttttccttgtcctcatccctgagggggatgtgtgactgctggaccttagaaggtgacgttttcatggcgctgagaaagaccttgcagcttgagaggtcgtgattctttgttttgtgaataggacaatagacatcacgagttggtaaagtacgctgaattccacgctctttgcaggcatgaatttcagcgtggacgttgagaaaaacccagcaggcttgcgaggtgtgttttctggttttgtggataggacaccaggaccttgtcacctcggaagtcatcctcgtcggctcgtgattcttgtcggaaagacaaggtttggccgcactaggatccttctcaggctcggatgtcgtcgacgttccgatctccgcttcggcgggaggatccttcaacatgtagtcgtcctgggttatagccactgcgttctcgtttccggccattgacggaccagctgagatcggcactgtggtgtaaaccgggaagacgatttcgccgacttgagtccacaccagtgttgttgaagtaggaactccttggttgaggttggtgttgacgccgttgtcgacgaagctggatgtcatagtagtagaaccttgagcaccaagtgcccctacctggcgcgccactgtcgacgggggatacccgtagaccggatatagagggtattagggtacactggtacgaggatctacgtaatacgacatcgagtaggcagaaaacaaagattatactggttcaggccccttgataggtaatagccctaatctagttgatatgggattatatgatggaaaccacagattacaaagggaatagtggaactcgacgataccgacgagatcgtagtcgagttgattcgactagatcacccggcgacttggctcctgtaggctccggcttcgtaggctgtggtggatgtgttggcggtaagattcgatgccctaggtcctctccggggggtcccttttataccgcaggtcaactggtctccaagtaggactcggagacatcggacccgatacgatataatgacgacccagttcaatccgagtaggattccttccatctgtgaactccataatgaatttccttaacgtatgccaaaaacatccgtatacgcgcaagtataccatatcgatatgtgacgtatatcaaaaagtagagggtatactttacccgtaaccctgacagaaatgcagagctttcaaaaagaactgctcattcttccaattatatttcttgtatttatttatgcccccgtctcggcaagtgttttatagatgatgcattcacaagtgcgtagactatataacgtgaatatacatttttttgtgtaattgaaaaaaaaagttcccacatctcagtttgaacctcaaacaccggtacaccgtcttgcctttaggtttttgaatttttatgattcttaatcttttaattctaaacataaatcatctctttacttatttctaaacctgaatatttgttgccacgccacttcgtctgtgcgtgacgaaataatattgtcacaccatcaataatcgatttattgatgtgaaaattttgctttgtcatgtcaatatgaatggcttggcaagagaacgttgccacgtgcccacgtcagccagagtgcgtgtggcaaaataacaccgtcacactagccagggtagtgtgatactctctccgtcccataatataagggattttgatattttgcttgcactgtttgatcactcgtcttattcaaaaattttgtgaaaatataaaaaagcgaaaagttgtgcgtaaagtacttcagataataaagtaagtcaaaaaaataattaataattccaaaaaaaatttaatacgacgaatgttcaaacggtgcaagcaaaaagtaagtaaaaaataaataataattccaaaaaatttttaatacgacgagtggtcaaacagtataagcaaaaagtcaaaatcccttatattagaggacggagggagtagtattgttctagatgacatggcaacggtatttcatgacaccactcttgctgacgtggtcgaaagattcagtttaaaaataagttttgttatgatttaggctgtgtttagttccactctaaaattggaagtttaaaaaaattagaacgatatgacggaataattggaagtttgtgggtgtaggaaagttcgatgtgacggaaaagttagaaatttgaaaaaaaaattggaaaacaggacattactttaaaattaaaattttaaaaggttaaaaaaaaatcttggcctccccccctctctctctccactaaaaaagcatgttcgtttgaagctccattgttccactccacggttcaactaaccaccaaattaccagactacccctcggagctcgaggccaagggccgccatggatcgccgggacatggcgagccaccgcggccggagttccactcgtggccacggatggggccgaggctggcgaggtcggggagaaggccgcggccttggtctcagccgcggcgccggcccctcaccgccacctcctccttcctcctccacctcttccttcccggcggcggccagcgccaccgcggctggtaccggcggcgacgccccgccgatcgtgggcagctgccccgacatgtgcccaggtaacgcgcttcgtccaagcctcccgtgcgctcacgccgacgctggctgacctgacctgacccccgtttggcggggcgaattgccccccacctgttcgacgaaattgcgcgatcagttggcccctaattggatggatttggttggcgcgttttagctcatggatgctactgttttttttcctgctgcagcgagggagagggcgcagagggagcggctgagggacctggcggtgttcgagcgggtgggcggcgaccccgcgcgcacgtccccttccctcgccgtgaagaaggtgagccatccatttttctccgtactcatgtggaggccattcctgattttttttttctttttgaacttgcggttgggtcgtggtgatgcttcactgctggtcatttttggtgcgtatctgcttggattgttctctccatgcaaatggacaggctatagcttggttccattccatgtggtggtttagtctgttttgattggatttgatatggagctggaagcttttttttgtgcatgcaactgtgcatgtatttttgcttaaaagggtgatcagttgccgttaagcatgtgttggaacaatcaacactttatgttagatgtagctatatagttacatatgccaccaataatgcaataacagcaatgcagcactaaatctgatctacgcttgtcttgtccaatcactgccagagtgtaaggaagctattcgggtagcctagccttcaagagattgaatgtacgatagtgtcagatttatatttattttgtttgatttctttttatagtttattggatgaaatataaccctacttagtacttaccttgtactagtatttttgcaggggtgaagatatgatgaaaggacaggattatcaattcatttaatacttatttttatcttgaatatgtggtcatgtttgcagataaaagaaagcaatgtgcaaaagcagattatgattttttttacattatttatttagcatgccattgttattaggtaaaaagagcttgtatcaacgaaaataatagttatacaatgagatatcatgttctgcacacttgaggtgaaactgtcggaattcatttacttgccactgcaaacttgagtaaaaatgccactgaaaaatcataaaaggtgtgtaagataatgaatctttaccaaccacatagaatagccaatttgccacctgaaaacactgttataattacaaatttgcactacagtttcatgtggtctgaaagatttcatgaaccgcgtgtgttttaagagaatcaggtagctatttgagaattctgtgtatctccgttccttttctaacacttggtttcctgctagttttgcagaactatctcttccacgagtgtacaggcatcagatatacgccctctcccagtcctgcgagaaacaatggattatcttttgcatttattggattcctcagagcatcagtttgagatagttcatgattttatatttgataggacaaggtctgtgaggcaagacctcagtattcagaacatagtgaatgcccaagcaattcaaatatacgaggatgtggtacactcatatcatccatgtttttatcttattgtatagacctctgaattttagggtacttatttgtctggtttagattgttgtgtctggaatctaacttttaacattatagaattgagcatccttatactctatcacagaactactactcaacaactttctctttgttttccttgtaaggttatgttccatcctttttaagtagttgaggccagaaaattcactcatccaaactcttgttagatagagtaatactcgatatgcataaaatgttgttgaggttctcgccttttctctctaattggtttgggagaaagtatgtttcttttccgattatgcatgaattagttctttcaggcattttctacttggcatctgtgttagccactaagtggtcctttttgttcgttagatgctgttatcttttgatgttatgctgccggatgtcattttgttaaggtggaggaacatatttgcttcaagtgcaagcatatagggtagattattcctctttcacagctttatctgatgcatgcccctgccttctgcagataaagtttcatattctatcccatcagaagctttctaggtcttcccaggattctgatgcttcttccctgtgttacctaaacatggagcagctaatgaagtgccttctttctctgtttgatatgtatgatgtaattcacaagaacaattcacagagtagtaaagagactgaatattattccttctacgtgcttctacatttgggctgcaagatacccaaaatggtttgcccccaatttttattgccttctaaataatctaatttatgttattctcttgttcccaatactttcttcttactccagctagtgaatagtagcctaatttcctgtttatctccaggtagattcactctctttgtggtatggccatctatctgcttcaattatacaatcaaaggaaatggtatttgctagatctatattaaggtaactttatgcatattatttgtatcaacatacatagagccttcatttttgtcatgctctaagagccatcatgcttcttgagtcttctttgtgcacagcagtatgatttgggacaactcagaagtgctaactattgagacacatcattttaaacttaattgatatatatatgttctgatcttctttctgcagattctaccacctaggaaacttcaagcgtttcttctgcgccatagcagctgaaggaaccgatcttcagctgcgtctgttagaaccttttctcaatgaggtaagccgaacagcaattttgacccttttaatgataaggtgatatccttgccttctgtatgtacatttgagcctgttatatccatatggtatctgttatctagcttttacaaacatagttgttaagtgtaaagtaggtgcccagttgcccacatactgctgaagtgtttaattgtttgtgcaaaaaaacgaattgctgcaattgttagttaaattttcctcacccgttttaaaattgtgttctgatcctttcagtatgaatgagaattatctcaagtttgtgttatgctagtggttgttaccagcacatttctttattcacaagctttaatattgctggatatatttcgttctgacatatcaattttttttgcctgctttgctgccaaaggctcgtgttagagcattaatgtacttcaatcatagtggctacaaacttcaacaccaccctttgacacatttatcagaaatcctaatgatcgaggtacgcggacaccacccttcgacatatatttttactgcagttgtgcattttagttgcagctttagtgaacagttctaaaatcatcagctggatgttgattcttgttttggaacttctttaggagctggacctggaaactctttgtagattatgtggacttgaaattagcaacaacgaagatacgaaagcttttgctcctaaacaggcgagtttctgcgtaccagcatcaattcctcaaattaatggcatttacatatcaagggagaatcaaaggtgaaaaaaatattgtagcgaatgtaaaatgtactccattcttcacttgttcagttgtgtgctaaagcacctatacttccaagtatccaatacggaaagcaattgatcccagtaaaagaaaattacgaatgataacagtacattttcttgtattctctccaacaaagtgtattttgtgagcttcgatgagtagttcagtattctcttctgatgttctcacaatatgctaatggttgctggtattgttggtgatttgattctcgtctattttgcaattcgatcgcatctaatgccattaccagaattttgctttctgctatgcaaaagtaacagtggatttgtcgattccaaatttccaatcgattctaacaccccgaactaatgtttgaatcaagagaaaccagagataccctgtcactttaacctgacaaagttcgtgcgattctgatagcccttgccgccggcgagggagatacgattctgctagcacttgccggcggcgagtcgagggagatagaggacctggacgccggcggcctggagctcggacaagctcacggcgccggggaagttcaagagcgataagatatcaagtgaagttttgttataacggcagcgatacttcgctcccaataattccggagcatctatcacacacaaaattgataacatcgaatgagggaaagaggatgggagggcaatttcatagttcaggactgctcttgtcttcaggaactaggaatctaggtgttttttttaactctgcttccaacaacactaatcagaaagatcagccatgcaagtaggcaaaccgatcactcagtcgctgtcctccgtcttggacttcttctttttcttcttcccttcagtggccgtcttaggctcagcgtcctccgagacttcacggttcttcttcttcttcttcttgggagtaccgttctcctcggcgtcgccattggcatgcgccacgctcttctcctgctcctgtggctcctcctccagcttgtgcttcttcttctttttcttcttctcagttccaggctcagcttcatcagccacattggaaggcttgtccaggtccattgcttcgccgtcagcttcagctttagacttctttttcttacttttcttggcagatgcatcgaccttctcgccatctgcacaatgcacagtttataaatgatagtaacatgtagctcaatgttagcatttctggcaaccgaagttagccaacttaccatcaacatcatttgtggcatcattaaccatgctgtctatcgcagctttcatcacatcaaggtttttacgaggtgcaacacccttgtcatagaagtctaaccgctcctcaacttgctcacgaagcttttgcccaaagactgcggtagctgactctgaattccaaaatatggcagcaagttctttcagcaaaagcagtaactagtggacatacaaattggaaacagaactatgcaactaacctgaataacaatcaatgcgtgatgcaatggagcacttgttcgccagatatctagccattctgcctttgttcttggttgaagcacggccaatgaaggatgagtggaatataaggccatactttggcgtattccccctagttttcaatgccctgggagaaagtaaagaagcataagaagttgacgtatactctatgatcagtactttgaaacaactttccatacagttacttggaatttgagagctaccaagaaatcagtcagttttaacaacctgaaaagtgccttttcagcaccaagtatctggagagtggaggcaggacacttagcaaggtttgaaagactgccagcatgagagataaggcgtgctccaacaacttcaccaattaatgatgttagattcggtgcaatatcattcatcttggtaacaagatactcataaaggtttttacgatattcagacagattcatgactctttgagcaaactgcttcacattcatcaaatcaacttctgacagatcctgacctgaaaagcaaaaggatcaataaaccacaaaaactactacaaagaaactactagatttatattacaacggaagttaaatgtaatcatatctcattacccattgaagcctttgctgcttcgacaacttcttttg

SEQ ID NO: 73583 - DNA, 2466 bp, Oryza sativa
  unsure (1)..(2466): unsure at all n locations
tgctctatgatttaacaatgtggtgctacagtaaatatttgctaatgacgaattaattaggcttaataaattcgtctcgcagtttactaacggattctcgcggtttgattagccctaagtgctatagtaacccatatgtgctaatgacggattaattagacttaataaatctgtttcacggtttccagacaagtttgaaattagttttttcattcgtatctgaaaaccccttccgacatctggtcactactggagaaaccatctttgcttggttgaccaaaaactacactagtctcggtagagaaggcggagacgttggcgagcggcgggagctcaacggcggcggcgacatcctgtcggcgacggagcacttcaacgatgcgtactccatcggcaaggggagcttcgggaccgtgtacagcgccgacctcggcggcgggcgcaccgacctcggcatgaagcggctagacgcatcagagaccggcgacgcgtgctgcggtannnnnnnnnnnnnnnnnnnnnnnnnnngaacgtcggcaccgaggggatgcgacgcatcggtgtgaacgagaagccaaacgctgtgttgctgctgttgggcgtgccgagggcgataaaaagcatcgtgttgctgtcgaagaagatcatagaaagagaggaagaagaacagagaaagagagatagacaagtggacccatgggcaaacttgtctttaaccaaagtttctctccccgttttcattgaaaaataataaaataatagaagaagtgtctagcagctaattaccactttttacagtatccatgagcaaatacacgatcttcgggtgtctcacagcaaagaccacaatctttgagtgtcctgtaccaaattttgcctaaataaataagttctgaatgactatatacctattaatgaataaaaatatattttattatacaattgattgctcggttcacaccatcatattcaccgattattaatactaactgtccattaaacttcctataaactctcttaagttgtcacgtggcatcctcacaaacgctcttaggctgccatgtgacgctctaataaattatagaaaattctaaaaaaacaaaatatctaacccttaatattcacttaaattagtgtgtccaatattacataactactattaggagtgtattcgagcgctaaacatacatcagcccaggcccaccccaccccacgtaccgtcatcccacttctaccgttgtcggagtaaacaatttactcctatcgggcgcctctacctcccatctttactcgagtaaacgatttacttcaataataaaaacaactttctgcttccgatcccacaccacgtccatatcgtgctcccaccattatcggagtaaatgatttacttcgataaaaacaacttctctgcttccggtatatattctatttttcccgtacccaaccaaccactctcgaccccacttcattttttttctttttttcggatctgaatcgatccaccatctcagtccacagatcagtgacacaccatggaggaggacgatgacaccgtggcggttgatggcggtggccggtggtggttgaggcgacggcactacttcgggcctcgctgtcggacgctgggcagcaccttaaccaagaaggaggtattcacctggaccaatagcaacaaccaacagctgctccacgtcagcgatattgatagaacaagcaagtaaggaaatgatactctgatttgcatctacatactctccttcaacttcgtgcatgaagccccaatatttttttttgcaaatcaaattaacgtgcaatctccaatattacctgatctcaattgatgggctgcacaattcatacatttgcacatcgtgctccatgtggctggctgcagaggatagggtagagtccgccggtgatggaaattgtttgctatttttcttttgctcgtcatctccattgacatgaaggagaatgttttttgcatttttttcatgcttactagatgatggatggctactagtgcgcaacgtcgagctcatctctagaccataccgctacatccttccatgatttcataatcgactactgctcgctacctggttgccatctccactaccagtcacaagacacagacaatcctcttcatccttatggcaagatccagcaaagccactagatggatttttgactaaatcttcttttttttttctaatttgattcacctgtgagtatttttatctcttgcgtgtgattgagcctgtaattttttcattcatacgactattttgtgatatagatcaacaatattcttagtactaatttttactcttatattgtatattgaacacattagtaaacatattactacacggtggctacgagatcatggctatatcgagaggaaagtggtaactgttttactcgcagaccacggaatgtcttttgtttactcttatactg

SEQ ID NO: 73584 - DNA, 7573 bp, Oryza sativa
tttgcagagtgaaaattaaatgagattaaaaaattcagagccaggagagctaacccacatgcaaatcatgattggattggatgtgccgcgcgtctcctccaactcatggctgtctattcctttcatccctatgatgatcatttcagaatagtttcatcctattaggtgtttgtttgttctaccatccaagcatgcaactaactaaactaacacaatctgtactttttttctcctacagaaaatgtagaggctggcaagagtggaagaactagtttttgtttgttaaaaaaatgtcaaacctaccaaattcagtctgaagaaagaaagacaatgatatactccgccaaagtataactaaagttcagaagccaactataactactgaagatgaggctataatactattgaaagtatatgtataatttttttctaaaactttaataacattcataagtacacccaaaacttatatacgcagaatatcttcccttaaataaaaaccataatcttaaagaggctgaatataatgtatttttgtgttatcacatctatggactaaaattaaagaattggaggaacttttcgttttgattgtgttccaaacaaaagaaaagaaaaaggaggagaagaattggaggggcagggacagcagggcagtggcatgtgatgtgaaccaaccaatgcaatgcaaagccgacccgacccgacggcgcgtttggtcagtcaaattaaaaccgggtgccagcgccggtgtggttacctcctccctcaccaacggctcagcctgccacctcaccctcacacaccaacccattacatctccctctctgtcctacgatttcacaggaattttggtacacagccatcaagaccatatattctttcttctattaattcccctgtctcccctctcactctattttattgcatcgttatatcgaaacaccagaaatattttaggttattattacaaccatatgttgtatagtatttgtaatacgctacaggtatatatatgttagagttacatgtgtacatattaaattggtattaaaataaaaggcgtcgtctaaatgttacccatatcatcttaccttcaactcttttgtaggttctattacagtaaatctccgtaatttctaagcatataacaaatatcatatcatgaaaatgttaaaatggcatttagaggatatgatcaatgtgtaacagtaatctccataaccatttaattatatatatcggttaccgcaatttaattaaaatgagcattttggacatcatgagtccatttcaactttgaatctgtatgacccgtttttgtgaaacttttttccttcacattctatcatatggtggtgcacaccctaataccattatcatctaaatgtttgacattgacctatccatacaagaaaggctctagaaatgcataaatgatctttaattaccaatatgttctcttgaggtatcggtctaagccttgtcagtcaacgtggatccttgatggcccaatctcctataatttgaccaattcaatattgttgttttgatagaagctaagtcaaaagtcggatgaatcaatcaaatgcattgaatctatccatgccacgtgtgtaaatcatgccataagaactgatataatttaattttatacctccctgatgtcaaattataccctagaaattttgaaccttctaaaccttcatattgttagattaatttttaccttaacataagccacgttagagtggaaccaacttttcagactcacgcaacgagctgcaatgatatttataaatattttaaatgatgacgcccataaactacatcagacaaaatgtaaaataccaaaaatattagtattgagaaagaagcaacataattcagtccagaatttaattttgaagctgttgagcaacccgggtaggaacccagcccactagcttatcctgcgttattttcatcaacttcaaaccatctccgttagcacataaatttttttatgtaaaagttcttttttaaaaaaatcaaaaaaatctaatttttaaatttgcaataattaatactaattaatcatatgcggtttcttgtatttcacgtgtcgccgaaaatctacctataactttaaaaaaacacacccttactcctagcaacaccttgacttctcgcatttacaaactatatacatagttttgagttccgctacttataatatggttataatacgaatgtaataaatataatacttttataaataaaaaaaattatagaaacaaccctctacatcctcctgataaacaaacacacatacattggcacatggcatttgctcctctgtcaatcaatcaattaacttaattaaaaaaggaaaagctaaaaccaggagagaaaagcacacgccttttccccccctcttcttctaacacgcgcgttctgacgacgaacacacggagatagagaaagagagagtagaggagagaggaagctgccgcaacgacgaccagttggctggctctcttctgtagcagtagcaactagcaaagctgctgtatttaagttcaccgcgggtcaccacaccagctcacacacgctgtgctgctgctgctgccgctgctcctcctcctcctcttacatcccatcctcgccgcgatttccttcgccgccgccgccggcttcgtcttcttccccggcgccggggcacgcgaaaaggtgcgatcttgacgccggattcggcgccctctcgccctccctccccgaaagttcgctgctttttgctccgatctgtgcccggaatctctcgtgggtggatggatggattggactcggtgtgatctcttcttctttcgctggtggttgctccgccctcggggggcggttcagggttggggatttgggtgggtttggtggctggttctttggtgggttgccggctctgaatctggagggagcttgggttgggttccctttcttggttggtcaactttgatagtagcgtttactgtgaggtgagggggaagaagaactagctcctctcgtttttagctgtgattgctgcgcctgattcgtttgattcggttgttcgtctgattttttttttctcgctgaattctgcggcttcttgagctttgccaaagaccacggtgtgttactctttccgttagttggaggagaacatgttagttgattaacagcttgttgcgattagctaactgcgtgtattcgaggttgcggtagcatatcaattaggaataatgtccaattttgtagcgtcatgattgcaattgaagttttactgtgttcaatcattggcgtagtacttgtaggtataggcaagattgatgtttcagtgctgtaggagttgtgtggatttaggacagtgctagggataaagatgcgattgatgattggtcgagcttctttggcatgcatcctgaattggagtggtgcgaggacatgaccgcgtgagctaccggcatgagtgaagcagtgtgcccatgcaaataatttttgcatgctgttcttccatgctattctgtttagtctagtgcagactttgaagtggttatgaacttgtcacatttaatcagttgcctcacattctgcccttgtgttcataggatacatgtttgatttacaaatatggcatccaattaataatgcaatgttctaaccactggaagggtggctgaatgaataatttaataaaatttccatctgatgtgtattattggtgtctagggctaatgtggtatgtaaccctgtaggaaattggtaattattaacgatgccactgcagaatgagctgtcttctcatcagctctaataggaaaaggtggttattagttctggccttaggcagatttcaatcctacctgggcatcctttgcttagtttgtttccagcatatcagtatatttggttccagtgaacttgccgtgctgatcaagaattgtagtggttaagtttgtctggtgaaagaagcagtgttacctgaaaaatgtggccaattgttttttgccgaattgagcaccccaaatctaaaacgtactcggattcagcaaccttgtcgtcttctgagtagtatcttgcatgccgtttctctttccgaaatcacacacatgagccaactcgcttgtccgtttccgataatactgggaagaagagacaaatgagataactcatatgtggttttagtagctcagcactaccattataccattcaccatgcattgatacgtggtaccttcaagtagttcatcgggcatttgtggacataattcatttgattgtcctggttgggttgagaaaatgcacaaaaagttacataaaaagaataaggaaatgatgggaacaaaatggcttgtggagaaattactgatagatcttttagcacctcctttatttattccacatatgtcatgttctatgcattccactctctgcaaggtaagtgtgaaccctgagttttcgaagttaatttatttcattcactttcctattatctccacactttcatcaggttatttgtccatctacatagtattaactagttcaatcatgtgtctgtttgaatgtcttatggtggtgtatttgtgtttgcacttctgcttgtgtttttcaatttgtgctcattcaatttctctctctttgaccgtctgtctgatgctacttttctgtaaactaaatgcatgttgctggtttctaataaaaatctgcatgattctgttccagggtttgtttctagtagaatatgtcgtgctttgcatgctgtggtgatgaagatactcaaggagtaccagacaacaggaatccatacccagggaaccatccagcaagtaatggcactgggccttttgttataatcatctgcattgtcccattacatactgtggtttacagatggtgctcaagttttactgaactgcaatttgtctgcagggagcgatgcatatcgcacagctgatccaactccaagaggtcctcaacctgtgaaagtgcaaccaattgcagtccccatcattcctgttgatgaaattagggaagtgactaagaattttggtgatgaagctttgattggtgaaggttcctttggcagagtgtattttggtgttctaagaaatggtagaagtgcagcggtcaaaaagctagactctagtaagcagccagaccaagaatttttggcacaggtttttttttatctctgttaggaattctgcaacaagttttctttttcttgcaactcatttcaaaatgcatccacaggtatctatggtgtcgaggcttaagcatgaacatgttgttgagctgcttggttattgtgttgatggaaatctccgtgtccttgcttatgagtttgcgactatgggttctcttcatgatatgcttcatggtatggtctttgcacatctgtgcttttgtttcctttattcatatcttgaactcttgatagaattatggtgttattttaaactttgaataccattaaatgtggaaattgtatgtttacaggaaggaagggtgttaaaggagctcaacctggtccagtcttatcatgggcacaacgtgtgaagatagctgttggggcagcaaaaggcctggagtatcttcatgagaaagcacagcctcatatcatacacagggacatcaagtccagcaatgttctccttttcatgatgatgttgctaaaatagctgactttgatttgtcaaaccaagctcctgacatggcagctcggcttcactctactagggttcttggaacctttggatatcatgcacctgagtatgttctggttttcttcaattctctataaaccttcagaattatatcaactactaatgttggtctaaattctgtggccaggtatgcaatgactggacagcttagctccaagagtgatgtgtacagttttggagttgttcttcttgagctattgaccggaaggaaacctgttgaccatacattaccaaggggacagcagagtcttgtgacttgggtaagtttcaatcgcatatgctattcgcggttattggaatattctggcttgcattctatttggtgggctgaattaatggtttattcaacattggcaggccaccccaaggcttagtgaagacaaggttaggcaatgtgttgactcaagacttggaggggactatcctcctaaagctgtcgcaaaggtatccgatattcagagacaacctcttttctgttttatcaccataggttattgaactagcagtctccagaaactatcttgacaacgtgcaaaaggaagctgatggctaaagattaattaaacagctaaccctaggattatatgtctgaaattcacatcgttcatgaagcatgtctggattcaacattaaatttgtcgtagatctattgtttgcagcacttgtacttgagattatgtttccttgtaagcccagtttttaaacatttgttcttctgtatgtttcaaacagtttgcagctgttgcggcgttatgcgttcagtatgaagcggactttcgaccaaacatgagcattgtcgtgaaagcgctgcaacccctgctgaatgctcgggcaactaaccctggagaaaatgccgggtcataaaactttggtctaccttttgtatgatagatattaagttaagaagtatgagacatcgatattgttcttgcggatgtgtggctggctggaagtgtgtacatttgtgattattcgtcccttgttgtaatcaccaaggttctacgcaaccgaaaatatttgattcttcgcatcgggtgagacataacttgtctgaaggtgacatgcatatctatctaccttactcaagagggaaaacaaaattctgcatcttgaactgaactgaactgaactgaacttgccttctcttgttctgcatttgattgatctttgtgcagaagaaatgcccccaaatttgtccatattttcttcccattacctcagcattgcagatttgggccttggcacggttgttcagaacaagtgcgtcctgtttgcatactgaacctctgaaattttcagagttcagaatcaggaactagctcaatcaactgaaaatgctaaagattagaacaagcgaaccatgccagcattaacataaccgcaacgcggccagacataaattaaggtagatctgtaactacaatattgcttaattatgagcttacataagctagcagcaactgcactacagtactacaatactacagactaatcttggatgtcggcaaattcagttggggcatcatctgacgactgatcatgcagcaatgacctacttgactacatctctggcttcctgaactatagactatgagcaaggtgctcacctaacactggaatatactactaagtagcattctttacacaggatgctgtttcatcgctttgtgagcatcactagtgcgagcattgacatggaggcgatgaacttgaagctctggttctcccagaagttgtgcttgtcatcacggtatgggacactgggttgcttcatgcccacctgatccttcagctccttcagttgcttgtctcttttctcaccagcctgaagaagc

SEQ ID NO: 73585 - DNA, 5148 bp, Oryza sativa
tgttgtcaacgaggctgaatgtcatagtagtaaaaccttaagtaccaagtccccctactggcgcgccactgtcgacgggtgatacccgtagaccggatatagagggtattggggtacgttggtacaaggatctacgtagtacgacatcaagcaaacaaaagacgagaattatactggttcaggcccctagataggtaatagtcctaatccagttgatgtgggattatatggtggaaaacacaggttacaaagggaacaatggaacttgtcggatccggcgagatcgtagtcgagttggttcaactagatctcgatggcttggctccttgcaggctccggcttcgtagcctgtgtgggttgtgttggctctgagattcgatgccttaggtcctccccggggggtcccttttatattgcagacctggaggtctccaagtagaactcggagatatcaggccctgtacgatacattaacgacccaatcttgtccgagtaggattcttcccatccatagattctgtgaaggatttccttagagtacgcaggaagtatccgtatgcgcgtggatataccataccgatatgtaacgtatattaaagggtaaagggtatgcctaacccgtagccctgatgcatgtagcccccgacttctgcttaaaatgaactcgtgtaaccattcgcgacttcgggtgtcgagactgttgtcgttcctagtgcgaggaccgcggagacaggccgtagtcgagcacgccatttgaagcccaacggtcacgagcgaattttaaactaagtccaaaaaaccgccgcgcgtaacggacccagaaatttccggcaggcatctctctctgttccttggaattcgcaccgttggtagtgcgcctatttaaaggaatgttggggatccattttgaagtccgcccaccgtgcagaaaatattccacctgtaagcgctcttcgccttcttcaccgccacaagaaaccctagttcatcaacctaggccctttctccggcgatcttcgattagcgatggacctcaggaaatcatcttccaccagtgcgtcgctgaagaagcttcaggaagacggcgcccttcccggtcgtggaaccatggagagggaagcaggaggtactaatccccagcccgtcttaggtcgcatggttgcgatcgaagactatattctctgcggttttctccctccgccttccgaattccttctcctagttttgaacttctatggtctttctcttcttcatttgaaccccaattctatcgcttttcttagcatctttgctcatctttgcgaggcctacattggtgtagagccttttcttgatctctttcgcttctactacgagctgcgttggatggagtccaacagggtatctggttgcgtcgggttctgacttcgggatggcctgaagtcgcgttatatccccttccagtgcccttcttctcacagcaaatggcggaataggtggctctatcttgagatcaaagattcagaccctgtcttcgttgttcccaaagaacaacctgacaagatttcgtcttggaccgcaaagccccccttgaccccctctcttcagtcgtttatcgacatcatcgacgacttccgagtacggggcttgtcggggtatgaagtcattgcagacttcgttggtaggcggatccagccgttccaagctcgggcccatccagcctttaactattccggaccggaggacgcgacccgggtttctcctcggggtatctttctcgcatttttcttgacatgtgtacgttcgcgttcctcttgatttatcgaagtttggttctcgattcacaggtttgaacagcgaaaccatggagcgccgcgtcgaccaggtgatgatcagtggtctgacaacggcgagtgacatccccgtgcccctttgtgagaagggggcagccgaacgcaatgacgctatcaacgtaagtgtactcgataggcatcccgcattttcctttcgagatcaccttaagacttgattaagcgtaggctcttcctctgactgacatcatcgggccgctcgcggaccatcaggtggcggcgtctctgaaagagaaggcgccaaggaggcgtctgatgctgctgctgccacaactagcggtcgcaatgttccgacaaaggggaggaagttctcctctgtaagcggacatcgtcgcaaggcgtcgaccccctgggtaatttatcctgtcgtcagatcgtgcagccagaaggattttgccttactttgcattgattgtctttcaggcctcggacgcgtctcccccgcctccacgacgacaacgtattgtgacgattggcgagaagtaagtagatgaacttttagatttccgtgattctattcaagcgttgtctgacccgtggtcgtcccgtagggaggcgcgggcaaaggctgtgcaagccaagttcggagggacttccagcgcgtcgcctgccgtggcctcgacggatgtcgcgctcacagccgggagccgggaggcgacgcctagcggcccagtcagcgatcccgcggcaggtcgtggtccgccaattgccggcctcaccttggaggagctccaagtcgaaatgaggcgcctcctcgaagctggtgctcgcggcatcgaccgcgagattgcagaggcaaggtcggaagcagcgctggcgaatgcgcgtgctgaccggttggtgcgtgagttggctgaagcccgtgaagacctcacgaagatgagggaattggtgtccggcaacgagcgacaacggaaggggctcgaggaccgcctgtcggaactcgggaacaacctgtcggaaatccggggttcgttgtgggtcacctacactggcctgcaccagctctccggggagtgcggcatcaagtctaccatcccggtgaatcccgacgagttctcgctgacctcctcccttgcggaactggcaacgacgatgggggagatcccccccaagcatgcagccaggattgcggaggagacgtcgagcgggatctacaccggggagtgtcatgtcctcgcgtgtgtaaagcagtcgcgtcctgaactcgatctgcgcgagatcttggatcagggggcggccagcgacacgcgtgaggaggtgatggaagaagtcggtgatctgggagagtctattctccccctatttgaagagtaggacttcttgtacttccaagacacgctgtgtaaaacttgaattctgaccgccttcgtgcgtgcaattatcattctagtttacttttgtatgttgacctcggaaacttttgtcctttgtagagatgctgatgatgaggatatccagcagtgcggccagcccgagtcactggcgataatttcggtactcgagtttgagccacacgtgtcgcccgacaatgtggaccagacccttgatacggagacagggatgacgacgacttcctcaggttagtagtccattcatcccttgatgccctcccgactaggtcaaccgtgttctcgaaagaggtgtgcagcttgacttagtggttatcacattaagaagatctcgagggtgcccttgctggccaagatcatcgtatccaatactggaagatgaagtttgaagtggcggaactcgagagaaccatgctggcagtgaagaaagagcaggctgtggaaacgctccaaggtcgcgaggtgtggtttaactcgtacttgaagagttgctgcacatctatggccagggtctgtagagaacttcgagtggtccgcggagatcccgaggagtcggcggccggatacatctcatggctgaacggggcctgtgcccaactcaatggcatcggcaagcgtatcgacgaggccttgaagcaggagtgtcgtcgatcgagccggtatgccggagggcacgtgttggcttgcccgcgagatcatcgtccgcgcttggacctcgactttctccatgagggttttgctcgttctcagaggactccggcggagatagaccatctggcgaggtcgatgtcgccgttggccgagaagatcttccagtctatggactggcgttggccttcttggtagtattcgtaccctgtgacagatatcttggaaaaaaagtgtaatttagcaaaagatttgtgtaaaaactgtaagaagtattttgtgaaatagaaaagaaatctatctttaacaaatgtttcttactctggatgtcgtgtgtaagagtgtgttctcagtacacgactttagtcagccgtttaagtcgtacactctccctggctcccagccttgtcgtcggaggaattttctcggaggataaggctcttggacttttgacctgccttggttgaataagctctgatcctagcccccagccgtgaagttggaaagttaatttccgatttcatggcttggttaatacgcacggcgagaactcttacacgaccagatcttacatggtcttttgtctctacaggatctgacaaggccttatcggctttgggtgtccccagccgacgatcccttaggttcctcggaggccttgtcaagacagcgtaaagggacataaggacaggtttcaacgctaggtgtcatcagggtaagggatcatcgggtgaaaaacactttgattgtaatatgggcctaaaaataggctttattgatactgtaaggtgtcttacaggtatggatggtattgactcatacatagaatttacgtagttggtcaatgttccaagaatttgctaactcgcgaccgtcgccgtctgcgattttgaatgcgcctggccgcaagacttgtgtgatcgtgtaaggtccttcccattttggtgagagtttgtttcgccctgcttggctttgaacccgtcggaggacatagtcgccgatcgaaagtatgcgtgctcggatgcgcttctcgtggtaacgtcggagggcctgttgatagctggctgctcgaacggcaactcgttcacgatgctcctcgagaagatttacatcgatgtctcactgttcctcctggtcctcgtcggagcgcttctgtactcgtgtattctgatgtcatagctcaccggggagcatagcctcagagccgtacacgaggaagaagggtgtttccttgttagacgttgtcggtgtggtgcgtacgacccatagtactgatgggagttcttcaacccattttt

SEQ ID NO: 73586 - DNA, 12666 bp, Oryza sativa
tgtcatgatgaccgcgtaaagcagcttttggatctgtgggtatcttgtctttgcgtcgtggagagcttcgctaacgtagtagactggtcgttgtactttctctctctcgacaacaatgacggtgctaacggaatatagtgtggcggcaatatagaggaataattcttcattaggttggggagcaacgagtacaggggggtttgataggtagcgcttgagtgcaacgaatgcctcttcggcttcctgtgtccatacaaatttgtcttgtttcttcagcagagcgaagaaaggttatcctcgttctcccatcctagcgacgaacctactcagtgctgccatgcatccggttagcttttgtacctccttaagtcttatgggcgacttcatgttctcgattgccttgatcttctcgggatttgcttctattcctctgccaaagacaaggaatccgagcagcttgcccgacggtactccgaacgtgcacttctctggattgagcatgaggcgatatcgtcggaggctgtcgagcgtttcccacagatcgtcaatcaatgagtcgcatgtcttggttttgacaacgatatcgtcgacgtatgcctcgacattgttgccgagctggtcactaagtgcgccctggaccgtgcgctggaaggtattccctgcggttatcagtccgaacgggtatcttaacatagcaaaataccctgaacggcgtgatgaatgctatcttctcttcgtcctcttttgccatgctgatttggtggtagccagagtaagcgtcgaggaagctcaacagcttgcaaccggctgttgaatccaccagttgatctattcgagggagagggaagtgatccttagggcacgccttattgaggtcggtgaagtcgacgcacattctccattttccgttggccttccgcaccatgactggattggctagccactctggatgaagtacttctctgatgaagccggctttgagaagtttgtcgagctcttctcgtatagcttgttttcggtctggtgcaaatctccgcagtctttgctttactggcttggcatcgggtcgcaccatgagtttatgctcaatcacctccctagggacccccggcatgtcggacggctgccaagcgaacacgtcagcattatcacggaggaaggtgatgagcgcgagttcctatttctcgtttagtgtcgccccaatcttgacggtcttgtcggggttggcactggagagtggaacgatcttgatggtgccgtccggtttcggcgtcttgtttgtcttgctcactttcttgggtggctcagtcgtggcgggtgggctgggcgtttgctcgaccatgtcgaggctccgcttgtcgcactgcaccgccagctttgcgttcccttgaatagtgattgttcccttcagtcccgacatcttgagcacttgatacgcgtagtgagatgcggccatgaacttcgcaagtgcagttctcccgataatggcgttgtaagctgtatcgaattcagcgacatcaaaggtgatctgctctgttcggaagttgttggcttggccgaaagtcacgggcaacgtaatcttgcccaatggtctggacgatgattggggaataattccgtggaagggttgattggttggtgtcaactcgctttgcggaattcccatcgcgtccaaagtgctggcgaaaagaagattgattgagctgccaccgtcgatgaggactcgcgctaccttgatgttccgaatagtgggttcgaccacgatcggatatcgtcctgggatgacggcggtcttggggtggtcttcttccgagaactctatcttctgctcagaccacttcatcttgggtgcagccccctgccatgtcgaacagacttcacattccactttcttgtattctcgctttgaggagtatggtgtggaaccgccgaagatgtgtgaaacgtggaggtcgaagtctggatacgctgaatccgattcgtgaggaaccgcctcctcgttcttctcgaccacgcgtactcgcttgcctttttcaaatgcgatgtgcttctcgagcgattttttgaaaacaaggcaatcttccagagaatgtctgtccgtcttgtgtatggggcaccatactttctttgtgtcgctactttgtgggtatgggcgcttgggagggttcgcgtattctgctgcgaggacttctgcttgagctttccttttcccatttttgcgatttttcttcttgcttgactcagatgcgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctaggtagtgtagcgatctctgacaccggatttgaaggcgcgaattacagaagcgtcgatgatttcggggattgtatttctgcactcgttgaagcgccgaacatattccctcaatgattcaccagagttctgtgtcaacgcatgtaggtcgtcttcgatcgcgtggtgcttgtatgtttcttggaaattggcgacgaactgttgccacaggtctgcccacgaagagattgagtagggaggaagatgcatcagccatgaacgtgcagaacctttcaacgcagttggtaaataatttgccaacgcgttgtcgtctgctccggcagtgtagagtactgtggagtagacttgaaggaactcctctgggtcggtgctcccatcatacttttctattactccaggtcggaatctcttaggccatcggacatcacgcagggaacgaccgaaagccctacacccagcgttgggggcggtgggttgtcggcggtcgtgtgtccttcgtggatgtctgtctgacgatgaggaggacgatgatgatgacgatgacgatgggttgcttggttccggcatacgattacgaggatgtcggcctggatctcgggaatcctgtcgtcgtctcccgctgttgtctcggcgccgatctccgtcatcgtcgttgttatggtgacggcctctaccagtattgtctggcacccatcgttcgcgatcgttgtgatcgtggtggttgtcctggtctcggtcctcgtttgagcggtttcctcgatttccgttatcatggcgccgtgaagagacatgatgccgagaacgattcacattgtctcgtgtgcgtcgtgcctctcggtggccgttgatgtgatctcggagatcgccagtgccgcgaggtggaggggtagctcgttgaggtgattccctcctttccgggtcttcaccattggcatcgccagttggtggctgctccgggtgcgctgcggtagcgacttcttcgaacgcgttgctgaggttggtcactgattcccgtagtcgttctgtccaacgctcgaggtcatcgttcagaacgggatcgtagggagtttccctcagtatagcttgaacggccctaatgtgctgggctggagaagtcaattgactccccggttctgcgttggcgtgcgcttatcgatgacccatagtcttcgagaaggtgtaagaccgatggttcgtgaggattgatatcgaataccccaacgaatcgatctgaagttggagtcgctccatgttccttgtcgttatccctgatggggacgtatgacttaggagacagagctttcatggcgctgagaaagaccttgcagcttgagaggtcgtgattctttgtcttctgaataggacaatagacatcacgagttggagaaatacgctgaattccacgctctttgcaggcgcgaattttggcgcagacgttgaggaaaacccaacaggcttgcaaagtgtgtttcctggttttgtggataggacaccagaaccttgtggcttcggaagtcatctttgtcggctcgcggttcatgtcggaaggacaaggtttggccgcatcagaatccttcttgagctcggatgtcgtcgatgctccgttctccgtctcagcgggaggatttttcgacatggagtcgccttggtttgtagccactgcgttctcgtttccggtcattggaggaccagttgagatcggcgtagtggtgtaaaccgggaagacgatttcgccgacttgagtccacaccagcatcgttgaagcagggagtacttggctgaggttggtgttgacgctgttgtcgacgaggctggatgtcatagtagtaaaaccttgagtaccaagtccccctacctggcgcgccactgtcgacgggtgatacccgtagaccggatatagagggtattggggtacgttggtacaaggatctacgtagtacgacatcaagcaaacaaaagacgagaattatactggttcaggccccttgataggtaatagccctaatccagttgatgtggggttatatggtggaaaacacaggttacaaagagaacaatggaacttgtcgaatccggcgagatcgtagtcgagttggttcgactagatctcgatggcttggctccttgcaggctccggcttcgtaggctgtgtgggttgtgttggctctgagattcgatgccttaggtcctccccggggggtcccttttatattgcagacctggaggtctccaagtagaactcggagatatcaggccctgtacgatacactaacgacccaatcttgtccgagtaggattcttcccatccatagattctgtgaaggatttccttagagtacgcaggaagtatccgtatacgcgtgggtataccataccgatatgtaacgtatatcgaagggtaaaggatatgcctaacccgtaaccctgacaactttgcagatgtagattgcatcatcgtatacatttataatgtttgaagaaagtttactgcattgtatagttatattctttacacatctatatgtacatttgttgatggttgttattgatcagtttcgaccgtcaatattaccaaaataaaggagaactagtgatgcttacaatgcatatacttgttagaataataatattcctctagtatttggttcactaaccttttgcagagaataaccataaagtggaggagaatcggcatcaactcaaacgataaatcaatcggcatcaactcaaacgataaatcaatcggacgatgtcgagaatcagacttatgcgtgaatgggccaagaactcagaattgacacgatgaattgggccaaaattcacaagtctgcgtaaatgagcaatagaggaggccgccagccaaagatgggccgggatggcccagcctatggttcggccgaacccatcctggcgccgttggatgcagggttcggcgtggacgtccaagattgcatcccaatgacggttggagggcacttcagacaattccccttccacaactataacagccctccctccagaaccgcgtagcccagcacaactgacgagcgggcccacttatacacaccaccccacttacacttttgtcctcgcttcgtgtaaaagggttaaccctggagtgatgtggttggagggaagaggccttataagtcggttccactcgtgctaaactagcaaggtggtactaaacatatgcacacagctcacatgggccacacaggcctaatccttattgggccgggatgtcacatccacccccctcaaaggacccgatgtccccgtcgatccaactttcccagccacacaggcatacaagcaaatgtccaggaacacaccccctcttagcgcacgtccgtacgtccagtgtcgatgccatatgccatgccttgtgcctcacacagagcccacatgcgccatgcgccatatgcccgaccccgtacgtctagtgtcgatgccatatgccatgccttgtgcctcacacagagcccacatgcgccatgcgccatatgcccgaccccgtacgtccagtgtcgatgccatatgccatgccttgtgcattgtgcctcacacaaagcccacatgcgccatgcgccatatgcccgacccgacgtccccgtcggtccaacttacccaggcacacaggcatacaggcaaatgtccaggaacacaccccctcttagcgcacgtccgtacgtccagtgtcgatgccatatgccatgccttgtgcctcacacagagcccacatgcgccatgcgccatatgaccgcacactgacccgtacgtgcaaccgcgagggtcggctctgataccatttgtaacagccctccctccagaaccgcgtagcccagcccaaccgacgagcgggcccacttacacacaccaccccacttacactttcgtcctcgcttcgtttaaaagggttaacctaggagtgatgtggttggagggaagaggccttataagtcggttccactcgtgctaaactagcaaggtggtattaaacatgcgcacacagctcacatgggccacacaggcctaatccttattgggccaggatgtcacaacaaccgtcataactacctctatataaggacttcaccttctcacttcactcacacacctcaagcaagagctctctcatattctcttaagtttagtttagtagtatcaagctagtggaatagtaatagagtagaaatcaagagtccggaagtcttcggaagagttcgggtatggctctagtagatttcctttcctcttttgtaagctttgtactttatttagaatactcttttttatacatttatggtattgaaatactttccgagtatatgaatgcctactttacattatgttcatgttatactgattatactgctagcttatctagcttatctgagagatactttggtgcgggtataatgtttgcatatgcaattactctatgtcatgacgatgatattagagtagtatctggtagtttaaacgtggtgtctagattacgggatatcattatttggggttatatgctacggatgagaggtgggccgctgatggtgacagctcagtacgggtatttctccgcgcgtgtatatagtcctaagttaattccctagggagggtactcgtccgtatttagccccggttgtatggtcatgatgggctgtcgtaaggaactcagcagtcaggggtggcttctcgaagtaccaggagagtatcggatagagagtattagctagtatatcagttaactaggatgtatgtgtactatgtatattagaagtataggaatagattatctttctcttttctttccacttagcttagataatatattatgagattgagtagctgatgcttgtgtgtcactctacccttggtttatcttaacccctacttagaatatgattatcacaagtaatatataaattattagtcaagttctctctacatgatcttcccacgggataaaataaatatgatacccttggaatactctcgggtgaaatgctacaatggtatatttgtgcgcttgcggataaactctgtaaccataatataccagaagtatttctacgccattgctgggaattatatttctagtaatatcgttaagaaataccaactattatatactgaaaatccattaaatgtctactatatactaaaagttcattgaattcccaaaaatgctctcaaactgtgtcacgtggctttctacaaacgttattaagacgtcatatgacgatctaataaattagaaaaaatccttaaaaaattgataaaaaggaaaaaaaatctaaccattgatattcttttagataggtggaccccactaattttaactgttagatcgccaaaaacaaaattccagtacacccaaccccaccgtatttgggcacacatgtacgtacatactccctcaatcctccaactctccctcgggatcccactctcctctcccattttcgagctaacttttcctattttctagctaacacaaaatataataataataataataataataataaagttaaaatgatcatgactctcaagttacatgcacttttctcaatttatttgcaaattttcatttcccgtgtttttctgcactacactgaaacatccgttcttttcaacactctattttacacatgtattcctatcatatgtatgtaccttttctattctttttttttcaatcctgtgttataaaggaactttaattattattaaatcataattcaagattcatattacctttatttactatataaaatttagataatgtagctgttttgaatacaaatatttgagcaaaatttgtactatgaaaagattaatgaattcaaatgtgtgagtctaaagtccagattcaatcaccaccaaggatcttaataccatgatgcatactctgggcctacaagatattattaggttgtgttcattagatgggtttgggagctaatctcccacgcacgtaaaatgaatcgactcattacattagagtatgattaattaagtattagttatttttttttataaaatggattaatatgcttttttaaaagtaatttttctatagaaaacgtttagaaaaagcaccatttagtagtttggaaagcgtgcgcatagaaaacaaaggagctaagttaggaaaggaggggaaagaacacaaccttagcgaagtagacaccgacagaagcaccaagccgccagaatcgactttccatgacttcttgagcctaatagcacactaggtaacgaggtgaacgacaaaggattgagaggagggtagagggagacttttgcgtcttccacaaggactagaaaatagcttcatctctatcgtcgagccctaccacatcatatccaatgcatcaggagaggcccactgatatggaggtcgataagatactccgcgaggccgatggtgacatgtagatcaattatgaggtgttcgtaactaaattcagaaaaaaaaaacaagcaatttgattaaaatacacattcaaaaacaaaaaaaactaaaacaataaaaaatatataaatagattccacgtagaatataaaatatcaacagaccaaataaaattacgttgacttgaaaaatcgacacgcatcggcctgggagatctgcttaactctagtgcatgtccaggaaatttgccttcgggttctgagcgtgccagatgttttgatcctacaaccaacaagacaggaaacaacaaagagttaaatccatcaacaatagccgatcagcaagattgccgatgacatatcattgagggccacgctgatgcaacagaagtcggaatctgctgttaccttttgagctaagtgggccaaactatcaaattcttgggccgcaaacttctcacttataggtgccaatagaccctgaaaggcgagatcggcaagctgcgaatccatcaaagccaagctaaaacacctgttcctcatgtcccggaacctctgtatgtaatcttggaccgattcgtcgtgtttctgcttgattgacgtcagatcggacaacttcatctcatgaatcccgctgtagaaatacttgtggaattgcttctccagatcggcccaggtgtgcacagagttatgtggcaatgctgaaaaccatgtgaaggccgatcccgatagagatagaggatagcctgactctcaaagcgtcggtagctgatgcctctccgcactgggccaggaatcggcttacatgctcgtaggttgatacattgtcttgtcctaagaacgtcgaaaaatcagggaccttgtatcggtttggtaatggcactctctcaaaatgctccgggtagggatgtcgatacaagtttccactgtctttaggcttgagcccaaattgttccctcatcacatcggctatcatgtttgcccacgacctttgctgaggtgctccttggatctgcttttgtatttgatccagctgattgtattgtggcaggtactgaggttgagacaatcctcctggccgatactgtatttgaggtgagtggggctggtattggaagttgaagttgccccccatatgaggttaagggctctgacggactatgttctattcagggatctattcggggatgagctggctgccgatagttggctgtggctgtgggacaggtgaatgctgccccatggtcagttgtggaactggctcaattatcggctctcttggcccaaacatggctgcaacttgatctggggagacttgagggatattgtgtccagcatgttgcagttgaggtctgaccagaacacgaggattgatggttggctgtctaggtgccgatgccgttggaccctgccccctagggggcactgccctcctccgaccagatctgggaaggaggggggaggggagccaccgccgccgccccgcgctgtcgttgccgccctcgcccccgccggcctcctacctccctcctctggccagatctgcgagggagggagggaggggagccgccgcgccccgccgctatctgtgccaccgcagtcatcgtcctcgccgcgccgccacagtcgttgtccccgccgcgtccccgtagtcctcgtccccgccgtgtccgcctgagtgttgagggagactgagtgttgaggggagactgagtgttgagggagagagagagagttgagaggaaatgagtggtgggaggagaagataatggtagacttaagtttattttttgggtaggtacgtccgcctgcgaaaatcattttcgcatgcgccgtttaagtggtccgtctgcgaaaatagtgaacttcacctcaatttatatttttataggcggttatttagctccaagggttatgtccgcatgcaaaaaaagatccacacgtcgggaaaactgctttttctagtaatgtccgcccagcacatgaatacacaatcgctgcatcatcctggacaagattgtggtggtttcgcggcatgggaccaactgaaactgatcaaagtagtaaaagctaatgtagcccgtttaagttctggccgagtcatcttcgagacaaatcatctctgatcgacatatatatacgcacaagcgaggagagcatatcgatcacaggcgaacatatggctgttctttgattagctgaggaaattatctgaatagtatataatattcttagtgataaactgaaaaaaatatccgtgtgttgcaacaggtaaaaccatttttggattgctgtatattttactctttgattttggaccaaaagttcgatccttcctcactattcagtctcagccgagcccgctacttcgctctatttggcctgcctcttgacccaacccacaagcctgcctcttgcctcttgacctaactcacaagtggagctgtatgtccaactcgcatagttgactaccgtcttcaacctccggaagacaatctagtgtctgtctcgtcaaatccggttgaagaaaaaagtggatgaaaaaacctggaaaaaaggcgacgaaaaaagtaaaaaagaaaagcggacggaaaaagaagcgaaaaaagacggaaaaaaacagcgaaaagattgatggacgacaaacagaaaaaggaagaaaaaaaaaaggaagaaaaaaggacggaaagaaagaaaaaataatagaaagataaaaaaacgaatagaaagaaaggaaaaaacgaacggagaaaagaaaaagaaaaatggaaaaaaaggaaaaacggcgaaaaaacagaggaaatttttttacggaagccttaaaaaacttttcttttctacaaacttttctatttttttaattacaggtatatatagtgcttctaaataatggaatttcaattaaatagagaaaatagaaaagtgcactgtacagagacccacctgtcagtattttttttttatctctcgttctctgctccttcctccttccgttcttctttcttatttcagagagaggagggagaggggagggtgagcaaggcgacggcgctcctgtagccgggaggcggtgatgtcagaggcaaaacgtgtttccactctctgcgtatccgaggaaggtggcagcaaacaatcaaattgagggagaagttggaaacatggtcggcaaaagctcagtcccgaggagagagaggaggcttcggtgtggttcaaggtggcggcagacggagggggaaagtagagaaatgagttcttctcagcgagatagagctggtggtcagagggaataggaagggaagctccggttgaggagatcggctagtgatggtatattggccggcagcctgacggcaacgcgtacgtgtgcacgtgacatcgggaaagccagacaaaaacaacagaatcggactggaactacgtacgaaaagtaggcaaaaacatattaaacttttataatagataaagatatgtcagtgcagcgccttacaaaagtgtatgtacaatatcttgaatcttgaggattgtataacaaattaaaatgtgtataactaattaaaattgatctttacatatatatctctatctcttctctacattctatgttataataaaaattgaagatgtttttgccggtactttggtatgtcattcgtgtatgagtcgatttgtaagttcgttcgcttttgaaaatacatatccgtatttgagtaagttttaaattcgtttgtttttagaaataaaaaaatgaatcatctaataaaactatcttaaaaaaagtcacatgctaacttaagacaatcggactcctaactacagctcatgattttctaaatatgtatatattcaagtgaattccatag

SEQ ID NO: 73587 - DNA, 1165 bp, Oryza sativa
tttggctggcagtgaaaatgggtgatactaaaaaaatggggctttgctgaacgcgtgtttctgttagtatcagtttgacctgtacattttccacagataattattgcacaactgccgtagcagggatgcttcattcacatggtctagatttgttaattttaactgtcagagatcttgttagatgctcagggataaggcgtcatattcaatctcaagtgcctcgtccccagttgagataaccataaatgagcatggacagcaatgctagaagagaacatcatgtttgatgtgtcaagggacaaggataaatatgaacatactctctgaagttttcttatctgggaccgtgattcctgaaggcagaattcaagctttagaattctctttttcagttcctggtcggttctcttttgtttctccaactgttcaacaaacaagagatttcaagtaaatacaacattttagcacaaataacaagtttctttgtaatagtattcagcatttctatggatgaaagaaagagaaccgtatacctgtgactctagttcctttgttttgttcgtccagtgagcagataatatcctaatttcatctctcaatctggcaatctctgcatccttagcgttcagaagtttattgagattatcaatgttccttggtgatacatcagataagatctttagaagctcattatctttgttagacccaactttggcaactgcatccatgatatctgtttcgatcctcaaaacttcatctttgagttgcctctgtgagtattcccttgattcaagatccttctggagatgatccagctgctcacctagcttgttgactcgacgctcgtgttcttttagcgagctgtccttctcattcagctcttttaataatgacaagcattgtgactgagctgatttggctgatgcagcacttgcttctgctgtagcttgggtgactgacagtttcgatctaagatcgtccaactcgtggaagtactgcacataattagaatagttattgaggaagtgcatctgaattgcaaaagggactcattagagcgtcaaaaccagcatcaacattggtaattggtttgcggagacaatataaagtggagtctgaaagatgtaaaatagagagtaaaatttctcatcgccatgaatccaca

SEQ ID NO: 73588 - DNA, 14705 bp, Oryza sativa
attaaaatagtcttcacccgttgcaacgcacgggtattttgttagtatatgaataaattaaaaagagagttgacagggtggtaaaaaaattattgccaataaaagtttatcgagatttattgaaaaaagagatacaatgaacacccaattaaaaatagaaaacaccttactctaatttcagtttattttgttagaactattttctaaacctagttccatctaaactctggatccgaataggactctgaatcaaacggaatacgattccatcttgtgaatacgaccacgggtcgcgttcgtcgcctccgccgtcggcggcggtggcggaggcttccagcggccaaattttgagaaaacctcttggggcatcgaaatttctgaaatacattgactgattctgcaaaaatcgagggagaatgtagcatgccgacgagcctcgatgaactattaaaagctaaatcctactgaagctagcagactacgatgagctattccttgtctggcaacccaagagacgcatgtcagcaacagcaagtcccttcctgtcaaagagaggacacaacaacttcacagtgcttgatcaaaatctcctcgccattttccttcttgtcatcttccccttcaaccacatactgtgtatgttatactctctccgtttcaaaatatttgataccgttgactttttagtatatgtttgaccgttcgtcttatttaaaaaatttgtaaaatatgtaaaattatatgtgtacatgaaagtatatttaacaatgaatcaaatgatataaaaagaataaataattacttaaattttttgaataagacgaatagtcaaacacgtacttaaaaagtcaacggtatcaaacattttgaaacagagggagtgttacctcggttccgttttgtttgacgtttcggacagcttcgacaaattaaaaagaacagaagattacatcgtcattctgaatctctatcggatgaacgatgaaccgggacttgctcccaaagttttccaggaatcattagaggcagatggtgtaatttttcttgcacttggcgtttgctgtcttaaaggacaggtgcttgatcttgacgctgtcttcacacggatccacgcgacttctcatccgaacacccaaaaaaatcgaatagaaggatgcgacaacacaaggttatcgtcgttgtggtctgtcgcatttccaaggccttgcggcgattcacgcaaaggcgccacctcctcaccacgagcttagccggagcgcgccgaggcgagccactcataggcgcggcgtttgacccaggccagccagaagctaaggaaggtggcggaatctggttgggttgtccggtccgagcccaccagtaatgtgggggccattcttgtcatgtggtgcacgtctccgcctccgccacctcatccaggccggcgacggcagcagcaacctcagacgagatgacacggcgtcggcgtggcatagcttggcatggcgtggcgctcgcgtctcctcgccgttccgccgccgcctctgaagagggcgatcgagcagcatgccgtcgcgccgcgcaggtgcagcgagtgcctcatcgccctggctggctgccacggtccgtagccggtcgtgacgcacggcgcacggcgcaccacgtcgttcggcatcgacgtcggaaacgtgtccagctagttcgtcgtcgaggccgagctcgtctgcagcgccagtgccgtgtacggcttcgttgcgtcgccgccggccaccgcgtcgaacgacgacatgacgatcacctccgatcaacctgcggagccaaaacacaacgacacctccacgttcttcttgattgcaagcgaagcgagatagatagagaggcattaactgatcgatggagcatggccatgggcgcggtgacctcgttctggagatccttcatctccgacagcgagagctcgggggcagaattgctctcctgctcctgtgggttcgagccggccttgtcggcgtcgtcgcctgcgtgccgaggctaagcgacaccccgcgttgccgcgtactgcaccacacggcatggcgtggcgttgcgcttgggtgtcctcgccgccatgcccgcgcacgcgttccaccgccgccgccgttgaagagatctcggtgcaggatggccggcgatcgagcagcatcttcgatgacgcgacagccgtggactcgcccggcgccgcggcgcacatgcatgttctgtacatgagaccatcgccatcgggcacgatcagccatcagccacctcggcaaactccccctcgcgtgcatgagtcgatttgtatgttcgttcgttttagaaatacatatccatatttgggttagttttaaattcgttcgtttttaaaaataaaaaaaaatcatctaagaaatctatataaaaaaatcacatgctaacttaagataatcggactcgtaattatagcttatgatattctaaatatataaatatatccaaggaattcccaaagtaaatttcgccttaactaaaccatttaaaataataagattaaaatagccttcacccgttgcaacgcacgggcattttctctagtatatgaataaattaaaaagaggggttgacggggtggtaaaaaaattatctatctgtctattatctatcttctattatatacaaaagtctcctacaaacgctcctaagtcgccatatggcgttctaataaattaaagaaattactagaaattctaagaaaaaaaagaaaaacatctgtccatccggtttcacttaaattggtggacccccgttagatcaacttagaaaaaatctttccacatccacctccctcctcccacacgtaaacctctctcccctttgtacgtaccctgtcacgtaccgtgtcaaaaaagtaccgtgtcaaaaaaaatcttcagatacgtacgtgcagcccacatatatctcctccttactggcctattttttagccagcaattcaacataaacatggtgagttaaatggtcacaatttaatttagactagaaaaaatacccgtgcgttgtaacaggtgaaggctattttaatcttattattattatattgatttaagatgaaattcaccgtgttaaactcgcttggatatacacgtagtattttattagaaaatcatgagctgcaattaggtgtccgatcgtctcaattaggtgttcaacaatatgacttggtgtacggcatcgggttgagttgatatgcttcaagatgattgccacgcatggatagagtcctgataaggcaattgtatctattaattaggatattttatgtaatttctttagatatatgtttgggcaaaagtctatcgtaaagacttatggtatcttagagtttgttagagataagagtcgtgtccgatatggacatagtttgtaattttcggatataaatagaccccaaaccacatgtaatcaatcaacacacgttcaatacaatttcggcgcatcgccacccttttttagttttgtttcgacgagttcttgcttttgggttgagctgcatcggtttcaatcttcaacaagaggtaaaacttgttatggcggcttgcgttctcgggattagtgcttccatatttatgatactctgatctcgttttttgtaattcgtcgagttatcatatatcttacataatctctggcaatatcgctatctaatctacaatcggctaacatctgttggtagagggcagccgattaggttagatatcgatgttgacttagattttataaggtatccaccactctatgaaacttccaacggcttgattgtctagatattgtccttcttttcatacttatagttgcatcagttgagtttgatcttatgagtcatgattagaatctcaatctctagcctgctacttggttgccgattagggtagtatcggagtttcagtcgatcttatctgatttaactatatttactttatatgctttattgacatgttaaatctgcccttcatgttgagatcttgttgcatttaagtatattaggcttttatttggtatattctacttgctttaatatcttaatatagagtggtatcggagtattagccgatacatgctagatctatctgatcgactatgctatcaacatatatagtctcattattaatatatatttcgatccaagtgatttatattgactcggcatggcgatcgatctatctcaatcacttgatttaagtatatatctatataaggagtatatattggtaatatctacagccgatcgagtagatttagttccttcatatttatttatgaccgccgatcaacacatatatgacatcggcgcaaagataaatgatatgtcatcggcacctaactgatcggctatcgtttatggatttaaccacggtttctttgtctttatttcttgctgattgcatgatcaaatcaaccggcacgctagcatactcgaaggcgagttttagacctgcactggagttaagcagatctcccaggcctcgtgtttttcatcaacactttcttggttgacatcggagattgactcagacaaacccgcatgaggctgataaggaaagtctaacgttatctctgaactcaccgagaacggtcacgtgagctcgataacagttactccaaggtccgcggttgagaatgtgaagcattgaagtcgggggctaccgtcaaggtccgcggttgagaatgtgaatttcttcatttgcattgaagtcgggggctactgtcagggttatggataccacatacctaatagtagttgactaaatctcgacaggacccaccacataccatgtcttatacgggaactgacttcggatatggagagagtttcggataaggaaagacaaccagagttctacatggaaacgacaaggactactcggattatatccatattagtctccctagttctacttggacaaggggacacctatgagtataaatacaaggccccctaggaggagaggggacacgaaacaacatacaaaccaacatacgccaaggcaagacgccggatatcgacttcagagataggcatggctagtcccctacggtgactatggctaccgtcaggagagatatagcgctgtctctgatctcgccggatgcggattcgaggaggaaggctaccctgttgtcgactacgagtcagtactacagaccgccaagtcgacaacagttagataggctaccccaaatattgtattggtatgattatggtgaataagagcaataccggcttcggccaacaggatgtagggttattacctaataattcaggggcccgaacctatataaaaattctcgtccccatctcttttacctcaatctcgcatatatcctggtaccaacgatccccatactacgcaaataccggaatcgcgacatcaaacgtcgacaaaaatccaacgtttaaagctcatacatgtgggacacataaatagttaaattggtagtgattatgtgcaaggcggattcggacactacgacttaccaagccaccggcaaaaatatcttcaattatttataatagtagagatagggagtaactgataacttaagatcaataaaatccaaaatattctgaaaaaataaaagctaaacattgaaccattgatttacaggtgaagtattattttcaatcattagattagatcgtactaaagtaattaatttctctctcctaatctcatgcgtatttgctagagagaaaaataaatatatactattctcccagagaaaatatacgtatgtatatatgcatgtacaggagactattatttgcaaaacaaaaaaacaacatgcatatgtacgtacataaaaaaatatattaaccatgtcctcctaacccttaaattagaaagtttatacatgatcagtctaccctatgctgtggctcctttcgatctctccagtttatttcctagggtcgttgttgactaggctatttcttatatctgtgatagttaatttataattaggagccgacgtatccgagatcgttgatatgcttagctagtccaaaataaaaatattggttaaatggtagtctaaaataaaacattcataataaaatatggcccaaagtaaaatttgtgacatacatatagcaattctgattaaaaagttatcacatggaacaatattctagccaatttttatatctttcttatacaaataatctcaacaattactccataatttttaataactgatagtggatattatattcatttacaacccattttttctatagaaaatttataactatgttaactatcttttgaataaaaaatattacacggaaccacattctatcacttttcatattattatacatagcattaacaattagcacaaataaacttgatagtatatattgttccatcatatattaccccatgaacatgcatagatgaattagatcaataatacaaagaaacaaaaatatcaaaattcatattacctcatatgttcgtgaacgattactactcgagcaaatatttttccacgtgtttctcaccactgaagctattagattatttgaagtagtatcgaatgttcaactctgcatattttcagaagagaaaattatatctgtaccactaaaatttagtagaccaattaacaccataaacaagtgtcaactctattccataaatggactcaaaacttttaaatttttatttatcactttcatcttatctatgtgtcattccctgaagggcgccaagcatggataacatagtttgctatgctactatacttatggcgggggcatgcatatgactaagttgaggtgaccctaatgagaggctactattcgcaataaaattcaactggcttacttagcgatgtgattctttagctgatagtgaattagatgttaaaattgtgctccacgaggagaacggctatgccgatacgggacacatgtttcaaggcataagggaagaaagccttggtggctacagtcagcttcggggcatttagatctaatttaatggttttatcccatgaattggtaggaataatatttcaaaatatttatgcatatatttaaacacaagtgagacatgaacaatttgatatgaagtagagatgatcttttcgttgtattaatgacataataagtttattttcttggtatggatgtaattccatttaataaaaaggtacctaacttataagacaatgatagtaaatagtagtaacatgcgagtttacatatatccgggacaaagttatttctgtttgaatatgaaagatactattgtcatttggtatatcaaaatttatggtcgacatttatttttatataattatatataaggtgatctatggtccttataattaattaatatggtgagataggatttcttcagcattatttttataaataataaataattggttcttataattaatatcgtgaagtatgacttcttttagcaatcttttataaataaattgcccgcgcatttgcgcgggcttccttcctaatatacaaaaagtcaattaaacttcctacaaacgctctcacgccaccacatggcgctttaataaattagagaaaatcctagaaattctaagaaaaaagcaaaacatctacccttaattttcacttaaattgatgggtccaatattatacaccgttagataaaattaatcctaaaacaaaccaaatactatggggtcccacctctcctccttctcccacacatatactttcctccttctcccgcacatatgtaggcaaacgtgtatggtacgtatgcttccttcccttttttttccttttttcttcttttttaatatataatggatatatttcttttaaataatcataatttcacaaacaaagagtctaccatcatagaactcgcagctaactaaattagctctacaatttttgaaaataaaatttacacattatatgttacccatttaactaataatgtaaaataatttccacttaaatcggtgtttgtactattattttcaaattatgcactattttaaaataaagtttacacaaagtaatttaaattaattattttaaatttaagatctatattaactaatttatatatttacttaaactgatagatccattatttaaatcatcggatctattttttatcacagtggattattattctcaaataatgcactgtttcaaaataatatctataccattatattgtgtacccattaaattaacaatttaaaatctatattaactaattaacacttacactaggaccggtggacccattatttaaattattagatctattgtttgctaataaataaaacgtccaaagttttctttttggcctgctgcacaatgcccgtctgcaccttttcctttcgcacgtatgacaaagtgtcgtgtctgaggcttctaaggtgatcacgatcgctgcagcgctacagctttgccacatatcaaatcatatatgattaattttgctaataacataaaaagaaaattaaaggtgtgatgcagcgagacaagaattaggcaccatggattcggttttttttcaacacttagctctgtttaagttgaaactgagagttgattatagagtaattataatgtattttgttatttcgtatttggattttgaacaatttgttcgtacaagtgaaataaatcattatgttataaatgtgagcacaatattaactaatatcaatataactcttactaagacaagggtgttataatggagtttaatgccctcttttttttcccgattccatagtttggattttcgtttgcacgctttccaagtttctaaatggtgtcctttttaaacaacattttaactttttagaagtcaattcatttgtttatacctcaaatagctatcgcataaatctgataattcatcaatttcacctgtcctaaaccctaagtagtatatattttttttcatgtgagtcatggtgatcattaaattggggatcaacggataatcaaagtcataagatgaatatgtaagagctactatgaacaactgtaaatatgcgtcaaacttatttgctattaattatacatctaatagcttgctagccacataattaatttctctctacatgtatataaccatggacgaagctggaacaaatattaccttatgccccatacatacatattacgcggttaatattctaattacatgtgttaagtcctttaaaatttcttaaaatgctctcaatctgccacatggtgctctaataaattagggcaaatattagaagttctaagaaaaaaaaagcaaagtatctacatattataatctgtacgtccaatattataatctgttagattaaattgatcttagaacaaattaaatactatgaggtcccacctctcctcctgcggcacaggtacgcacctacgtacgtgggtacatacgcttcccctccttttttttcatttttccctttcttcttttttctccatgcatatgcttccctccctttcttactatatcatgcgtcttcatgagacgatttactcacaagaattttgagtatcttactctcgcattttttatttatggccatactacaaggtatgatatagatggaccgtataataattaactagcaatagtttctcctttcttatttactcaagagagaaaaacacatgattcaaaagtcataagtacttaatctatcccctattcaaaagtttgtgaatggttttttaagatatcttaagaaaaatagaaaccttaaattattataaaataatattatccgaaatttagtttgtccttaatttatgagacaaaatttatgaacaaacaataatcttacctttcaataatataaatgcccgcgcatgtgcacgggccaccttcccaattgccaataaaagtgtatcgagatctattattatatactaaaagtccattaaacttcctagaaacgctcctaagtcgccatgtggcactcctacaaacgctcctaaaccgccacatggcgttatctaatcccaccgtcgattttcacttaaattggtggacctattattttacaccattggattagatctattatttaaaaaattataattttctcctctttatacgatacaagcgctactactatcatgtacgatgcgatccatacagacgctactaagttcttctcccctacgtacttacgtacaccaatgaaaacaaaagaatagcttacctgttgtttgcccgaaagaaaaggaaaaactatacgcacgtacatatataaaaaggacagcagaaaaatacatcagtaaaaattgatgaattttaaaatatgattttctaaaatatattgcttcacaaaaataaatatatatagttaaactaagctatataataataatataaaatatccaatcattgttctgtataccttcttctaaattatttttttaaattagatatccaattagttattccattgtatttcgtttagttaaattacaaaagttatattgtagtcctaaatacatcacaacacatagggctaacatataatggttagttgtttgatttttttttaaagttcacaacatattttagggtgtgaaatatcacttcataaatatagaacactaatttaaatctatatataaaaaaataaaaacaacacaatttagttgtgttttttcaaatagatctaattaaattataattggtttgagattaagattctcagagtttttttttgacatttttagaattatttgattggtatttgagtagtgaccagcatacatagtgcatatatagatatgaaaaaaaataaaaaatatctccagccaatgatctttgctataattcaatccttcatccatcatgagatttatggtcattcttctttgccaaatagttttgacacaaatgaacaatgaaacaatatacgcaataaactactcatgatatactttcttatacttaaggaacttcaatatgtcagacacaattgatggatatatgtcataatcttcacagacgtgactataagtgtactacagtggattatttattgtaaataagttttaaaaaaataaatacattctttaaattagtaaaaatgcctcatgtgatcatgaacaataggtgttgaaaacaaacttggcgctaaactatagatatttgtcaaaatattaaaaaaattatatggtgctctggatattatcatggtagtatgtatgtttagctatattttttaaaaataatgtcgaatgattaacctcactcattttcataagagagtattctatctatatcataaaaatttaagtagtaatgatcaacaccataaacaaactatgtctaaaaagactattttgatcacttccatcttctctttatccgtccctaaagggcaccaaacatggaacatatgcctaagttaagttgacctcagtggaggccgtcatcactaatagttgtcatcatatgaattaacatgtaggatctgttctattctattcggaccatatggggattattcagactaaatagggataacataaagtagcactcctatttaccaccatatataagttttatgatttggagactatattaagtaataattaagtaaaagaatagtggaagtacgcttattgtccttcctctttgatttctattaaatatcatgatatgtgagtatttcatactaagtttggttaattaaggaacacaaatcatactaaacttatatattagaattaatgcaataaaaatgtactttataatagtaattgacctaataaaagtgtactttagtctatagcatttatacatttataaattatttgtacgtactaattatatttatataattgcgctcttgtatcaatttaaattcagttttcaagaaagcatatgaaaatgaaggagggagtagaagtaaatagaagtctttctataattagaagaaataatcctatagaaaatatcttccattaatatatcctaaaatccataaagacatctataatatagaagaaaaaataatccttaaatgaatttttatcattatctattatatactaaaagtccattaaacttcctacaaacactcttaagctggcacattatgctctaataaattagagaaattgaagaaatataagaaaaaacaaaacatctaaccctcgattttcgcttatatggtggacttttacaccattagatctatctttttaagaaaatcccaaaacccatccaaatatcatctcatgggcacccttcctcctgggcaccctcttctcatggtatatacatcgtccctccctctttccttccttccttccttatttctctaatataactatttaaatttaattgatggatccattaatgataaacattacatcttcatctaacaagaaaatctggtaaccccaccctcaccgccatacgcgcacacgtacgtaggtacgtactcactccaccctcctgactctccccccccccctcttctatttctttagctatttctagctaacactcaatctatcaaaaaatcaataatcggatttctaagtttatattcaagttacttttttttcttaattatttttgaattattgtgttatttataattaaatacatgatactagatccatatacatatatatagctcaaacttctaatataaatgtttaagagaaaatttttaagagccatcttaaacaaatattaaatatagatatataaacaccataagtcactaagtgacaatcgtacaaatgcttctaaaccgccacgtggcactctaataaattgtaaaaaatcacagaaattataagaaaaaagaaaaacatctaactattgactttttctttaaatttgtagggccaatcattagatctaatcttaatcttatcctacttaaaaacttcaagatgatttggtgctatgtcgcttgatgacgtcatccatgagtcagctgcacgtacttcatgtatatgttccgttcgctagagagagagagagagattttgactcggctcactaaagaaaagcgaggcgttgtacatcagataaaaacttccggcctaatttcattgtagacaaaattaagatttgaaacatcaaggaataagcataaacaaagtttcacatgacctaaacgaacagaacaaggaaatttgatcgtatcatgcatagaggaactatggcttaacatagtacgagatataatcgagagagttaggtcacaactaacctaattagataaaaccctgtataaggaaacgttactgcagaagtatattgtatgataatgatagaaacatagtacaaaataaatttatttcgttgctaaacagcataatcttctatgttactatgtactttgtatagtttgcatctttagttaatcatccaaaaaaactataaacacaattaagatgatgtgctttgaaaatttagatcaaatatagattcaacatcaaaagcaaaaactaaggtgatatggctttgtaagagaagaaacaaaagagatatacctttcgaccagattaatcatcgaggtgctagaaattgagagactagaaaaataacattaactatacatagtgagggttaaggagcgatcaatcgctgccagcgatcgtttttttcttttttttttcttttcctcttttagtaagtttatacatataaagtttacacatctaaagtttatccacctaaagtttgtaaagcgaatgtttacaagtcaaaagtatatatacccgattcaaattcaaattcgaattcaaaaattatatatttttcctcttttagtaagtttatacacgtaaagtttgtagagcgaatgcttatatgtgaaaagtttatatacccgattcaaattcaaattcggattcaaatatttttatatatataatatttctataaataaagtttatgcgtgcaaagtttatggtataaagtctatgcacatgaatgagagtattagattttttttctaatttttttactaactttgtgtttttttttttgaattttgtgatgaaaggaaagaagggagaggagtataggggggaggggcgggttgatcgctcccagcgatcacccgcacggtagcctcacccatgattgtagtacacataataaattaccacgaacataaaaatgcctaattatgtaacacaaagaagcaaaaagatggtaggcactaattcatgcccactgcaagctagctgaaaaaaattgaaaaaatgatcagtttggagagtaaataaactataacagctaactgtaattttatagaaaatatttaatctatgatatcaatgaaaaatccacattgtaaaaacaataacacgtgagaggttatgtttagattttatgtcccaacaatattctttttatttactttatttatatttgctttggcacatacaaaaagacaaaagacaatgataaatatgtgatatcttaaattccaatccttcgcagtagcgtcatggttttttactcttgcaggtatataagctgctaatagcattgcataattgatggactttcatgtttaaaagttatatttttcctaataaatttacatttgatgactcatgttgattgtctttttagaaaaatatcatatgggtgcaacatatcatagacagatgttgtctaagatatgtatatttt

SEQ ID NO: 73589 - DNA, 6456 bp, Oryza sativa
acgcagttgctcatctttatcattcaagcatttctgcagcttactgatttcttcctccatgctcctcgcctttgtctcagcaaactgtgataagttttcccttgtcaaaaacaaaactcaacaacaatccggcagggaccaactacaaaaacaagaaacaaacctttctggtttgggattcccgaacaaacaactgctcctgtgaagcaagtttgttcctcacatccttgagctcagccgccaaagacaccacgtttctcctaaagcttaacttcttctctgtaagatccttcaacagcggatccaaatccgacgaagacacagaagatggtggtaccaccttctctgaaactgacatagccaagccccaaaatactgtttctcttccaatattagcaccaaaaacactgcttctggaatactgttatattctatccaagaacaacaaacaggacggctcaggcctcacagcaagtcatcaagcacccccatgaagaaagacaaaaacaagggagatgagctcttctttgaccaagccaaacacctctgtggttgcctcacaagaagcctcctatctcaggtcagtatgggccagcaggtagctttcgctgcagaaaacaataccaattttgagaggagatgaaaacatacaatgatgcttgctacatgcaacgtgttccgcttaaactactgatatgaaaacatccgctttcttcggatcaagggtacgagattgagtggagcctagacatttggcaactaagtgacagaagtgtagctttcagtactcatcataatattattgtattggcaatgaggaaaaaacaagcaaagtatacaaaatattattcacactacaagtgactgcctcatgccgatcaaatcacgcatctaattagtcaactgcacgcaccaggcagcaaattttgcatgttcttggtgcttgaagtcaacttgtttaacagtagagattaagtatggtgcaacaattaaaaataaaatgtgcggtagaacaatatagctatttttttggtgtctgttcttgtgttggaataaaaaagaacttttctggaatgccaaaaacttctcttgcgggacgctacgactaaaaatttactgaaaagaaggattgagacaaaaccagatgaaaaggaatctttcactgagctcacaaagagatgaggacaaaaaggaggctgtccagtgtccatccgaaaattttcaaacaaattcaaatttttggggaagaaaccgagagaagaaaaaaaatgcagcacaaaagtcgagaatttcccagtatgaaatctggagcgtaagtcctcataaatctcttacccttcttacttgaggattaattaattagagtgtgtgaacactctaattttcgttaagaatagtttggaaggcaaaaaaaaaattgaaaatttcgtacaagtacgaacaaatttaaaatacttcaaacagtggggaacagcataactcaaaaacactccagattccttagatttgagtgtaaaaaaaagcagagaaacagcagagagagcactgtaaaatcaccacccagaaactccgagctcttgatcttctcccataaattagccaaaaaaaatagcatgaatcgaatcatagtaagcatatttggaaccaaagataaactcaagtgccaaagaatcccctacctccatccgacgatgcaactcagctccaagaaacgagcacgcagatcacgagcgaaccaaaaataaaaataaataaaatcctcgtttccccctccacctcagatatcttactgactcactccactctctccttctcgcaagcagcagcaaactagcaccaactagggcttacgcgtcttcttcgggaagcgacagcagcggcgccggaatccgctcggggcggggaagggaaggccaggcagaagcaggcggcgacttaacttggcaccgcgcacggaaggagccacggcggcggggcgcggctgacgcggcggcggcggaggcggaggaggagattgggagtgaagacgacgacgagaatggaaggaaaggaggaggagatggttggggtggtgggatttcaaaaccgggggctgacaggtggggcccacgcggccagcgcgcggcaattccaaaaattttcgtcggggtgtgcgccacgtcggcgtacgcgtacgtacgcgtgtatttaatttgtattgtaccgtcagccgtagaggtcatgtgataggtacaggtaatcatcgtcacgagcctcgcctgtgttttctgtaccagctagctggatttttaattgtctgcatttcacacggtaataaagtttcagataaatcattgtaacaactttgtactcatgtcaagattagtaatattaggatgcatcatatgttattttaggttattatactttaaaatgaatatggcaactttctcgaacatcgaagatatcaacattaatacttccctgcttttaccaaatcatttgttatataataccactacattttccattagtaaaatccgataaaccggccccaaaatcacatcggaaaccgaacacggaagaaacatcatataagatccaaacataaaattgacaccgatacatgatatttgataacggagtttagccgaggtctacatctacgaggcactgattgcaggcgctcctacccgatccagcatattacaacgtatcagagttataacgaccatcggcgaacgccgccggtagccactacgttacgctatgctaagtcgctatacggttataacacgtatgtctttctatctaagagagattttaagatagaccctgacttttactctattcctatacctaatataactctaagttctaaactgtaactgactttgtatccatattcgacgtaatatatatcaaattgagtgatggagtcacaagtagctgattccgttgaccaagttttgatcctgatgtccgctaataacgttacacaaatggagattttcttagtaggaatataattgggttggggattttttttattggggatgtgtccccgtccctcagcgtacattaagaaggaatattcatagggttttttttttatgtttaattgacacatgcggcaagtgcatctcttatataattgaaaaaaatcgtgtggtggtatctcatatagtgtagagttggactaatgcgaggatgaaaatgtaatcagaatgccgcctgcatcggtatgtgcaattgtggactatgaaccagatagtaggaattgttttttatttgctcacagtcacaactcacaagctcctggagcgtgcgcggatggcctgcgagctcctcccccatacgccgtcactgccgccgccgccccgcctccagtgatggaaagtgagaggagagaaaagatgaaaaagagagagagagggggagaggtgaggatgaccatgtggggctcacatgtcggtgggtcccacttttgtgtgtgtgtgaatgacatgtcgatcccacaatttttttttactctaatgccacataagcaacacgtgggacgaagactgggtcaacaccgccatgtagacgccacgtcagacaaaacctcttctaaaaccatccagggatatagtttgcatcggttttgatagttggagaagttgatatacacgatttagtggttagaggtcatgaatcatactcaggttatagttgagagagcgaaagtataccttttcccacgctttaatcatgcgatttgggctgcctgatccatgatgagttttgatcggcctatgctggataaataccaatggcccatgaagagcagggagggacagaggagaatagtggaagcaggctttgcaactataacagcaggctccctttatttccaaggaattttttctttagatgacctgcacagttacaacaactagtgcgtatcttctataaatactgttggaattcaaatctgagcctaaaattaaacataaccgaattgttggtggctcaaagctaagcaaccagttgcgtgtcttcagataaggagtacaaaagagcttttcagaatgaacatcggtctgaagagaagtatcctaattagaacagaaaactggttcagactaaaatgccaaacagtaaaaaaacctcattagacatccttggtgaaataaattgttgcagagtagcaaaccatgcttgttttaacggcgacaaagtcaggtttggagagtaccagggtagctctgggagcccccccccccccccccccccccaaaaaaaaaaaacaaaaactaaaaactaaacaagaactacaattcctgtaactctccacaaacatggtcttctctaaaatggacatggcatgcagctgaacaaaaacataagaattctgctagccatcgctagcaattaaattgatgaggtgcaggctctgcactggtttaggttaacaattgatcaacagggaagaaaaggatcaggcagtgagtgaacacagatagcagctgaagtgttaaaaaggaaaattaggagcctcggttcgttcaatgattaccagcgatagggaagctattgctgcagatgaatacaggtaaatacaattgcataccactcacctgagcaaaattcttgaaaaaaaattacaaacgatgaaggggaaaaaaaaaggagatatctgtcagacaacctctgggccaccctgcaccggagtgaaccaggcaggaacgatcctctgcagccgtcggatggctcaaacatgcatcctagccgttaaaatcacgctctggcccggaggttatgtcggcatcaaccagacttgagagcttgcctccttattggtaaaggatgcaacggtacgagcctgtagaacagatcctgttcaagtaaggtcgtgccgcaagattccaggctgcagcttataagcagctcccgcttcttcaaaactggcgaggtggtactaaccggcagcgtcttgctttgccttccgtcaattgcgtaatgggtccggcccatctaaactctctccaagctaccgtctgcactctattatcctgagaacaagtataatagtgagctataagcttactataagcttataagcttatgtggaggagagaggtaaacaaaagagaatggtgctggctctcgtgcaagagctagcttaacacaagcttcaagacaaatacattaaatatataagtgagagatagagatagaagaaaaaaattatagctaacattatagctaatctattatatgtgttgactttagtataggctaatagtaggaagtgggctatattattatccttgctttgagacagattagcacaagcaatggatagattaatttataacagttgagctggaaaaataatcatatgacaactgacaaaattgctgcagtgtatcaaactgtcacaactaataagtcataggcgaacggtttcgtgaaccctgctaataagttgctccaattgcatatttgcattcagtaactaaacaaatacaatcattaccaactgtaatcttggtcattttatatccagctgaccaccttggaccaaatgtgtttagccactgtattattttaggaaacaaagcgctgatttatttgtttctggcttagtaaaaagaaacacaggaaacaaacttatcaatgcctccgctaaacaagttatctgaattccatctctcaagcaagaatatcagcttagctatagacaacgggagattattccctcggtggattggatttgcaacctggtaagtgctcgattgatcatgttctgtgtgcttctttgatcgagttatgcatccagtgatcgggatagtggcaagtgatggggcaaacagagaaaactgggggtcggagttcagttatccgactccctttgcttcagagaatttgagcagaatatgcctaaacagatatctggaaaatttgatggcagcattcttcttgttactcctcagaggaaactcaatcaaaaaagaatgcaatgtctcttctctgaagaggatgatgaagaagaaacaagcaaacaccagttgccagctgaagtcttctttgattcgcagatatatcatgtatttcaccttcgattcttctgacagaaaaataatgcacgtccgtcttctctgaagaatcgagccagctgcacccattcttcagataataaaggcatttcttcagaacaacagcaatggtaattaagtaatgacatagatcttgtctgaaaaaataatataaatagcatcgtagcatggtcaggatttatttagacagagagagtatttttttacatttcatatatatatatatatatatatatatatatatatatatatatatatatatatatatatatgagtatatatatatatatatgagtatatacctagttataagtattcgattcattacctacacctctcaacaaaacaactcaaaatttaactttatttcaca

SEQ ID NO: 73590 - DNA, 1760 bp, Oryza sativa
acctcaccatagctcaccctcgttctgtggaggctcaccaaaaaaaggtgacttgcctgaatgtgcacattacacatgtgtcacatgagcatgaatgtgcacattacacatgtgtcacatgagcatgaatgtgcacattacccatatgtatgccttgtatatatatctcacaatgtgagagctgattttggagtatttcaacatagttctcttttttaattagcttttaagttgctactaagaaaaactattgcttcaataggcagcttgaagtatcatgcattagtttggtgctatatacctaaggttagccacaatgtggccataaggggctataacctaatacattgtggagattttaagataggctcaggttagaggcaatttatagaccagtcatacaaaacttctctctcctacactctggcttctctctatgttgggaggttgaaaagggtaaacattttattttgttatgggacctaccttaacaccaactttagcgttatacattgtagagatcacaacatatttagtgtggaccaccttgtggtcatgttaggccatatacgttgagaattctctaagaaataataaatctcaaaatgttactttgtgcaaagaacggaacaacacacatgcatcgataagagcatcatgagcttagccgtccaaattcaacaacttgactcaggataataaggggacctacgagttcaataggctaacgaagtggtcatgctaggctcgatcaagatacatcaagagtcatgacacaaactaaatgtgtagtatttgttagaattttaggtaatttcttagctaaatatatgagtgttaagaaaaaaaaaatagaaaaacgtctcaattgtaagctcactatctaacaattttcaccatgtcaagtggcttggcatatctgctcatgtattaataacaagattcttatcccaccatcgctaaagccgttatgacggttgagcatgttttgtcattcacatcatatttatagaatgtaagcttcgatctctcgtatgccgagaacttttccacgaagagatcaatgttgcgtaacgacaaattagttgttgacttatcacaccctaccccatctcactacaagataagagcgcagagtgcatgtatcgtcggcttatatggatttattacactttcaataaatataatttatttcaattcataacatccatgacgtcatggtcaaaaatttaaaccaatagagacatctcgcgccatttactattgtatgtgaaatttatattctatacccacgatggtatccccataggcccatactccatacaatactgtatattttcacacactctttgttttagttgattttgtactcctaaaatttacagtcattctttacatcataataaactcttaatttagaagcagctattatctctaaaacagaaaagtgataaattcgatatatatatttattattttcagtttttgttgtcccatttttccttagaggagaaaataggggaaaaagaaaagaaaatccatcctcattgagattgagagccgtttggtggcctcctcggaaaccctaattcttctcctcttctcccctctcgatgccgccaccgccgccgatgatgcccaccggcggctaccccggccaccgcggctgcggcggcgaccgctgcggctccgggcgcgacgcctggcccctccacaacgtccggcaccagggcgtcttctgccgcctctgctcctcctgc

SEQ ID NO: 73591 - DNA, 88348 bp, Oryza sativa
atatcggaaaggaaaaagtacaccgaaggtccctcaacttgtcatcaggataaaaaaagtactcgaaccgtaaaaccagatatgtggggtcccttaaataacaaaaccggacacccaagatccttcggtggttttgaccccggttttggtctacgtggtggctaagtcagtgtgggacccacgtgggccccacatgtcaacatgccacgtcatcactccctctctctctttcccctcctctccctttctcccatctctctatctctttctctctctcttttcttctgcaagctggccagtgaatggggaggaggtcgccggggcgacgaggtggcggcggtggctgcgacgcgggagcaggccaccacgccgggttagattcttgcaccggccaaactctcccgggatggtgctggtgaaccggttcccgaacagctgaagaaacttcgccggtgaaccggtgaggttgttgacgtccaaaccgagagcccacatagccgagcagttgtagaggcggctcgggatgccgccaccgcaactaccatcccactgtgcaagccgagccatcgccctttccaccgcttccggccgctccccgccggcgacacaggcctcgctcggctgtgctgccgccaccctcagcaccgccacgctccaccgctcctcggcgtccactcctcttcgccgaatacccaccggagtcccaaccacctcgcgttccggtgagttccgccccgagttccatcgccggcgttgttttcccaccgcttcggtcgcccgttttcctccctaacccatccaatctcttcctcaggtctcgccgatcctcggcctcccctcctcctgtgccggacgccgccaaatcgtcgtcgtcgtcctcgcccgagggacgccgccgcctcctcgcctccctccgtcggccacctctccccgccgtcagccgcttggtgagcatccctcctttcctccccgctcccttccatcgcttgtcggccgccgcttccggtgaggacctctcctccctccccttttttcccgtcctcctttcttgccggccaccacctcttggggtgcgccgccgtcccccgtgcgcgccgctgtcctccgcccgcccgccgccgttccgcatcgccggctgccgccgccgccgcaccttggctcggccgggccggctttgtgccgcgccagtggccctggccgctgctctcccctcgggtcgacctgggtcgtccacgtggtggacatgtgcccgaggccgtggtggaccgtgtccaccgtgcgcccttccccttgtgccgctgacatgtgggacccgcctgtcggcgccggttccccttgctgacgtccgcgaatgccttttcctttgagaaaataattattaattgcgtcataaatcggtaataattctagaaattcattaaaacggctcaaaacttctaaaatttatgtctaattcatacgaactccgaattgagccattcaagttgcaaaattcatctaaaattgggatctacatgtttttttactttttatgtactatttccttggtttttattagtgtttttcctcgttttgcacgccaacgagtagattccgccatttcggaagtctgcggtcgcaaagataagagttcagaagatccaagtaaagaagcaagggaagtcacacatttccccttgagcatgttgatcccaatttacaaatgttttaccgtttgcaaataaatatgcatgttttgctaattacatgggatcagggtttacctatctgctcgcttgtgccatgtttacttgatatctgtcatttgtcaatcgtgggtaataaatcgactagctcatgttacttatgtgacacatctagaactatatgcttagccatgcttaattgccactagctcagttgatgggataattacagttttagacctgttagtatcatgacgagccgcgtgctcgagacacccgaccatgttgcattggtcgtaattatctatctaaaatgcaactgaatggtgggctgtgggtgcatggttttgcgagtcgcacccatggcaattaagaccagtttacgggaaaccctggaagacttacagtgcttgccacaagcgggaatgggtaactgcctgatctgaagtatagctcgaccctttcctaggcaccggtggcgagggtgggcgtgatggagttgggtcggccggggtgtccaattgtccagctgccggattcaccgcggtgcacgaggggactgcctgctgccttgtgaggagtgggggtgaaaccttagcgtggtgtggatggttaggggagagttatatgaagggtcttgtcacaatcactcgacgtggtgacgtgttcatcatgggcacatgatgacacggtgacatgtcggtggattgtgtcttgtgcgtacagttatgcacctctggctagagtaaaactattcgaatagccgtgcccgcggttatgggcgatcgagcagattcaccgtgattagtctcacccctgataaatcgacccaatgcactgtagttcaggtgggttggttgggcctgttcaacgtggtgtagcattgatcaatggagatttaatattaccttaattactcaactgtcttactgttttgcgcaataaatgttttacaaccgcctttatgcaaatagccacaagccattcttgaattcccttgcatgtctgcattgttggtgtggcttgctgagtacagtggttgtactcagccttgctattatttcccccttttcagaagtgtagtgattctgagctgaagacgaagttagaggactaaggctcagaccccagttgagttttgcgtgtggagtggagctgaagcctcgttaggatcgcctttttccgctgcttctactttcgtttcagtgtgaggactaagtgcctcttctgtaagtattttacgctttatttatgtttgaaactgtatattacttgtcgctttatttacgtttggaactgtatattacttgtcgttttgtgtaccctggctggtactggacagggatttaatacacaaaatagtctggaaatttgggttaaatttctgggcgtgacactggtgttggcccatgtcagtccgacccgaccgtcgggccgtgtctgggcctcggcctcggcacagtgggccgacccagcatggcatagtccaagaaaaaaaagtctattttgcctccctcggcttttcctcttagttgagtctcatccccttgttgacaacataaatgttattcaatacacaataaatcaattacggtctttctatttgagtaaaaatataataaaacttataaaatccataactaactcatatgtactctgtttaactccattcaaaatgcagaaaattcataaaaataccccaaatccattcaaaatcctagtaggcttttcgctgacacactatatacttcatcttgagcaaattttgtaaatttttattatatatatagtttcatcctattgtgcatatgaaagaggattagctcttagattttttatgaactggacccatgttaagaaccttattcatattagctaatcttcagtgtgaaatcgttatcatctagtgagtaatgtctattcgctattgctagctcatgcacgcgatgaagtttccaaatacagacaatattaaaggctgacagatatgctagctatttgcacattagccaccgtttttatcaggcaaacattaacttgcatttattcgtttgatattctcgaatgtgtaaaataatttctttccataatctagtgattgttgcgatatgatcttccattataaaaccaccatattcccctttctttgaactcatatcaatctaaccatttcccatcaatccataggtgcagtcttgctagaaagtggtgaatcgtgaaggccatggctcgcaacaaggtgaagttgcagcggatcatcaatgatgcgaagtggcgggcggcattcaagaagcggctcaagggctagaagaagaaggcaagcgagttgtcgacactatgtagtgtggatacatgcctcatggtgtatggtgagggcgaggtgcaagcaacagaggtttggctgtcggtgcaggaggcgacgagggttcttgagcgcttcaaggccatgccacagctagacagatacaagaagacgatggatctggatggcttcatcaaggagcgcaccgacaagctccaagaaaagttgcacaaggtaagacgtgatgccgatgaaagcgagaccaagatactcatcgttgaagccttctatagccgctgcgcaggcctcgaggatcttaccattgagcagcttaccagccttggctggatggcagatgcacaactcaagatcgtcaacaactcagtctatccgtaaccgtgccactgaaattttacaaaattagaaccatgccactgtcgtcacgttttccgtcaatttccttccttttccaccttcttccttctttctcctgtcttcttccttctttctgccatagcgaggttgagcgcgtttgcgattagcacggtgtccacacggcttcccgcgtcagtgcagccagcgtcggccgtagcgacatcactattcccgccatcgtggcggtggcgtgcccgcccgcgcagagccccatcttcggggccgagagccccatctcgtggcatctttcccttctctctctcttccccgtcgcatggttagcgggaggcgcggcgaagcgcgtggtgccggtgtccaagtgaggcggcatctcggacctcatttcccccctctctctgtccccaccccttgggtctgatcactctgcgtcgaggagctgtcgggtccaaagctagtgccagggtcggccgctgaagccttggggggggggggggttcctcatcgtcgcaggctagctccggccgctgtctcacctccttctcctccatctagcgggctccagcaccagcgccttgcctcctccactgccgccggtgctagcaagccggctctcccgctcccgccgccgatccgtgcgtccccaccttgccgtcgcgatctttttaactaggaaacctccacatcatttagcgatatttagatcatacatgttgcctgcggaaaacgtgagacattaattaggagatcatatgctctatcgtgtgttacctttatccgttataacgcacggacatttttgctatattcattatattaaaagttaaagcaatttatcaagtactacctctgttctataaaagttgaatttatagggaatcaaggatagaaaaacaatcataataaccttattatttaatgaatacagtgcacgcacacattctatatataaacttaattaacatgaaggttgagacttagagaagggatggaaggaagggagattaaaaggaaatatttttttatgtaatcaatttgctgggtcccacattagtagaaatacaattttagatagaaattcaaattttatgaaacggaggtagtaaattaatgtgggaaataaactttccttttaaaatcatggctgagaatattttcctaatattcttcattccctaatatactctataattttccttaaactttcatagtaaaaaacaaaggaataagttcaccggaggtccctcaacttaacagcgagaatttttgaggtcccttaaccacaaaaccagaaatgtttacctctaaactcacacaaaccgtgcactcaagatcctatagcagtatatatggctggtttcgctgacgtggcatcctagtcagaaaaaaaattaaaaaatgtacgtgaggcccacatgtcagttgcacatctcttctcttctagttttattctcctcctcttctctattctcttcttcaggccggcagcaggcggagagccggcgggcaagcgcagatgaaggcgacgggcggagagccgtcgggctgctgtcgccggagctgcatagccggctcctctccgaccaccgcgcgcccttgctctccctcctccgccgccaggatgacgagctccggaccaagatcaagaaccacctcctcgcgctcggatggaccatcgcctccaaagcccagcctccctggcctcgcgcccaggctccgctacgtctccctcgccggaagcatgcatgctatttgtatgtatgtatgtatgtatgtaagctcgctaatggccaggtgattagcgagcttaggaaatgggctcagcaaacaccacctcatcctggaaggcaaccatccatcatcataagaagtcaatactgccctggtccatctcctcgtggaaggcaacctcgcccgcccgcagcacccctgtgtccccatcacctggccgatctgcttaggagcatcgtcaaccaacgcctacgtcggacttccatggcagctagcacagccatcctcggcgccagtacgatgtacgccatcaactcatcatcagacgccagtcgccgacgatgctacctccacggtgccaccacgttgtcaagacgccggatgtcctcgcatgtgcggcagctgcaacaacaagagcacggcgacggcgatggtgcctccgcccctggccacctctgccgcccacggcctgccgactccccccccccccgcgcgccccgcccagcgctcccgccgccgacgacgccctccccttctcttgcgtcaccggccggcgccgccggcatccgaacctctcgtgacccgtggcccgtggctccatgcacgcccgccactccgctgccgtgctcgcccaccgatgctctgcccggcggtgctccaccggtgaagaggagaagaagagaagtgaagaggaggagaaaagagaagaaaacatatgtgaagctgacatgtgggccctacgtacttttaaattttttttctgactaggatggcacgtcagcgaaaccactcacatatactgccatagtaacttgagtgcacggtttatgtaagtttaggggtaaacatttctggttttgtaattaagggacctcaaaaaatctcgctgttaagttgagggacctccggtgaacttatttcaaaaacaaaaggagagagaagcaaggtccatcgcttgggccgacgtcctcccccctttccttcttacttgggccgacgctcccgcacggcccaaggccgcgctagcccatccccatgccgaaccagctagcccaaggccacgccagcccagcttgcccgcgcccctccttcagtccagcccactcgtcaattttgtccccctcctctagcctagtccactccctcggcccgtagagtaaaacagaatgccaaattagtgcacgattaaggccctatttctttcatgttaggattattataatctagattattgagagtaaactgaaagaaacagataatttattaaagtagcttattataatctggatcccagcttattataatccgataagctcatttatgtgagctttttccatattattgggtgaaaaattacccaccatgccaccccactccttctttaaacttgtaaacccaataatctagactctaataatctaggaaagaaacaactaaccgcctattctactacatattatagcttatagtaatctgactcaataatctagattataataatcccaagctaaaagaaacagggtctaaaccagaatgtcagattagcgcacgattaactaaatattagcttaaaaactcataatataaattaatatgatttttaatgaaacttttatatagaaaatttttttgggaaaaacgattgaattccattagccgataggcgaaaccgaatttttttttttactaggagagcattgcaggcgaaaccaaacttggctttggtttttcctccctctcgaaggaagcattcctcgccactctctctccatatgctgcccgccaccgccaccgcctccgccgcgccgccgccgccgccgccgttgccggcgtcccccggcggcgagccgcacgccgccctgctcctgtccctggcctacctgccgctgcgcgagctgctgtcctgcgcgggcgcgtgccgccgcctccgcgacgccgtcgcgggggacccgctcctgtggcggcgcgtcgcggtggcggcgccgccgctcgcccgccggctcaccgacgaggcgctcctcgcgctgacggggagggcgggggggacgctccggtccctccgcctcctcgggtgcacccgcgtctccgacgccggcctgctccgcgtcgtcgagcgaaaccctggcatcaccgaggtatatagtgggagggttttcccccacaccgcatgttcgcttcattttggtttgtgagaaaagtttggattagggaaagatctatagatgctttgggtagttgggtgttgctcgcctaatgtttgctgtaatgcctacgcaccgtggctgctttagctttcagcagtttggctcatgttaccgaaatcgaaagaggggggaaaatgcaataatgtaatgataattgatcaagttaatttgaattcattacaatttaaacattacatgtttacaaatacaaatcgatgttagttgatacttgatacactgtactttatcgtgtttggagcttgatagacttatgttggtgttcatgccctcagtaaatagcaccccccagaaagccagcgcactagcattttggacttttagttatttctgtatgaaatactatttttacacgaggacaactcgacatggagcttgaagctttgtgcttcgagagagaatgcatgttattgttattccaattcctgtgatatggacctttttgaaacaacactagtaatcttatatggtatctatggtggcaacaaaaggtagtggttggtttcttgcttggaagagataaattaattcgttgagcacattactcaatcaagtgtgaattctaggatcctgcttgcttgggtgcccattttgtatcctgtgatctgtgttaagtgatcccattagatactaacattaacatccacactagtcgacgctggatgacctctccttcgcatttattcgttgtaaattataaatataggtcaatgtgacattaataatattttttgttcgtactaaatgtaatagtaaaaaatagtcttagtgtcttatagccaaccctttagtgaaagatgtgctagagcaacaattttccattttgctgttcttggacagtgtgatctcattacccattaaaatattattattttttgggtgtcctagtattggtatacaagttagcaagcgagtcttcataaagttactccatactatggttttggccactgcttccaactttaggcttatatataccactcagtgtgctacatggtacatactgtgtaagtgaaataaagggttccgagatcctattttatgagccttttttatcacagattcctgcactttggaattgggataaagcaggtgccagatgaatagaaatcgatgcctaatacacataagaaaccatagataaataataccagacacagaacattcccattgaattgacaccacgaaataataagaatttcagtttgatcccatgggtataacagtacaaacatctgattgaattattgcctaaggctttaagatggtaacactgatcctacacaatcttgggtaaccacctcacgtattttatacatggttgtttgatgttcttgctgattaaacttgattttaacaaattttttgtgatctcagacattctgaatgtttcatgtatgcacaagatgcatctcattgtgcagtatgtttttggaattcacacgaaacagttaaactagtgcgggaaactggaaaagttattgggttccaaggctccgagcagggaaaagttcttgatttaggactctttgttaaaagatggaataaatggcacaccatgctgggtttctcttactcactttcgctggggttgagatttctctatacgtcttgggttgtttcactaaccttgctaactgcaatagctactgggattagggagtcaacagtatctattgtaattttgaatttaatacatcaaatctgcagtggattgattgtatccttgagagatttttccttggatatacaaccatgtacaccacataatactggaaaagaatgtttatcttgtcaagaaaaatatggaacaattagggcactgcagtatttgtgaataataatgtataggtcttcaactttgaggttgccgtattatttcccttagccacctgtttggggataatatgagatacatttgccttggactttggatgtaccaaaccttatatggtaaaatgtggtgcagttggtcaatactcaatacttactgctccctccgtcctagaatataaggatttttagggttggacacgggtattaagaaagtaggtagaattaaatagaagaaggttgtgattggttgagaagtggaggtaggtgagaaaattgaatggtggaggattgtgattggttgagaagagaatgttggtgaagaagttgttatattttgggacggagggagtactctctaatctacatcaccctttgttctttaatcaatgaaagattctcagtatggagtctagtacgctactgaaggacaccatgatctcaactagggctaaaatttacaaggttagttagaagattgccatgactaacttcccatagcctttctaacttttgaagtgagcaacattagacatctcacacacatgaagttcatttttctcttgtttttttttaaaattcaatctaggaactgataactgtcatatgacaatttctgataagtactgtaaaagcaccaaaagttccattttaaaaaataattattgctagcaactagctgggagcaagttatctagttccattccaaaatcatgattgttgaccacaatttttttatggagcaatagtgagtttgttaaattgccactttcagttaccagaatgactttggaggttctagttctaagaaaacatgggaaataattgcatgagctgatttgttgtatgaagtttgaacttgctttacctatatatagcactgttgacttaacgatgctattgcacttagtttttatccataatagatgctggccagaagttacagtcttctattgcgtaaatctgtttactactgcagaatgctaatatatatgttcaattttgatgctttgttatttctggaagatgaaatcaatatcatatgctcatgaaaagtacatattcacttcacgtcgtaccacttacttctatgcaatagctttagtgacctttgggtgcatcttatctaacttattctttaacttgcagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggtttgtaccttctgatcttttgaactcttatttgctctttgcttcgaaaatttcccttcaaatttgttgaaagtttgccactgtttttcttatttgcttattgacaactcatctttgctatatggtcacaatattcagtgcctttagatatttgatagtgttgtctcctgtggttgtggaatagctgacatagggatctcatctttcctggaaagcttttaagtgatggtccagaaactcatttattctctcccctatgggctacaggaaagcaactgcacaattaatttttatttggttgctctcgtctttggaacaactggttcaatatgttaaatattcttcagtattttttcaggtctattgactttgacctgaactttgttcgcatttctacaaaataaggtttgatctattttgatgatttatttatatttcaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacaggaaatacaagttgtcgagtatacttgggtatgaaactactgtctgtgtaccagtacttgctgatgacttttacttaaagcgtcaaatgtactagactaactaactgagtgtactggaaatctaggattctgaattatttattgatcacgtcaaatttagcgggtgcagacttcatggacttgtgcaacttgtctgaaactctgaataacactgaaacagtccattgccctcaagtcccatatgcctatggaatgtgtttaaccttccaggcttccagctcagaatgtgctcagcatgacagactgaaggacaccgttattaaccgccatttgtcattttggagcgtgctgtactctgtctggctgccatttgcgcctataatttcagaattcaaatgatactcctgcaagaaatgctactcgactggaataccttccatcatctgttcatcttttacaggaagaagatacctgtccctgtactatttcgaatccgagtctaaatttgagtagtcaattgagggtttagatcatgttttgcgataaacttgtacaatattgaaatactcgacagttgatagcactttgctttccaaaatttgttccgtagtctatatcagtattttggtccctcattatcttggtcgagagagggtcactaacaaaataaccaaaatgtaccttttctaatgcgattgtttttaactgcacatccatcttcttttccgcttctttaccgaattattgtcatgaattgtttactccgtgcttcaaaaaacaaattttcttttttttttaaaaaaagaaactttcttctactgcgttgcttggactacttgttttaaagttattagataagtttatttctcaaaatatgtaatttattcttacaactaaacagattactgtcacgataattcgatgaataatctgtttcaaatgctaaagcagatcagcggcacctactgaataatcccgtgtccatccctacttttttttagacacaatttctccatctccctcgaggggagcaagccagcaagatctgaaaaagggttttaataaaagcataaacaattacttcaagttcatgcgtctccatttgctatttgagcaaccattttcaggagggaatccaatagttggcacggtgaagtcagagtctagctttaccaaattgagatatcgcactctcgagcgagtccctccattttagaccacacctaataacatcaagatcatgaatcctcccagatgtgaacctggaatactggaaacacgtgtatttcgtgcacaatgagcaaagttagttttacatccagaaacctgtttcgcggcgatcatttcacaatgatgtttcgctgagattttttttatataatggataaaaatccggtctctatatccacaagtgtatatacaaccaaacatttcagaaaaatattattttactataatattctatagcaatagtcaagattcctttggaatataggaattttacaggacttgaggtatgttccttttctcttacagataataaattatcacattcatgttttcaaagcacctaaatggtacgtttttttttggtaaaaagcttcctatttctatatataagtttcttgtaatacatctttagatcaacttttaaattttgtataactaatttattcacatgaaacacaagaattttacaagggccttcttcttttcctcttatagattacaggttatcacagtcatgctttctaagctgtgatttttgcaaacggtttctacatatataagttccttagaatactttttaaaatatttttttaactttataatagttacttcattcgcttgaaccctagaatattattttagaaagaaaatcaaataatccatcatctatttatccatttagaacaacagaactaggcctaattagttcagttcctataaaaatactctgaaatttctacattcctctgagtgatgaaacaggtggcagcagcagattggtcctccaaaatttcgacatgtgaaaaaggaaccttgctactacacccttcaccagtgagttccaaggcaaggcatcactgatcagtagttgtgctgttcccatctagtcccctgcttcttgccatgaactcaagtgaagggcacctcctttttcccctacacacaaaataaataaataaatcagtgctactaaatcacaagctggaactttttttccttttttttttcgcgtcggtgaccgtcttcaggtacactataactaaccaccaaaatccatgacatttacatgagcactaacaccccccggagcacacgcgtcatgggagacaggatttgcagagagcaacagcccaagaaaaggggcatgagctttgtgaaaattgtgactctgggtggcacatatgtcactgcaaaacttgttgcatgaacagggtcagaatgtgagttggagcaggaggaggaaaatgttggttgggagaacacaatctttggaccactaacagtctctccatcatgtatggtgatctgatcatctcttcctttgtgtggaattgaagtggattcagaaaggggaaaaaaaaagaaagaaaaggagctgccttgcatggcatggcaatggcacctggccctcctcatctttcagggtttcacatatcccaatcaaaggcttaatagcacatctaattgtctaatgataaaggatgatgggaggcaaaagtacatccatgatgatgataataataataatctctggtttttgtatagtaccatgtttttcagctttgagtggcgaaatttgacctcagcgcgacaccgagacgcggtgtactgattgatggcttgttctagctagctgaagtcagagggtgcccttttcttttttttgaactgcagtcagatgatgcttttgattgtctgaaaggatacttagtgttggtgccaaactgcccaatcaagatatgccagggaaaagaaatgatgaagtgcactactttaccctaaattgacttgggaattcaaattaagcatgcagttcttcagtcaacctatgaagtgatcattcatgttcgagaaaaaaatttgtaaaaaataagagtgtttttacgatggtctctaccagcagtattctacgactagtacagatcacaataaaaattgtcaaaatataaacgggtctttttgtttactgaagaagatgtagttgatcattccgaccttgtgtcctgaccggcctgaagtgaagtcttgatggatactgttaagttggtcgatcagttaaaatgaaggtcatctagtacaacaaaataatggctttcattgccaatcaatctattgctggcactactacaattcagaacacaattttaccactcaaattactttttactcactattcatttcatttaaacctataaaaatttagtcgaatatcctccaccgtcatcgtgtcgcgatccgcaatctctctgtatggatagaaggaagaatgttttggatcttagctcacagacttttgtgggcaatttcatccctgtgatatcatgggaagtttcatatgttgacaagggagagtgagcagtgttgacctcaatgatcattcaacatttcctgcctgctggaagccaaaatcttgtccaacaagccgtactccatactgcggctacatatacctctgaaattgctgatcaaatcttcaaaaaaaattgcaagttctacacgcgcttgctcgatccgtcgcggccccataatttttcaccggaaaaaaaatggatgaaaatttttaaccatggtaggacaataaggacccctttgcaagtcatatctgaagctctagaacagatgactgaacattttacatgttgtcaattaattaagctggtcggcagcttaatcgattgatctgaggataattaatcttgtcaataactgttttcacctaaaaacaggtagtagaattctctgatctcacctaaaatccatccagggcaaaaggtagaccagaggataattttgtcagaacatgagatgaaagtaaagggagaagaaaagaaagcatggaaactttgtagtgcagcacttgcaattgcaaagcaagcaaaagggacccaagagcagaagctcatgcttcatggtggcacgtaggccaccctcacagccttcactgccgacgcccggcccgggcccaccgcgcagcctcaccggcctcggacacgtgtacatagagctagtaagcaaaataaaaaataaaaaataaaaaaataaagagagatagaagcttgaactacacatcagtacatcacacacagagagacccttggtgcttactacacatcagtagttagctactggctggtttgttttgtctcctcttcttgcctcccccttataaaggaaggtgagcattgcatcttgctccttagtactcctcctcctgcatcatcatcccaatcctcaattcagaattcagaactgccatttgctaccttacataccatacctagctgaattgctgtcagttaatctcttgatcagatcgatcaccctgcagcttcttgttgtttctagcatttctggtgaagaaaccaaatcttcagcagcttaaggtaggagatcatcaatggggaggcagccgtgctgcgacaaggtggggctgaagaaggggccatggacggcggaggaggaccagaagctcatcaccttcctcctcaccaacggccagtgctgctggcgcgccgtccccaagctcgccggtgcgtcgatcgagatcctcgtgtcgcagtactactttatgtgtgttttggctatgtgcatcctacgatcgaggccgaaagtttatatactttcattgtctgaaaaagggtatgtttgtaataaaattatagggcttctccggtgcgggaagagctgcaggctacggtggacgaactacctccggccggatctcaagagggggctgctctccgacgccgaggagaagatcgtcgtcgacctacatgcccaattgggcaataggtacgataacattgtcctcgacacgttgggacaacatgcctgaacgtatgataaattagttttttaatgtatatataaccatttttatatacaaaacatgttaggtggtctaagattgcgtctcatttgcctgggaggacggacaacgagatcaagaaccactggaacactcacatcaagaagaagctcaagaaaatggggatcgatcccctcacccacaggcccctccagccgccgccgtcgccgtcgccagagaagaagcacgcagagagaaagaacacggcggcggcggcggcggtggccgagcagcatcagcacgacgaactctgggaggaggagtccccgggattctgcaccgacgaggtgccgatgatccacccggacgagatcatggtgccattgcgcgaccacccgccgccggtttgcacggccgccggtgcctcgacgccgacgacatcgtcgtcgtcgtcgtcctcgtcggtggcctcctcgacgacgagctgcgacgaggtcgacgccgcggcgctgctcccggtcctggagtggcccgacgacgccatgtgcctgatggagctcgacgagctgatcgccgcggcggcgccgccgtccctgctgtgggacgacgactaccgcctcccgctgccgccgccgccgctatcgccgccggcgatgtacgaggagctagacgcctttcagtgctacgaccagcagaggagcgcgtttgagcaggaggcagcagcttcagcgtggaacaagcttgagctcttctaatcaatcaaaattaaactctgtaaattatgtttacagtgtttattataatcaataattaccgaactaaaacagaacagtgttgtttcattgttctagtattgcctctctggttaattgttccattggaattgcattagtgtagtgatgtgaaatgatcaatgttctcagttatatattgcagaattcgatcagtttatgtcaaaaaaaatcgatcacttactaggcaacttcagtttttcttttttttttaaaaaaatcagatcgatgaaaattgtccctgcatgtgtggggtagtaataatccatgatattataatttcatatctaaatatgaccctgtttagggaagcttctgcaccttctcccagaatcagaaactcctctaaacagtctagtttttagtccaaattctgagaagctgtagttgtagaatccaggaaatgaactacaagctagaagctggaaaacccagcttttccatattcttggaagttgctaccaaccagctgcttctcagaattttaagttccccaaacaggctttatgtccctgtggctgatctttgtactttctataaaaaaaacagaaaattcagcaaagagccaatttttttcttagaaaataggatataaacccgacctctacatctaaccagatggacacaaccgagcataaagagcccaatgagagttatggatttacaggaaaaaaaatgttgtttgctttgctcttttttttaagagtaattctacggtctttgaggaggtaccatgactccatgaggtacctcataatatctaggtatcaaatttacaatagaaaaaataatacctcatggtatcatttcaaggactgtaaaattgctttttttttatgtcatgtgcacttgcacgcgtgcatgcagatgccgtaatgctaaaggaaaataaattcaggagagaaattaaagaatgagacctacgtatgaacaattgagaggagagagatagatgctgatggttgtagctagattctaagaagatcctactagctaccaaactctccttgagtgcagtgtgctttgtacttcacttcattcatatcccaggtgcaaaaggacaataatcaagtcgctggatctaaagtactcccatgggataaagttgtgtgttatgtgagttaaacataattttgtactttactatattctaaatcttatttatttagacgtgtgctataaatgtactccctccatataaaaaaacaacctaaaataatatgagatataatctagtataacaaacagatccatgtccatatttgttgtactagattatgtcatatcttatattagattgagttattagcggtttaaaagttaatactaagaacaaactaagggataaaaataactcgatcgaatgttaactctaaatttagattttaattttgaattccatggcggctaataagataataagtaaacaattggaagcgcaagtagattcaaactttctctcccatgattttacaaatttcactaaggttattgtgatttcaatagattttgaacacgacttatcactagtgatcttcctataagataaattttagtgttcctgacggttagagcatatatgatagttgtagaaatattaggataagattaatttgtttagaaccatttcttattgctaatcctttcatatctctactcatataatctttatacatatatcatcccgagaggccgagacccaatacaatcattcagttacatactatatttctcttcctatatatttatcattgcttcttcgatcgactacggatatatatacccatagtggaagaagcagtgatgaatatagggagaatagctactttagtccctaaagtttctctgtaaaatcagtttagaccctaaccttttaaatggtccaaagaaatccttaacctttttcataaggcctagaatattcgttgggtccaccaaaatcatcatatggatatgccatgtcatcattcatgcaaaatcaataatgaattgtccaatttacccttacgtatatcatagaaaaataaatataagggtgaattagatataaccataggaaaaaaatacttctttttttcacccttttgaggtatatttttgctcttacaaataccatatattttttaactttttccttttgttttttactttcctgtgcgtaagggtaaattggacaaatcatatagattttgcataagaaggtgacatggcaggtccatgtggcgattttggtgggaccaaggactatattagcccacatgacaaatttaaaggacttgtttggacaatataaaagattaaggactaaactaatctaggagcgaaactttagggatcatattaactattctccaatgaaatatatatatatatatatatatatatatatatatatatatatgtatgtatccagcgtgcgtgtaacagcacagtggaatacatatccaacgcgaaagaaggaaagcagaaatagtttctctagaaaaaacataaataatataatactaagatcatccatgacgcatgatgatcatccttagccggacacacgctcacggctcacatcagcttctttctacgtacaatgggagagaacgaaagtcgcatccatatgcaaaccagctagtatctctttgctcaaatccaaaatttgcatgattggcgcatacaaattcaactgctcttcttattttttattaattaattagcttgaatgcggcttgtcaatcctcgtcatttcacttaataacattattaaccgagaggttctgtatactcgctcgatataaaaatataataacttctaactcttaaaaattaatatgtcttaaagtcgatttcttcactaccttccacatcttaatctatcacaataattattttttaatcatagatatgtccacttcccaaaaaaaagattatagatatgaccactacctagtgactagttggttaattaggttatgaaaaattacatatatatgtttgtttgagctacatataaccaattttaaatttagaatttaatttttaagactagcatagggattcttaaggcgttttaatcattcagctttgacttccataccacttatataagtaaaagtacaaaaatcaacattaaaattattttccgttacatcagtcgtcgcgggtcttttaacttataaaccatgaataaaaaaatatcttccttgagtccgaataaaaagaatatatcttccatataggccatctgtaaggaatttttctctgttatatttgtagctagtcaaagtagcatattgtgcatgcatatcgtggcagctctctaccactacgacagaaacagtttttccatgcgagagacccagtaggtagcaggcgggtcgactgtctcttctttttatatatagagataattaattaactaactatgctctatttttgaaaatatttattaattaagttattttattatatttactaacatgtggcgtgtcaaatgatgtgtggacgtgcggcctcaatggtacgaggtgtatgtgcaacacacgtgctagctagaccatatgctttgcatgcggcggcgagttaattcacataatttaatatgtgttggaggattatttcactagctttgctttttcctaagacaaacaaacatatgtatgtatcttttaccatcagtttttaaaaaattatatagtttaatatcatattcaccatcttaaataagttttataatatataatttatacgttgttaaactacatgattttttttaaaataagtttgacttgagaaaaaagagggagtccagtaaacgctaattaccgcttaatgttctcatgttccaaagctagccctaattaagaattaaatttaagggtattgtgctgcttaattactataattagctagcttgggatatgtctagctatatgctattaataagacagctagttattcataggtagtgaagacataatatttgacttcttgttttatgcatagataatatttttatcatacaaaaccttgatcagtgtacgtgttttccacgcgtattcttcgcactctaatgtgcatgtgttggtcgatattttttttttccaaaatggatatttggtgtggaataaatgagcatcaggtgtagaatatctacacatgcgtctaatagtctgttgaagtgcgcggtcactcttcaaacgtaaaaatgatataccatttttttagagaaatatatgccgctttgacaacgactataaattagtataatatattttgaaaagttagagaggtttgttatggaattaatatttgagaacatttttctttcaccaatccttgcatccataattcgcttgtggtatgaaaattttacacttctctcttttggcactattccgttagtacttcctctgttttgtcattatctagtccaatctagtagttgttgatcattatgtacttgggggacattcaaattaatctatttatccaaaataaatatttaatctgtccatgtatattaattatcaggaattcttgtttagcattattaatttgcttgcggaaaatgaagaatatagggtaggtttaatttggtgccaaaatgaaccttaccaaaatttggcaatggcaaaaattttagtaaattgataacattgccaaaattttggtaggattggcttaataatgttgccaaaattccatacacattgccaatatttggtaacaaactaaatgtagccacataattattaattttaccaaataatagtatggttaaaaatgtcatcaatttgaacagactcgtactatagcaaaatttgctgctttcgctctacttcagtactccatccgtttctaaatgtttgacaccgttgactttttagcacatgtttgaccattcgtcttatttaaaaattttgtgaaatatgtaaaactatatgtatacatgaaagtatatttaacaatgaatcaaacgatagataaagaattaataattacttatttttttaaataagacgaatagtcaaacatatttaaaaaagacaacggcgtaaaatatttagaaacggatggagaatttgattaagtggactacaagcgtaattaatggatattgaattctggtactaatggtcatttcattggagaaaaagaaaagaaactgagggaggattatttccatggatggaacactcttttcttcatggaatataatttaatttattacgaacaagtatctatcaaacggggtgtttggtaataagaagaggaaaaaaaaaactaacgctggtttatctttgcttttgggcatcgtgtgacgtactgaaacgtcctactgtctactgatgatctcaagttgtcaattactgccaattagcaataatttaatcaaagttgttcacatcttcgtaggttgttcgagctgtttcatgcatgtacccgtacatatatgcacacaagttgatgatgagatgatgagttaggagcgtgttcggtgaggacacatgcatgcagtccaacaaaaggttctagatattgacattgacttgacgactagcttgatcgcagttccatgcattttttattacaagacattttattttttaaaataaaaattttgagtttaatatttatagaaaaccatagtaatattttttaaataccaaacaaatatattatcaaaacatttttaatgctagatttaatgaactaatttgatgttataaacgttgatatttttttataaatttaatcaaacttataaaaagtttttaaagaagttaaagtatcttttaatatgaaacggagaaaatacatgagtagaacccacggcgattcgtcgaacagctagctagaccagccttttccagcaacttccgagttcaaattaagaaatttgctctaatccggtccagtaaaaagtatctcgaggtaccggcacctcatagtactaaattgtttccgatcgttggatctagctggacagaggtattgttagattcaacgatcggaaacgatttggtaccatgagatattgataccttgacatactttttattggaccggaacaaatctctcaaattaaactctatcgatgagaatcgtttttctttccacttatacttcctatattattcttttcggtttaaagattatggattactgcaagtttgcttcctaaacttccaaaagcgacacttattcttacgaaactttcttcattagtattttttagaaaaaaagatttaaatcaactttttaaatgttcaatattttatttattcgtctgtgcccttaaataattttcataaacttagttgtatccatcacccataaagaatcttagggtgctttcttttctcatatttctcaacttctaatttttctgtttatcaactagctttattttaaaagttctatgtaaaagttgcttaaaaattacattaatctatttttaaatttttttaattaatatttaattatttatgtgctaatgagctagtccgatttctatatgagaaaagttttcaactcttcgacccgaacgcagacaaaccgggcagaccggacagacaaaccgggtagacagacaagagagtttggaagagcttgctgcagcagtagctacactgccttcgtaaaaaaaaaatcctgattttaaagccggacaagtgatttattaaagtatgattaattgtgtattaattattttaaaatttaaatagacttgcataaatttttaaagaaaattttcgagtaaagtgtacgggcggtccttaaacttgtaggggtgtctcatctaggtccctaaactctcaaaatgcatatccaagttctagaacttgtcatagtgtgtcatctaggtcccaaatcgcaacaacccattatagattctacgtggcgttgatatggcatgccatatggaatgacatggcatcccacattgaatgacttggcatcattttggctgacaaatgggtccaatttaaaatttttccatttctttttttcttctctttttttccctttcttctcctttctttgtgacccgagcagcagaagaaagggaaaaaataagaatgagaagaaaacgaagaaaaagaaataacgaagaaaaaaaaaggaaagggacacgtcacgtccatgtggcatgccacatgagccgtaggattctaaaggagatgtgtcgatttgggccctagataatacactttgacaagttctggaacctgaatatgcattttaagagtttagggacctatatgacacaaccctacaagtttaaggaccgccgatgcactttactcaaaattttctatagaatttttgttaaatacataatgtttagcagtttgagaaatgtgcatttgaaacacgatcatacgaaaagccagactgctataagtctggatacgtttattaaaatgtgtcacatctaataaaatttctttatattttgaaacggacaaagtaggctaaccgctcagttacatcagctgccgaaccagaagccacagcctcacaggctctgtacaggacagcccatgatgctagagcaagtttcaccgaatagcctcaaaatctaatcagtcatataaattaactcttacaaaatttaaaattcaagtatcaaaatatttaaagtagacaaaaacaaagtaaaaccgggcataaagaaagtacacgctgcgatcctaggcttaattaggcatatgaaaagaagttatgcgatcaaaatattaaaaatagaaatccgccattcaaaataagtaattggatcaatcattgatcgatgtggtggtagagtcacgatgtatagtataattctatttgttaggtttaaatccgagcgtccataaactatatatagatagtagaggtacttccttagtaaaaagaaaaagacggcgaaagtggaacgacgatggattcctctccttttatcatacgtaggtacatgttcgtcgcttttcatcaatttttttctcctttctgaatttcggcaaattaataaatttcctaaattaatatatgaagataacatttttaaaaaacacaatacaaacgaagacgctcataacatacacgcacttaccccaaacactcatggatatacttatcatatgagcatcttcgaaagactgggttgacatctacttacatgttcatctcttttcgtcgtttttctcctttctaactttcggcaaattaataactttcctaaatttatatatgaagttttttttagaaacacagtacaaacgcagacgctcataacacgagcacactcaccctaataaatacacacgcacactttatatctatgagcacctccaaaagactgagttgacatattttgagattaacgaagtcataacaggcgactcactatcgacaggtacgtcgcgtaccattaaaataataaatagttgtaaatacgagcacacacgttaaatctaatatttaaattcgagtgaactgattctataaaaaaaaaacctaattagttgaggtaggctcacttcactacatgaaaacaatacgatctttcattatcagggaaattattaaacaaattattaaagctgctttggagagacgacgcggttttaataccgctttgcaatagtacagcatatccacttgacctggtatcgtgagcgtctggactgttccggccggcagatggcgaacacgtatactcgacagtataaatgctactacgtactccctccgtcaaaaaaaaataatttctagggataaatctagacaaatatggatccagattcatccccaaaagttggttttttattgaacggagggtgtaatgcagtagcaacgactgacacattgactaaacccatacgtcaacgtctcctattacatcaactgtacaaatttcccaccaatgtgtggtgcccacgcccaagcatagctcctatatgcaaggttgccttagcctcttagttcccaaaacaaaaattttcacgctgtcacattaaatatttagatatatgtatagaatattaaatataagaaaaaactaattacacatattacgtgtaaattgtgagacgaatcttttaagcctaaatacgccatgatttgacaatgtggcattacagtaaacatttttaataaaggattaattaggcttaataaattcgtctcgaatttgtaatttgttttgttattagattacgtttaatattttaaatgtgtgttcgtatatatgatgtgacaaccaaataaaaaaaatttcacaactaaacaggccttgccagagcactggtatactgtagaagatatttgtgcagccaatcgatagcatcgatgttttctgaattgcccgttgctctgtgtatagaattagacaactttttttcaggagtattattatatgacctcctgtaacatttgatttttaaggatagatttattaagagaatcacttacgaaaattatgttttacaagcctttgctgatgaagaccaccctaaaagtatttttaagggtggtttattaacaagtctacatgtgaaaaaaatgttttccttctttaaaagtaatagaaaatttattttaaatccgattgaagtgaatcaaagttgtgattcttacattatttgctttaatataaatggccgggttcatatttccttagaacatttattttaatacgattgttactcatctcatctcaagtactttgaaattaagtagtaaatggccctaataaaaaatattaaccatgttatattaaagaaaatattgtaagcatctcacataattttggttcaccttcagacttatatgaatttttatagtttaaacttcataaagaaccgcaagtaaaattagatactagagcatatatataattagatacttagccctgttcttttctctaataagagttgaatgaagattaagatttttatcgcacgtttttcaaactgttaaatagtacgtttcgtgcgaaaactttctatatgaaagttgctctaaaatatcatattaatctatttttcaagtttgtaataattaaaactcaatcaatcataagttaataccacatcgttttgcgtaaaaaacttaatcttcatcttcaggagaaaagaacaccaccttagatgggctcaaatgtaaaaatgtaaaagagatatatagatcccgtcaatctttacaattctgataaaaccatgatgtaaaaccatgtctccatcagagattgtttgaaaacttatatctaagagaacttgtaacgaatatttggtcttctaaactctctcaaataaaaaaactatcaattaaattaataagtgcttgtccatcctttcatacattaaaattaaatgataggctaagtctctttaagagcagagatctaggtctttttaaaacagagtttttttagtaaggccttgtttagttttcaaaaatgtcacatcaaatctttagatacatgtatggatcattaaatatagataaaataaaaaactaattgcacagtttgtatgaaaatcgcaagatgaatcttttgagcttaattagtcaatgattagcgataagtgctacagtcacccatatatgctaatgatggattaattaggcttaataaattcgtttcgtggtttccaggcgagttatgaaattagttttgtcattcgtgtccgaaaacccttccaacatctggacaaacgtccgatgtgacacctaaaaaaatttcttttcatcaactaaacaaggccttgtattattcgtgatctcacgatgaagtcaggcacacgcgtgatcactacagtagtacacacaaatcgatcgatatcaatcacacactcatgaatcattttgtgtttgactcggaacgagcgatctatcactctctcaaactgtgctcttcctcactcttgacgatacaagtctaccggtttgctaattagcaacaaagtcaagaaaagacaccagaactcgtcaattacattgaacgttcctacctacgcgtaccaacacacatatatgcctattgcctaaggtctaaatcttgaagataaatacatatgtgtacaacgtatgtatacttcatgaaaggtaacttcccgatgaagtatggtcacaagtttaaattcattaaccggccggccaagattttcctgcaagtcttaatccgcacaatcaattcacaataatcgctgtttctcatgtgttgacaagtgctcattcccaaacgataaatttacaatggaggacagaaaatttacaagtgctcattcccctttggtagaacatatattcactcaggtacattttttactatagacgacgtacctgttaacaaacaaaacattgtcataactttatcagaaatatcgatcccttcctcaaaggtgcttataggattccactttgtaagaaacttcctgttgttagggcaagccggccggcgggaaatagcccttgtgtaaaattattatggttattctatcaacaacgacgactcaaatctgatgtggtgatggaattgtcgtggatacatgacttcactaaatgatgtttaaatcttaataattataattatataaaggtggttgcaatttcaataaaaaaatatgagtaaatttcacaaaactacaggtatttttgaacaatttatcacaaaactacagatttaagagcttgtttcataaaactacagatttagtgtcttcgtttatcacaaaactacaggtactttatataatctatcacaaaactacagatttaagaacttgttttacaaaaatatagatttagtgtattcgtttatcatagtgctacacatttagtgtcttcatttatcacaaaactacagatttagtgtctccattctcacgaaactacgcgttttagcattgttaaaacatgtaattttgtgagaatggagacactaaatctgtagttttgtgataagtgaagatattaaacatgtagctctgtgaaacaatttcttaaatctatagttttgtgatatattgttcaaagtacttgtagttttgtgataaacaaagatattaaatctgtagttttgtgaaactagttctaaaatctgtaattttgtgactgattgtgtaaagtatatgtagttttatgaaatttactcaaaaaatattgatgttccagatttattgttgctgtttctttgggcgtgtatggatgtggtgtatgtacatatatatgccgtatgcatgcattttccatacaatcgcaaaaaaagtcagtcatgtaaactagtgatactttttgatgaagtacttggtacagctacatatgtaggcaaatctatactttctataaagttaaaccccactaaatctaaagcttaatatgtaaccatgccacatcatcatctgctagtaataattacatatttaatttcatgcaagaatacaacatcatcttaaaaaaattgatacaatagtagtgcttgattgccaaattttttttttttgagaattgcttagtaatttcctacagtaaagcgcggggaatcacatagtggatacaatagttactgctgtaactaatttaggactcctctgatatacatgttttcttaaaaaaaaattccataggaactagttcatttcctttaaaattctcgtaagtttcctcagttccaaaatgaggccttatcatttactaccttcatgctaaaaaaatatctttctagacagtttatcaggttcatagttaaaaagataactgtagtatttatttacggggtagtaattaataatttggctcctctctccattctcaaatatctgacttcgttcactctccccatcttactttgactataaattaccttttattgattatattatgatttatatagtcaaatttatgactccagacacaccttaataatatagtagcatattttcaagcagaagtatatatagggaatttgaacttcaattatttgagaatgggggagtatatatagggaaaatatgtagtgaaaatcatacatacagtgaaaacttaaaaaactaccgttggataaaaaataaacttttaagatttgttcatgtcatcaatagtaaaaaaatttacttacatattcaacaaagagtaaaaaattagtaaaatttttacttttggtgacatggataaatcttaggcatttatttttaaatccaatgattccttccatttatcccaaaataagtttatttttcagcaatcaaagtagaggttaaatgcattaggagtagataaaatgaagaataattgtataaggatttaataaaatagagatattctagtcttttattttttatcgatatgtgagatgagtgaaaaatgaacctattttgagatggagggagtaatatatataattgctggtattaattaatataaacttgtatgtctaattaagtcattttccgtgagaatttcatatacatgttactaacataaaaacacaaaattgctcccaattctacatttctttgatgtattagacagtcaatgcaacacaagtcggagagttctcgaagctgaactttctggtaaatcaattatcgccccatatatggccattcggtgatggaggctgcagcggctcgaaatttcctgtaacgttcacatatatacatatatcgtggttaagcttatttaaatttattagttaattaatcactctctcggtcatttctggataaaccacttgacagtttatgtacatgaacatcttgacttggtgtgtcctggtgatggtttgagtcttctgaaactgactgacgatgcataagcatgtggtttagaaactctggaaaatcacccattgcacgaatgggcaaggggggggtctccatcataaccacatcaaagagaccatcaaattaatcacgagtaagcgtatcactctagaactcatatctgagagctatatactttggtattgcaaaagactagacactatcaaaattcagtgggacagagctactccctttatttttttatataccatacttttatattcatcttattaaaaagtatatataattatcatttattttatagtaatttgttttatcattaaagtactttaattatgacttatacttttaagtatttacataaaaattttgaataagaaaaatgatcaaatgtagcgttaacggtgtcatatattaaaaaaattgtaacattaaaggtctcatatattaaaaaatagaggaggtattactataagatggatagatagaaatcactgaaattttagtactatatcataatttaaagtggcgtttggtttactaacaaaacaaaatttcgatgttactaaattttggtaggatagcgaactgaactaattaactctactcctactgacacagtagtcatgatccaataggccaatcttgataattacttttttctcggatgctcgaggacacaatgacgcattgtcaccacacaaactgacacacaggagaacggcaccttcaccgaccacagaaaattacttcataaaaattgagaagtgaaacgaaacaataacctaaagtctagacaagatctcttgctttcatcaaaggaattaacagcaaaactccagatagatagaaagacgacggctcacctaaccagaacataacaccccacacgatctgaataaactatcaattgattaattgattattgatacagtatgtaatatatatatatatataatgtcaggaccagaaaagcaacagcataacacctagatatagctagatagttcttctttaatttgttatgcaactcatgacccaccttagcttatccctgcacacaccaactattttatacttgcatgcacagcaaaacagaattgcagattaatctgaaagtgtcaaccctaccaaacgtccaaaccacacaatcactttctgtgatggctgagtttgagaggagaggaaaagagaagatcgagaagatacgcaaaatgaggtgagacattagcgcatgattagttaagtattaactattttaaattttaaaaaggattaatatgatttttttaaagcaacttttctatagattttttttgcaaaaacacatcgtttaatagtttatgaagcgtgcgcgcggaaaacgaggtgttttctctctcaatcactcagaaacgaacgcagcctaagtactattgttagttgtgacataaatctaacgaagcagtgagatggaagaatggtgtagtttccttggtgaaatggctcttgatgatgtgattggtcactggacatccatgatccatgcatgtgttcaaatgcaacaagttgatttttttttatcttgatttgttagtacaagcaagtgggggcgaacctaggaccaaaactagttaggtgattctcgttgctactaagcatagccacagaaatgttttaatttattttaatatgaggtaattaaactagcaattgtctaaacacttaagtatgctgggcccctccagaaatcaacatggcaatgctagctctgcgtcactgaataattacatggcctttttttttctctctaacacatttattcctactacaatctccgatgagtttcatatgaaatatgttatacagaaaaaatattgtaaggttaaagattaatttttcatgagctatgttcttaatatctgaaaccattttgtgaaagtacttgaagtatgagtataatttttatacactaggtgtatatataagttgactaattgtagataaaatatctatgaagctgggctaattttcattttgagagagaaagcagttaacaggatcaactattaagagctactgtatgaaaatgagctgagaagcattaatagactgacctggatgtgcaacaggagtgaaggcccaagtacaggagccaggaggtaaaactatagttgcaaatgatgtgattggtaaactgggaggtcaaatccagtgtcgagcttttgtttctgtcacagcatcatggtgcaagagtaaatattaacattactaacttggtgtttcatcaggaaaaataaatttctgcataacatgtgcctaacaaaatatataatgatgaaaagaactacagtgaccaccagagcgatacagagacgctagttgtgctggtctaccatgactcatgaccgttcagatatcatcctctttgcacttctccagtggactcagcttatctcaactagccaggggaaacaatagacaagtagtgattagaacaggataactggtctgatacagcaacgaattctgaaaaaggcgtcaaattcaggaaaggcgggcgatgacatgtattccagtacttacagatgaagtggtctctaacgcgctttagtcctacttgttccccagatggtcccataataacgcattccctgcaaagagtgtgtgcctcttggcttagcaacaattgatatcttttcccctgcatatagagagagaagggatgataaagaacaggtagaaaccattgcttcaattatacttcctccgtttcacaatgtaagactttctagcattgcccacattcatttagatgttaatgaatctagacataaatatgtgtttaggttcattaacatctatatgtgtgtagacaatgctagaaagtcttacattgcgaaacggagggagcatgagtcagaaggctaaagccacagcaacacacaccagtgttagcaccttgatattttagcagagctttgtaaaagaagatctgaagttctgaacacctatcattctgcaaattttcatggttattgatttttttcttttattgtttgaactctaaatcaacttaaaactcaacaaactatcactcattttcacatctactcaagtgttggagtttatttggtaaggacttagaaagactaaaaaaccatcatcctgcttaagaaattttttcgggaggaacattctccaatcaaaatgctaaatgagagcttctcatcagctctcaccatgcataatttgaaacatgtttaggtaaatcaaatgtgttaataatgttgcagtgattaatgataactgatattataaagagaatctcgtgtttcggtgtccaccaaacacattaaagcaactacaaatatagaaaattctgtaaaataaatgccaatatgagtgatcagcgttagatagtaaggactaaggactagccagtcttcaataaacaaggtgactggttactcaagcaagagatactatacaactctgcaccctccccttatcctcgtgtacacacctccattcagtagctttgggaaaagaataccatccaagcaagagacatagacattacagacaataatacaacctcttactcaagagctgtagatgacctcgcattgtttggtactactaggattggcaagtgacaaccattccctaactatatatcccaagataacactagtaaaataacaacgcccatagctagtgggaacagaaattgcagtttccctgatctccaatgtcaaaaatattgagtgggcacttcttcactagcctatctgcatcatcaatttttacttctttgagaaaaacaactacacaataatataacactaagccatgaaaacaatagtatatagcaactcatggttttcttataagagattccagcaaaagaattttacctcagggaaattctgtaccaggctgtagtagcaactggagaccacttagaatgaactttcctcattcccttaacagcatatgcctcaagttcaatagcctaaaatagaaccgactaggcaaattagaaggcacggtggtttgcggagaattaccccatgaaaaattagtaaagcaatttcagagtagcaggtctctacaagaaaatatctttgcagaaatttctatcagcatgcacatgaactcaggtttccagcagaaatttaagccgcaaaaaaaattgattggtcacaaaaataatggtaaagctacatacatcaggattccaggaaatgactgcgttgaaatctttattataccatgtggactcagcaaagcgccataatccaaatagtaagcctaaatgacagcagatataggtaccaagtatatcatatagtgtcaaggggaaagccatgataacaaccaccataacaaacttacttggccaggtccaaacctcataatagttatatcgttaaatttcacaccatcctttttgagatatccttcttgctttggccgaaggaagtgtaggtcttttgcttgttcccagattgagcaggagatgacatatttaattggctattttctgctaaccacacctcagtagaaaatatcagtcaaccttacaggaaatatgacaggattataataacgataagggcacaaagaatagaatacttaatttatcattgatataagtcttaggttttagcaatttaatttcttacatgattgattagcataagagaacaacttcgcaaaaaaaaaagaagagataacaagaagtctagccatcaaagctttccaagtagaacaatgataacagaattggcatgaataagctgaagtaccaataactaaggatccactgtttgattcagcgtgcatgaatgatgatggtatcagaaaatcagttaagaaatttgtttagatagtttgagtttttggtacacaaaatattatattggtacatagtagcattaggcacatgctttgctgccaaggatttaccctcacttttttctttgtaaattattctgaacagagtaaatctgattgatgtggcatcaaaatatttttaaatgattccaaatagttttggcttttattaagaattttttaagatggaagaaaaggttggtgccttagctgatttatgctgtatattcagataataatatgaaatgtcgtcaatgtggggatttacccattaaccgcatatctaaagactaaggatccacaatttgtgaaacataacacagttttcttcttatgtaagtctcgtagcacagaatgtgatgtttcaaacagataattggatcatcctcgcttaaaggagatggtggtttgaaggtcactaacagcatcaaatcaggttgtttaatctatccagttgcagctggcaggtgcaaattgtctcccataaaaataaggtccacaatttcaagataaatttgtaaacttgatgcttatttagtaaaaatgagaaaaacatggcatttagtcttaaaagttaaaaagcagtgaataaaaatgactccaaagaataacctggagaagaatatttagaaataaatcacttttgcagttttgcacaattcaaattggaagggaggaaattcgtacttagaaataagatgattggaaactgtgaaagggttaggttgcaggacagcgaagataactgtaagctgggggcctttctaacatgaaacacgcagtttgtacacaataatgaggcatcgttctctacagaacccaacgaaagaataatacagctattattcatacacaagtattcatacatagcaatcaaatatatgaatgtggaattagaaaattttaagttattgacctgagatataataaaaaggatccatttgcatccagtggaatcaaaccaagcctgtgtagaataacttcatctggtgtaactgatgtgttgtcaaccatgaggactttctcaattttccgttgtaggaacattgtaatttaaaataatgaagtacatgtattggaatggaaccaccaaatacatgactcattagaacgcaacaaacagttttcaagatggtagtatggtacagatggcaacatgcgcatacctctggtacgaggattcttcataaggcattagttatcgatgcatcaacaccaatcatatcaaactccatattatcttcagtctttatacatataaaacagttaggccttgtgcacacaaatatagagtaataaatataaatgttgtttctaaagaataatctaaaaaattaacatcatcaatgtcttctaagtagcaaattttacctgtataaatagacaattatgagactaacagactcaaaaactgaatatactattctgtaaccaccaactgataagtaaacatccaaacaacctttatacttttcaaatagcacaactagataagcaaaatagattaaagacagggcaaataaaactgaataatgaaaatgaaaaccccttctttccaacactgtgagaattaatccatgagatgcaataaggtagaaagtgtcatgctgtattagagatcaggctccaccttcgcaacagcaacctatcagaagttcagaacacatgatttcttcaggaacaaaaatagaatttaacaaacaaaaattacctgcagaaacatgaatacaggcatagcatataggtgcatcattcgttatagattctacgtgttttctttcggtatttcagcttgatatatcatcggttgggagatgaggatttgtcccatagcctcgagtatttttatttatcttttcttgactaattggccatatacttattcgcagaggccgaagatgtaaatcatttttattatctaaaaaaaatataggtgtatcataatcacacacaaaaaaaaaaaaaggtgcgggagcagaagaaagagtagcacaacaaatggatacaggagttggggcatcagcctcgcagacggcacgcgcgatcgccggagctcaaggcagtcggggagcccgttgatctggtcatcttcttcgtcatcttccccttgccatcttgctcgcttcgtgctggtgctggtgctggtgctggtgctgctatgttgctgagtttgctcgcgccgcgtggggcgtggccgcatccaatccctctcaccaccccagaggacggattggttgcggcgctcgccggagggcatgggagggaggcggcgccggcggcggtgggcgagggagcgagtgactcactccggcgagtggacggagaaaggaggaagcagtcggcccattttagacaattgggcccaacccaacattggaacgctaccaatgggcccaatccaatacacccgcgttgggtatggcaacgctttggcccatctttatctgggctgctaccagtgtagcggcctaattgggtccgtttgtagttatgtatgggcctagattgctggcaaattgatccatttgttattttactccgattcaggattttgaacacaaacgatatagttatttgcaccttacaaatgtgtgcttgaacttctaatttgcagcctaagagttgatttaagaactattttcatttttgttaacaatgccttctaagtgtctgacatttagatgtgtttggcacaagccaactaaatggacagtttctagcatagcgtaaatagaaaatgtatccgtgttttcgtaaaacaataagtcaataagccaaccagtaccgtgtccccttgtgatttcaaaaatgggattctttttatcttatgttaccattgttcttactttttttttttgcgatttttgacgatcatacacatcgacttgtgtcagccagttgtcatgttaattctcttagacagtgcacgtctatcatgtatctcggcttttcccattgtgtaatctcagtacttgcctcatacacattggctcaccacatcacatcaatacttcatgcggtgtccatctatcatgtatctcacctttatcataggatggttcatattattgacgaaggctgacctcaaatctcataaatatcaatagactaaataattgtatcgggaatattttcttcatgacctgagccattttagtcaacataagtgcgcacacactactgtacaagaaaactgcagtttgcaacttcaaaactaacgaattccatcacaatttatcaaccatagtgggtgatggattagtagctagacaatgacaactatatatgcatcgcaaaccttttcctccatctggtcataaatatttgacattcacaataagatttagttaaaatttttaaattctaaccatcacttttttttagagtacttagattattttgtttcaaaaactcattttgagaaactattaatgatttgaattttaaaagtttgaccaaatcttaatctaaacgtcatttttttatgaccaaaggggctagttttgttcagttatttaaaattggtttttacatgttgcaacgcatagacattattgctagtaaagtattcaaatggtagatgtatatgatgttgatttataacaaaacattgggtgcaacttgtttacacttacgatacgttgtttctaatgctctattctactacttttgtcccgtaaaaaataaatttctaaggaactaaggatacattaggagaatagacaaattatcataataacctcatttaatgaacacagtgtatgcacacatttcatatataaacttgattaaaataaggttaaaacaatgagttagagatgggatggaaggaagagagattacaaggaaatatattttgatgtaatcaatttgttgggtcctatattaaatactccctccatttcagtttataaattgttttgactttggtcaaagttaaactgttctaggtttgattaagtttgtagaaaaaaatattaacatttttaacacaagacaaatatattatgacaatatatttaaatttacatataatgaaactaatttggtgctataaacattaatatatttgtctacaagcttggttaaatttggagtaatttaactttgacaaaagtcaaaatgatttataatatgaaacgggagtagaaatacaatttctacgagacaaatattcaaaggtagaagtttaatttttatgagggaggtagcaataattatgtttctgatatatttttctttaaaaaaaatgtttcaacagtatatcctttcttgttctaccgttcggttctgtttccgaaaaggaaaaaaaaagcaaaggaaatggtctgagcatttttctatccgttttcattcctagccctttagccataaatattaaatattaatatttagcacaagttttggtcattttttacaatatttatgactacgtagagtatactagcttgggagagactacaatcaagtaaacactgtaacatatcactgcatgcgatctccaagggaagcataataatcttagttagctgcgtgatgtgcatgctacaaaaactcgctagtcattacaatgacaagcattctcgcctgtatgcacaaaacagtatgcaacaacaaatgtaccgaacatataaaaatggccatggcaatggcatattggcatcagggatactctgtttgaattctgaagctagctttgtatgtttaaggctagaaccaaaaaacagcaaaattacatacgccgaatctgtaatcctatacaactcagcagcatttcttttcctctcaagtccaatgccgctatggctcagggcaaaaataatcaagaacagcctgaaattacctgcaatgtcacagctctcgtactactaagtggcggcggctgtggctagatcagcacttataaacagctctagccaaagaaagattttgcagccaggatagaaacagcatctagtgatctcttcctatgtctcatcataccctaacacggatgcgaaagaaggcgtccgatctggcatcaaggtcagccgactctcgctgagctgaatcttcggtatacaatgatcaccaggtctcatatctgtaactttgtgctggggggctcctggctgctgaagctgatgttccttggctgacctaagcacagtgagtcctcgcagttgttggtcgaaggggtgatgtccgtgcacgatgatttgctcggtgtgctgggactgccaatggtgtcactgctctctagtggactctttgaggatgggtatggcgcaacacttgacactctacatgataaacaaggcacatgtcaaaaatatgcacaagaccatagtaacagatttcagctgcaaagtaaaaccacaagacacacgatgacacgatttatacctttcctttcgcttctccaagaatcgggcgagagatgcttttcgagcttgaggcacagctggaacaagcaagaacatgaatcaatctcgaataccttatgaaacactacagtagttacgccgggaattcagaattccaaaaacattacagaactagcaacatgaaggtagagccatatacctcttggcatgatagccgaagcatttgtggttgctactggaatcggctgggacggggatgcctggctcaaaggagtaacagccaacggtaggcctccagatttcggccccgcagagtcgttggagctagaaaagctcttggggagagtcacagcttgcgacacgatggtgatcggattcgaaacccctgatacaagaggcacagaagcctctggtttctgaactacaatctgccttgcaggcaaagcctcgggcactgtaagtttcgcagcagcggaaataggcgaatctgatttacgagctgcactcggtggactcggaatggatgccctgcttgccaaaagcataagttcttgagcctgccacagttatgacacaatcaggaatcatacccccaagaactgaagtaacatcaaacagatttcgcgcgtcgcaaagatacgataccttctccaccggaatgttgtcgaacacattcaccaatccatcgtagaatatggtcatctgtgtcaccttcggattttgaaggtcccttttgcaagtcaacgatccaattgtcagctcaatgctttctcatttttttttcttagctttgcactcaaaattcagaaatgatttctattagagcagagtagagattatccaccttgggccgccgtagacgccgacggtggagccggccaccgagttgccgacggagaaggattggttcctgtaggggctcccgccggcgacgttggggaggctatgaacccggagcatggggttcgcgtggccgaacggcacggggtggcgcggcgacggcgacggcgacgggaaatggtgcggcgccgcgacgccgtaggagtccacgccctgctcccggtggccgtgctgcgccgcggcggcgtactgctgccggccgttgaatccaaactgccgctgcacacagctcagaccgttagaatctaccatgggagggacacgacgtgggcgacggggaggtcggaggcgaggcgaacctgcttcatggcggcagcgccgtcgaaggcgtcaccgggggacgggcgcggcggcgggcggaacccggagagggagaagcggtcgaacaccgccgcctccttggggtcctcctccctcgccgccgccgccgacgacctgaaggacatgaacgccgacgacgcggcgccgaccttggtcgccggaaactgccactgcatcgccgccgacgcgcctcctcctcctcctcgataatctgcatcacgagaaactacaaattcactcacaaatcacgacgcacagccaaaaaaaacacaacaatcgcagcacagatttacctacgcagaatcgaagaaaaaaaaggcgctaaatcacgcacaagaaaatcgtgccgatttgaacaagcaatttaaagccgtcaaaaaaattgaaaaaaaatgaaagcctcttttataactaaacaaaaacaaaaaggaaagctgcgaattgggcggccaatcgatgccatcccaaatccgcagctgcacgcattcatctctgctctggtggatcacatcacatgcccgaaatccgagctcgcatcgcacccacccaattaaaaacccgcatcgccatggccgcgagctaagccgctactactactactactagcaccaaccaaccaaccaaacgagttcatcatcaaagaagaacagtggagcaccgacctgaatgctcctccggcttgccggccgcctcctccttcctccaaatcgcgccaagaaaatccctctccatcccacgcgaaaaaacgcctcaagaacaagaaccaatccaagcaaaacttttatcccctcttcctcttcctctccttcttctccacgatgccttgacctttcttcgcgctgctgtgcttcgcttcgctttcctctctctctttctcttcgtttcgattcgattgctcgcttatttattcgcgagatttaggagggagccatgattagttagagataatttaatcattattgctcaccgcatttaattaattaattaattaaaaaaagaggatgggggtgtgggccccaccccgcccaccggctcctcctctcccgtcgtccccgtcccacgtggttcgcctccgcacacgcgaaccccccaccccccgcgccacgtaccccgcggtcaccgacaggtggggtcgggggatggtgggggccgcggtgtcagtgaggtggcaggggtctcggcgggggggcgttgtgccgcggattattatttaaagcctcgtgcgacgacgcctcggggggagtaagagcaaggataatagtatataataagattagctcttcttaaagccaacatagtatataataagattagctataaaattgactataattttcttctcctctctctatctctcacttatacatttaatgtatttgtcttggagattgtgttaagctagctcttacatgagagccaatccacttgatttttttgttacatctctccttcacgtaagtttacagtcaggttatagctcactattatacttgctctaaggtgggcccgaccacgtgcgcgacgcgggggcgacacgtgtccccaccagcgggggcgcgcacacacgagccgaattgcgatccaaacccgcgaggccccacggagtatgacgccggggcccacctggccaagcgggagggtggtgggtcccacgtggttcgtgtgcgggttcacgcaaacccatggtacggagtagtggtaaaaaaagattaaattgaatttttttaaaaaaaatgatagaaattgcgtcacgggggagtttggaattagcgatgtggttagtgtgctagtgggggtggcgttgagggttttttaaatttaaatgtttagtttcctttaattttttctattgtttttgaccctaccaccatgtgcgcatggctgattttaaattttggttgtgagttgctttcgtttttttccttctaagtgcagtattttatttttcttcttggtcggtccaggttgatttgggcagatttgtttattgccgtctgtaaaatgactgtaatgcccttgataagaaagagcatgcagcaagatactcctagtcctaggaccacttgacagaaatacaaaaccactgaccagtgactgagtttgagtttgtgactattcaattgtgaattgaagaatccatgtacgaatgcagtattgtatgcatataaatattatacttcctcctatcataaatacttagaatttaaaataagatttgattaaaagatttataaattttcaataggaaattttatatgaaaataagttcacgattttgtatagtgggcaattttatcatgatataagtacatttcgaagcaatgttttgctcttgcatgcaagaaattattgatgaacaaaactgtaacacttcagtttgatcaatatttgtctagaacaacaaatatttttgaccggatgaagcattgttttgatgttctgtacctaaagcaaaatcaaagataatttccaattgcagttataattaaaccacaaaattttccactcggtgacaagggtgaatatgaggctagtgaaagttgtgagagcgaacaatattgatgcggtggctcactagtcactactaggcttcattctaatttgcttgggatgatttaatgatttacaagaggatgaaaatccatacagagaataaggatagatgattgaccatattattgttgtggattatcgaccttattacaataataaattaaatattttttaaaaataaatttacaaataacgtagaacatgtattgtaatcaatgcagttgaagaaagtttttttgagaaaacgtattttcaaagaaagtttttggtgaaaacgtatttttaaagaggcaagaagcaaacaatctgagataataatttggtgaattatattaatccgagctagagtggtatggttccaatctattatattattaaaggaatagaaaaagaagcctccacgttcgctttcatggcctagaatttatcacattaatcggagaaaaagaaaaaatagagttcatataggaatacaatttaataatagctgaaattcggaattaaaagtatggaatataggaaggtaagactagagtctatatcgttatacaatagaactaatggaaattcggaattaaaaaataaaaaaaattaaatgtagaggttagagttcatataaaaatacaattagaaataaaaaaaattcaaaattaaaaatatattggatggagaatatagagtcaatatagaaatagaatttaaaaataattaaaattcagaattaaaaaaaatattgaaagataagtttagatcaacataaagaaatacagaaataatagaaattaggaattaaaataaggaatattagaagaagagtatagaatacatataagaatttaaaattcaaaataaaactaataaaattaaagtagaatttagagtacatatagaaatacaagttacaaataactaaaatttaaaggcatatttgaagttcgctctcataagacatgtaaaattatattgtcattttaatatatttgaataatacattgagaaaatatatatgctattataagagagaaaatataataatgctagccgcacaatctgcatgggccactatgctagttttcctaaattacagtggtacgtagccaatatcatgaatagtagtcgtatttatctaaaatagaatatttgtagtgacattgatgcaattaacctcatttttaaagtgagtttggcagtttgcatgactaacagtgtactggactcatttgcagcctatagctacacaagaaagctcgacacggctgcaacgagattaattaaaagttactagtcaccgggttgtttaatctctctattacgtttgataccgaaataatatcgtcagagatcttcaccgactacatgaaaaataattcagcagatctagtgcatgcctgccaaccactaccagtgtactgctcatctgcaatttttggcctattatatatgcatatatatttactcatacatatattgcgcgctatcaaggatgcgtataggcggatgtatatcagaatgaaatcatcttttggcttatacgacttatcagccaaaatttgaattctcaaacttaaatttaacgttgattttagggtttttccatcagagtttatttttacttttagatcgccaataacatgaatataaaagttttattcataaattattttttatttgtaaatataccgttttcgcttattccaatgggtccgatagtactccctctattccaaaattgatctacgtatttcataggtacatcaagaccaagaaaaactaataactctctcatactatatttactctagcaacaaactctatgcatgcaccatccctactattttctagccaatagcaaatcaagatattgcatgtgggttataaatacttgtgtgcatggatgcatgcatcaatgttcatttactccaatgcacaaataacgaatagacataatgaatgaatttataaatacttgtgtacatggatgcatgcatcaatgttcatttactccaatgcacaaataatgaatagacttaatgaatgaacacaaatatgtagatcatttaggaataacctaaaaaaaactacatgtagatcaatttagaatggagggagtatatgacacgcgtacacaacacaatacattaatactaatagtacaacatgatactccctctgggctgataatacttgtcgttttggacaaggatgaagtcaaactttagaatctttgattatgaatcatttttaaaatatttgtctttcaaatatggtgactatatgtgtatagattagtctttaaaaagtactttaataagatcatatatttgctaacaattttatacatattataatgaaaaataatggtcaaagttgttttttagagaccgtgtctttgtccaaaacgacaagtattatcaactggagggagcagtaacattggagtttcaatacgtacgcatgagagttcacgtgatactacactctcgatcatcatcacttcttaattaataattatattggtcaaaatagtggccgtagaaatgatacaaccaatgcatatgcatgtccggcaagcaacagcaggtagtatataacatttgttttacatatccatgtgcaaaacatcaatatggcagacacaatttttggtggaaaattatttccatatatattcagcaaattagtttgtcctggtttgttgcacaataggatcaattaattctgtggaatttggtttccaagttcgtttgtcaaactacattacaatagtcatatacttagaccagcgcaaaatcgaataaaacctcatttgtcaaaacatgtacagcagtcattaattttttcttaatatatatacttcatctgtccgaaaatgtaaaggattttgggtggattggacacatcccactagctgtccatattcatagtattaattaggatgcgtccttatcaaatatacatccgccaatttgtttcccaactctacatataccactaatttgggaaatcccttgtcctgaagacaagtggttctaatcccacatttgataaaaacaccaggtgagtgatataaaacaagacaatttcaatatgtaaataaaagcagatatcttcaaaattattactggtgcgataactatatttgctgggcaatttggctaagtcgtaatgacgatattgtatttggttaaaaaataacaacacaatctctctacatgcgacttcctcaggaacttattgggtccaccattggttattatatcatcatggcttgttgaacttttggaaatggggccatggaaatatttacatgccataacatgaatggagtttttgtaataggatttagtgcaaattgaatttattttcattaaaagtgttgccttctcataacaatctctatttttttttgctttattagatatatagcaagttgcagctgaaaccttgtaataagttttggccggatacatcctgatatatgacatattgattgacttactttatcgaagaaatatcttcttttacatttgtgtggaagtgaatatctatgtgtgtgataattaataagactgtcatcacataccaattactcatagggttaaggtttagggtttatgtcgaacgaattccaccaattgagtgtaaaacctggttaattaacttcgatccatgcagaaagcccaattaatatgacaatgattcataatgtatatattactattccagaattttaatatttaaaatcccctcaaaaaataattttaatatttgattgacatgtctgttactgaaccttgtaatttatatgtgttggcattctacaaagctggatggacgtctgtaagtcaagaaaatatttaattcacctcacatatgccaaatgtaattttgttggaaaataatagtaattgcaaatttcatggatgatttatgttgtgtagatcaaatatcgttaaaaacttatgtttaattatgatggtgcagcactttgatttatcatttatatatatatatatagaccttgtgttacatgagggtggtacatatatattgtggctacaagctaatttagccctggcctaacaagatagacttctgttttcggtgagccatttgcctttgattattttgatcattatttttcattggagatgatagctttcggttagtatatacaattgaatcatgcttgcatgatcgatcggtactaattaataaacacgcacctggggaagcattatatatatttggatgtatgctttggctgtcatggagttggaaagactctagatctgataatttatgtagtctatataaacaagtatataggcggttgagtctagaaataattcataaatatatgtatataccctctacgtaaaaaaaaactaatcctaactacgaatctagacatatgtgtatccaaattcgtagctagaatttattattattatttaagacatagtagtgctcgtatatgtgagcatgcgagatgaatgatagactaaattaattaatggataaaatttggctagctagctgggttcgcagagaatggacggatacagttatcacataggcacatatcattctattactctaatctatcgctaataattaattaaacagcttacattgtggtccaaaagggccaatttgtaatttaatcatgttttacataataaaaagcatctcttgaaagctacttttaatatttatatttgcactgcacgagctgcagtacgtaggggacaaattgacttccttttaaaaatctagtcgatcgatgatctagatctatgggaaaacggcttaattagtaattaatatttcttcaaaaatcgtctcacaaggtacagttaaattaaacatgcatgtggcaaatccatacatctcgtgaagcaataaactcgaaattggggatcacgtaccattagtcaacgtgcatatatcttgccctaactaatcttaattaatttaaaaatcacaggaatatattgaaaagctgaaagatatatatatgatttcttaacttgtttttgaaaatgaacgactcaattattcaaaacctaaaaaaacggttcgaaggacggttcttttcacaatataatatatcaaacgtaaaaataatattatcaaggagaccacaaattaataggatgtgatctggacgaattaatggagcagtatattttagttcgtgtgtaggagcacaatatagtacagctgcttagacaaatatctttcctgccttgaaaatacacatcaaccaacaaagttcttagcctgttatacaatattgtaacttgttcaaaaaaaatattgtaattaacatgcaaatgcacctgcagttttagttggtacctactacaattattttttcacttgacttttagggcattaaattaaggattgtatgtttgcaaaaacacttggaacataataatatagcatcatgagcctatatagtcttaaaaattgacttttggatcgaattaattgatgtgagatgcatatatatataaatctttcaatctcattgttcagcaaatatgctgagacaacttgcacagattaaagagacaccaccatttaatcttttgttagattgtactttgaatgccttgtgccaaaattaactgaaaaattagtctctgtcagaccattgatgcatgcaacacaccacacatggatataaccaagtaccatttcgacaagtggcactagctagcccctcgtgagtcggtacgtgtgattttctttgtttattatataagcgcaatgtcaacttaattgccattcgctgcaactcataagcacatgcttaggaggtaagaccaattcattgagatctgcaaaagaaattgctggatgataaaaaaagagaaacgaacgaacaaacaaacaaatttccttctattgaaaatcatgccatttgtatattattttgatgcttggatgagttgtgactcacacaattaatgtaactataataccctattatatttttcttatttaccacacatgtgctacattgtagataactacgtaccctccatctgaaaataagtacatttttatacactgacctaattcatgtataaaagtaaacttatgttgggatgggagaggtgtagataaagtaagggattgttcgtttgagctaacgatgggttatcgcgagcacgcttttcaagtttctacacggtattatctttgtaagaattttctttgtcatcatttctcgaataacttttttaaatcaaccttttaactttctaatatttaattcatccgtttgcacccttgactaattgtcatatactcagatttattcatgatccatcatccatcggcactttagaaataggctggcagagcataaatgaaaggagaagaaaacaaataaataatgtatctacggagcataaataaaaggagaaaagaagaaacaaatactagctggacaggtatggggagagtgatgatgtttcatactgatctatctatatatgcactgattgagtatggatttgatgttctaggcctagccatatgataataacttgacagctctatgtatatcaattgtgtgttcttgtctcatttgattctgtataaattaaggaatataatgaacagtgcagctagctagaaaacaatttgtaaatatcataatcaaatgatgttaattatatacagtgactgacgacccttcatgtgccgtggcacccacatttttgtcatagcaggaattaattaagatgttcaattagtcaaggataagagaaaagtaatatagcttgtgcaaattaaccagcgtgtgagagctagctgcagcaatactgaaatctctagcctttgtttggttcagtctggtttaattagcttgttttattgtgaagtttgtcagtaccggggagcaggaggtggtggtgttaactgttaagccttctgttagtcttagttaattcattttttttgaatgattgaccctgtccaacaaacatgaccatatatgctagctattgttccaaaaaaaaaaaacatgactagatgcatggcacactagctggaaaagatgcttgatctagaattaaaaaccaaatgcatggatctacattaatttagcatcatactgtgttcatgttgatgcccatcttttgcttgttatcctatatatttccgtaatgtctttttttaaaggattccgtaatgtctttatcaaataaacattataaggcatgtatgtatgatgggcgtatatatacttttttgcgagatgtctctttcatagagtggcattggatattttggcctaaaaggatttgtatataacaagaatgcactattacagaattgagtttcatgtacgagatctcctccaacttctaggtggactgtaatagcgtctgcatgtgataatcggttcctgggatgggttaagggctgcttgcaaaaatgtattttcgcaagtaggtccttagcaggcccggctgcgacaatggcaagcggacctcttaaagagacgcaggcatacaacaaagtggcgaatgcatcctcggtcccacccctaccctagcgcaccacccatccttatactctcctcactcactccgcaccattttctcttctctccaaccagcaggcctcatctctctctctctctccaccgtctcatcgcccagagttgagtgcgcggaagcggagcgcctccgcctccgtaccgttccagccatgtacccgcgcccaggcctcccagaggtgcggctccacctagcgtagtgcacggggagcccgtgtgaggcgagcaacatggagaggtggggaggcttgatccggctgtgggaaagccgcaggatcaagcagtggggaggctgaatctagtgacggggaagtcggatcgagtggtgggaaggtcgtaaatcgtggctaggaggctagaccaacccccataaggcagcgtgcggcggaaaggcttcccctgtcccccttcttcacgccggtggacatgggaggatcggctccagcttgggcaacctcgagagagttggatctggcacctcctctcctctgcctcttcattgtcgccgcgcgcttgggtctgcaccgccggcctcctctcctctgcctcttcgtcgtcaccgcgcgcactggatctacgccgtcggcctcctctcctctgcctcttcgtctccttcgtgcggcctcctcttctccatgcgaagagcttggcggagtggcgtatcctgcatggggaacctcggcggcagtggatccggcgctgggaccacaatgacaggatggatctggcggcgtggatgacctcagcgatggcggatctggcatgggagctacgacaatgtcggtggcagctgtgatgataacgttctcttggggagctagggtttccaccatccccgactctggtatataggggcagatccgtcgccccctgctccgggaggggcgttgattgctgcagcgaactcactgcggccataacgactaggttttggttttggggatttttattttttttgtgatttttcttttttgggtgggtagcattactgaccggccgcaaaaaattgagttttgcatgcgggtgtgccacccgcaagcaaaaatatcaatttttgcaagcatctccgagtagacgtgcaacccaaccgtatgggaaaatgagttttgacaacatggaaagaatttctatagtagggatcagataataaattagcaaatagacgaacaatagaatgagtgttttcaataaaaccttgttccgtttggattgataattaggaacatttaaggagatgtggaagaaaacagtaagcaaagattatttcaaggtggttctccagccagccattacctccttttacaaggaaattcaaaccaaattaaagatctctaggtattcaaacaacctaatatatatattacacacatgtttatccaaacaaattcactgcgattcctcgaacatatatgcaatgttgtatttgaaccacattttctccctatatagaagatatatacgaacacacatattacacctttaattaaaatgtatttttttagaaacaactaaaaataaacttattatatacacttaaatatttatttttatttatcacgaatcttgaggcaatatgacaggcatccggaccatacccccaaggtggtgtccggcgcactacaagatagtttcttttttctttttagaacttacaagagagtgttgatctgcagtctgcatgcacaggtagtgggagattgacgaagaaaaagtgtcatcttccttgtacaatggggccttcatttaatcactcgataattagtggagcattaactaattaaagaacagtgtggtggattgagatgaagtagctcttaattaatttgcagacaggtagcaagctaattaatttccacgatcgatcttatcgtggctccattaaattttgatcggaaagaggagctttttccaagctaagtgcctcaaagagaccgatgcatatggcaatcagttgccagtacatcatgatacatataatcatttgtttttgcaagcaataatatatcaatctatccaaattgtgttctgtccatcttgtacgatcaagtcatatatatgtattgtgcttaattactccctaataataatggacttatatgtactataggaaaatggcatttgtttctagatcaacatatatatagatattaaattatgacggacgtttttttattcaaaaatatgacatgcactatttatcatgtgatttcatataggagtgccaatcaattaacagcgttctttggttggacgattgatgtcatggccgtacgtaacggttagaagaattttagtcagaagtttatattgcaaaaaatatacacacactccataaagtgagaaggtcgatatcgggaagataagaccagggaaaccgaattaataagagaaaaaaatgtttctcgccttaaggttgatgccaaaaaaaaaagtcgctagcttatctgaaagcacgactgattcataataaagaagggtctaggtacatcctaatcctagtaaatcactaatcaacaactacaaaactagacataaccaacaataacatcctataatatgttttaccttttgatgaacaatttttttaacaatttttttaattttttttaacaataacatcatacaatcacttttgtcagttttttcaataaaatgacaaaactaccctcgtgtgttcttccattgcttctgttcagctatcatcaacatacacacacttacgcatgatggttccaccttgcagttgatttatcatttttgctaatccatccagaggatgtccccttgttcttaccgtcattaaaatagttatgaatttttaaaaaataaataacaagatagattaatattttatatatcggtacaaaaatttaaattcaaatttgatcttcacaaattgtaataaaaataacaaatttaattgaaattagtatacatctgctcatagacaaatgtgattttttttagaaaagaaaacttgtaaaagtgaaatttaaacttgcatatttgtggaatgatgcatcacacattattctatcttattaaaatttttattttttataattatttgcataacatggaaagaaataagtggacatcctttcaaggtattaatatgcaatgatatatcacacgttattctatcttattaaaatttttattttttataattatttggataacatggaaagaaataagtggacatcctctcaaggtattaaaatagtaatattatacttttgcatccctattacacaagatgatgatgtggatggcatataggggaagaaaaacatcaagcagtggcatataaaggattagcaacttttcgatggaatataaggaaactcgtgaattttgagtggcaaataagaaattctctattaattaggaacatataaaaagaagactcggttctcgctaaggaaaaaaaatgttatttcaggccaaacagtgcatacatcctgtaaacggagttgcagctagcatctgcacctataagcaaagccaaacaaatcgaagttgtctcaccaaagtgcatgcatgcatgtgatagctaatctaaccaagacacttttgcaaaagactaattagtaaagctactccagcatcatatacacacaagaaaaagaagatgcaaattgaaccaaacaaacaaataaataaatgtgaactcgttggttttctccacaaccctcaaagcaaaattaaaagctaggcagatcgtgacacagacccatatatattcttcccatgctaatctgtaccgtcttctctctctgctcttccttgtctgatcttcaaatggccaacaatgggcagacagacaagtgactagattgattgacaaacattagtacaataattaagggtgtggtatagtgctttacctgatcaccctttaatattgcatgtgtttttccatagatgcagcccaaagaggtcattgtcgattttgtcgccgtgatggctttcagaccaagcaagatttcgcaagttgtgatgtgaaagccggtaggccacaagtgatgatggtctagctcatctatgccggggagccacgctagtgatcagattctaatatctccggaaagttttatacgacataaggaggatcggaggtaactagttatagttctgcaggaaatattgccaatgcatttttggcaaaattgaagaaccaagaaccaaattaaatgtgtggtagtggagttacagtataggtaaattccagtgatcataaatattactcgcatttattaggtgtgtttcaatagaaatttggtaagcttaaatatttgttgtcgacttctctttgaccgtgttgtaaggaggtacacatggttgtgtgcatgtccatctactatgtaatcgtaaaaagaatggctcgcagtaaattgctcaggttttgctattatttgttttgcatattcgttcttaggcatgctttcatctttaatttatctacaccgcaaagtatgtaggaccggcttcataagatgtatggttgtggttaagatcaactagctagggcttgactggagagagagctagtgggtggtatagtggatttgtgccactggatggaagcatactcatacttgcctgtgtcctgtctagatgctctgaatgcacatgcaaagcaaagtgtaataccccgtatattaaaatattaaaagatatttaggttgttttagtttggattgatttgttaaaataaagatgttaaccgaaataaataaaaaaaatatctttagaagtgggccaacatgagaaggcccataaacccagcccattagttctcccctaaaacctagagagaggggaaccgaatcccacttcccctcatagtgccgccacccctctccctggccggcacctccttccttcccttctgctgtgttcgcatctctcccttctacagcaaattgctctctctatatctccgccttcatagcttggatcaagaagcaaagtagaaaaacgaaacgaggaggaggagagaagtaaaaggaggggttagatcggagtctcccctattgtctccttacaagttctctaaagaaaccctaggtgaggcttattcttttgttgtatcagttgttctagcatggctttagtgctttaattcgtggtcagggaaggctagagaaggagtttgggtagttgcggttcggtttgttgcagttctgcatgtgggcagatttacagtgcttcagttttttgatattttggggctctaaatgttattttctgcaaacgtgtataactaggaagttgtagataatgtttggatctatcttctaaccaaagggcgcgattttatctcaagtggtttaggagatataattttttttagtatgactgttgtttttatgtcataatctggatagtagtagattgaactgtttttggacgggttaaacagtacaatcagccaggtcacctatagacaaagttgtagaggtttttcttagctttccatattggtaaagtacaccctgattgggcgagtagaactctagttatagttgttttagtgcggaatctgaaattctggacagattctgaagcctgctttcaagcgcaaattagaccatttaaatggcagaataaaaatacgatttccacataagagttgtaggccttgttctgtagatttccaaaatgtatttattttcactcatagccttttcatatttcaagatataaaggtttgaagcagtagtcttgtgtatagtccaagcggtgttccttgttattgagttttgatgggatggggcagtaggttcacctttttcattgttttatatgcatgtttgaatgtgttttctgaggttttgtttataattaggtggtggtccatcagatcgtgcatgataccaatccttcgttggaggcaagtgcatgacgaactaattgtgtgattcatggattgtttactctatctatttatttctgatatatttctacgtgataagtaactgcttatgttcatattattgttcacgccatttagatttcaagttgatcttatgtgtacgatgttattcttgttttaatattctggattctggttctgcttaaataattcaagttccctgcttgtcatggatgtgcaatatggtttcaatttggttctttgattccggtttcaattattcaagtaccatgcgtagtcatgggagtgcaatttggttctttattcaagtttctgtgggtaagcgctgatcacgcttactcggctttgccggcaaatgctaggatatattcactattgtccgggatggaaactactattacaattcatgcctgcacgggatgggaactactatcttctttaacttggtgtttggaaatgtgtttcctatcaaagaaagaaagccttatgttcatgctttattgtcaatgatgtatatatgtattttctagttccatattgtacttgctgagtatttttatactcactcttgtattttatttggttttaggtacgtattgagaccgacatgcatgggcgggaagtagcacctttatatacacatttatctgcacactatcaaactatattgcctaggtccataatgatacttaaactatatcatgattcggtcttgtaataatcttttagatttctaatagtttcttccccatggattataaggatggatcgcactgtaggaatgatattattattagttcaatttataactgtttgtcgtgaatgtccatatttacaggggagactctgccgaaatttctaataattttgggagttagtggttttgagtgtattttagtgtggcactccaggtacgtggctacctggggcgttacacaaagtgatcttaagctcatcgtataagcatatatattcacgctataggaagaacccactcaacaatcttctgaaaaatggcccatatcagatttgttttttcaaccatatggaatcaaacccacataacttcaagagaggtaagtatgtactccacggtgactagacctatgagactgtttgctagaaatacatataactatttgaagtcgtaaggacatatacaatgggtacacggcttcatgctttactaaaggtaaaaggtcaaatgagcttggtgaactgacgcgaataaactagcaagttaagcctacaaacggtctaacgtagcgaaaataagtttttgatatgtttttcaaggataataatggtagcaggtattgaggtgtaagaggttagtggcaccaattttaaccttgatgctagctacagaaaataggaaactagtactgaggacttatccttgctagagtcgacactaagttgagcgctgctgatgaaacgatgggtttatgagagtttttttagctatattgaataagagggatgtttgaattaaaaggtagaattaatatgatatcaaagttatttataggaagaattaaattcttaatttcctttgtgctatcatagatcacgttgttttagtttttcttttattcgtagggaactcttcgttggattttccctttgccctcatcacctcatggggtataagaccgaacatctcatttcaatgtaattcaacaacatttggcatgaatgccataatcaacatatgatggctggaatttaacattagccgatccctatctacaaccttgacaactctcatggacataatcaacatatgatagttatgaactcactcatatctcctcaaggtttaattaagtctcacattctttcaacgcgtatgggagagaataagtctttatctctcaccctccacatttttttactatgtcgttaatgtagtgaaaagaaattcgaaaactgtatacttgactcaccactaaaaaaaccttgtatagaccagccttataggtgccggttcaggccttttcccatatccaggtgatgaaaaagatataaaaccaacacctttaaggacaataggtgtcggttctaaagaaaaaccggtaccaatacgatataggtgccggttttttaatagaaccgacacctatacttatattgtaggtgtcggttctaaaggaaaaactgacacctatagtataggtgctggttttttaatagaacagacacctataaaacgagccgagccgattgaatgtggcgccaccgacgaaaatatctgcgccaccgacgaaaataagtgtgcatcgcttctagtctcttctcccatcttctttcgtctctctcccatccttttctctcccgtgtccttttctctcccccattatcttctcttttcttctggatctggatctagtgacacggcgcatcctcccaacggtggcgcgcggaggatggcgggcggccggtcggcggatggcgcgtggaggacggtgggtggcctctccacggcggcgtgcggaggatgacgagcagccacgtcgaggggctcatgggtggccattcaacgggcgacctccccacggtggtgcacgaaggatggcgagtggccgtgtcgaggggctcaggggcggccggtcgtcgggcagcctcccgacggtggcgcgcggaggacggcgggcggcctccctatggtggcgtgtgaagaacggcgagtggccgcgtcgaggggcttaggggtggccgctcaataggcggccttcccacggtggcgcggaggactgcgagcagctgagtcgaggggctcaggggcagccggtcgatgtgcggtcgtatcgaggggtacggactccccacgacggcgtgcgccggtggactccccgtggcggcgctcggtgggaggcgagcggccgatcaacgggtggcctctcccgcgtctgtttgtgcttctctcccttcctccctctgtccgtgcttctctcccttcctccctctcggatccttcaagatttgttctttgatgttcttgaatctcaggtgtctatatgttgttgtttagatgatgaatgtgttcttgagatgctaccagggatgatggggagcggctgcatcgagctgaattttttttttttgattgtgggatgttataggtgccgatttctaaaccggcacctatcacttatcttcataggtgccgacctataggtgccagttggaaaaactggcatgtatggggggttttccaaccagcacctatagcattttctgtagcagtgacttctatgcggatatccttaaatttcaccataaataattcataactaccaggatctgagcgacattacaataaacattttctcctttgtcattttgacaattaagaatttgtcactgaacccacatataatgaatatatgaggatcagctataagtgataaatagttaaacgccacgccttaaaagtggtaaatagttaaatgtcccatttggaatagcaactgcggacaagagctaggcaatctgaaccacattcacgtgcatatgcatagccaacaggcagctagccgttcgtcaggtttgacaggcatgtgtccgaagaattctggacgagaggccaaggcacagagagagtgctgtgccactgtggcgtgggccccactccttgtatgggcccactgtcatcgtcctcctgatcgacctgataatatcgctgcttccacgtgatgcattgcacggtgggtgccctcatccaatcattctcgcattgtttcctacacgtttctctctgccctaatccaattatatgccagcttcttgttattaccttctcctccatattaaaaaagaaaataaatggataacaaaaggaaggggaaaaaagaaaaaaatatttgatgggcaattgggcattgcgtacagaaactgaagaatgattgattgatgagattgatatttacaaactaccaataattagaatttagtaggagtagttgcgtttatgtatattatgaccagattattgccgtggattatttgcttcatgcttctcaaaatacatttttttatataaaagaaatcttctatactgtattgtttagatcccaagctagtttggcgagcttattaatttttaatctacccctatataaacgagtttgaatcatccatttcattttgtacccgttcatcgctttagaacggatccgtcttgttccgaagaaaaatatgcaaaagtactgaaacaagagtgcaccttgtgaaagtgtcggtccagcactggagctcactataggtaggtagtgaagtggtaacaataaaattgaaaggtactaatctatatataattcgagtcaaagataagcattctcttccatgcatttatttatctatcctacttgaaagccgccaccacagccatggcaaattgcattggcaataaacaaagatctgcagctacactagcttatcaacctgtagcagttgaaaggcagtacgtatgcgtgtgtgactgtgaactgtatgatgggcaagactcgtgcaaatttattactcctccttttttaaaaaaataaatatatgaaaccgttaaattttaaatacttcccccgtgccataatataagggattttgactttttattacactgtttgaccattcatcttattcaaaaaattttggatttattatttactttatttgtgacttactttattatccaaagtactttaaacacaattttttgttttttatatttgcacaatttttttataagacgagtggtcaaacagtgcaagtaaaaaatcgaaatccttatattatgagacggagggagttacatttttaaccattcgtcttatttaaaaaattaatgtaaatatataagatataaatcatgcttaaagtacgttgagtgataaaacaactcatgaaaaataaattatagttacgtaaatttttttaagtaacaaaatagaggtagtactcatactaaacagtcggccttaagcaccatactttagcctaatcttgctatgctctcttttgcaaaagcaagcgtgaacaataacatacacgcacacgcacctgctatcactatcagcaatatatatttcagacaagttcacataccattctgtgataagtgataacctagctgagcatggatgaatcagctgggatggaagaacaatatataatgagcatgcttatcctcccaaggcagcaagaaagtataagaccatgttgagagcaagtttaatttcatagctaactgttgacttcaaatcatttataatcaatttaatagccaatttatacaatacttacctataaacatatattacacaattaatatttggtctcacctatcatacacacatgcatcttggagatcgtactgcagctgggtataaatctgtagcccgctgctcctctctctcatgttttatctcctcgaaatgtgtttatagctggcttatagtttgctactatacctactcttagcgagcttaaacttccaagaaagtaagaaattagtagtaaaaatttaaaaaggctattttttttcagcttctgtccttctgacttgtggtgtatgttttggattttacaaccaccgcttttcaaaatctaagtgaaaattctagattgcttagagaagctaagggttacgagagaaactatggctggcagaagcactttaaagtttaaacaaagcctaagtagcataaaaagagcagaagctaagctagtagctagcttaatctctcctgcaagacaggcacaagacactagttcaatcttcatcagaagaagaaaaaaaagaagcaaaaggcgggaggagcaaaagacatgcaggtacatgggtcaaaagcttcaggctgccagcactactacctcagaatactttgattgcacggattgatttgatctttacaatagacaatcataccatcacctgtacccagatccacaaggaacatgcctgaacaggaatgcagaagaaagaaagaaagcagcttgtgtgcaatgcaaatccaaagctgcttggatcgatcgatcgatcgcaccatgtatgtgaccatttcactctcatgcatatatgctactacagtagtactagcaaacaaagaactcgagagaaaatgaaatgtgatcctcctgctaaacccaattcatcccaatctctaaccaccacagtaatccttgtctgtgcaggtttcagacattcagtcacatgttggatcgatcagcagtgaaacaggtgtattgtagtaccactgatggtgaatgcagaacggcagaggtgcagaggtttttttcttgcctctttcagacgtagttgtcaggcaattgtcgagctgcagggcaaagataataagcaatcaatcggatctaatctcttcggaatggtgcagctgagctattgaattcagacaaactgaatcgcacagggggggtttaagattgttcaaactgaattgtgaagatagcactatcgaagagcccaatttccgaagcaagacagctaaaaagcagacgatgtgtactatataactgcagagcgacacaagtttggtgagcgctccaagcagaaactggcaaatgttgaacgaatatcaaacaataattaactgcaaacttggtattctgggaaattgcaatgatagagtattcacatagaaaaaggttccaagtcccaaaccagaccagaattcctgccatgtcctgatagcagactgtagacactatgttctagtatgatccagagttgaaatgccgagcacacgcatccttagataatagaaatgttttacatttcgggcctctgccttcaggtaccgggtcaggattgattgagcacacctacaaaagaagcatgattaatgagtaataccatatatgttcaacattccagtacttgtaatttggaatgtgtggtatgtagtatctctgaccattctaggtagagctgagtggactagaagttcaggaaaaaaatataaccttaaacaccaataaaaacatggagcaaaggtaaagatggttgtacataaactgctttggtgagctgcaagggtcgttctgatactctgatgtgtttcaaacatgaaacaaaagataatgtaatgaatcgtctgagattacagattccagggatcagaagggaaggcttcaccacactaagtagggcaaaaaccatactaagttgatactgttgtggtgtcacctaaccatatctgctctgattttagagctatgctgtgtggtctggtttaacagacaaaatacacaaggtgtgtttttgtgtaaaacagcaggcagcattcaaacaatgctagcggagcaggtgggcatggatgaggtttgtgctggaaaaagttgtgcagtgctcgttgcatttccaacacaaaacaaatactatatcataaaaatatttccgatgatagattcactttgagttttttgttgcaccacatgttactatgtttgtctataaggttaatcaaacttaaataaatttgagttacgaaaagcccaaaacgtcttataatatgaaaggtggggagtactactgaacgtgtatagaacctgtgtggcttcaattacggacttgcaatcgccagtattaacaacacagaatctcagttcaatgaaattgcatggccagtaaattaagagatgactggctgggatgggccggcgattctcagtagcgggctgacttctagttgggcctatatgggcttgtccgctcgtgagaatattgggccgactgagtgaccggccatacgcttgggctggaggaactgaagatttatagtgcagtaagttttttttttctttgagtaacaagtttatagggcagtattacttgcactgtgccaaaacttgcctttctttcggagattttctagaaaaaaaatattatgggtacagcataaaaactgcagagaaaacaccctttgtttcgaatatagtgattacctacgtttagaactgtacattgtcccgtgtaagatggaaactactccctccttctctaaatgtttgacgatgttgacttttttaaacatgtttgaccatttgccttattcaaaaaattttgtgaaatatgtaaaactatatgtatacataaaagtatatttaacaatgaatcaaatggtaggaaaagaattaatagttgcttaaaatatttgaataaaacgaacagtcaaacatgtttaaaaaaatcaacggcgtcaaacatttagagatggagggagcatatgtcagagactctcctctcttttccatctctctccaagctcgccgagcgtgaggtagagctcaacaaacacatcgtggacagcatggtggcggtcgacggcgagctcggtcaagcgcggtctcaccatgctcggaaacctctcatttataggtacggcccacgcctacgtcctctaacgtcgcaaatcctcacttgtgatatcatccaagggccattaatcaatcatctaagggatagagacaagatatatactggttgataccctgcattttgccgcggtacatgtggatgaatacatacatgtttaaataatgtgaaaataatatggagataatgatttgacattgattgcatattaagttctaaaaatacaacaaaattgtaaacgatatatcatatttgcatgatatttaaaatactctagataataattgctagtgggtaatgatgtggcacacttgcatatgatttaaaatactctagataataattgctagtggatgatgatgtggcacacttgcatgttgagatttagaagttagtagacatcaactttacagtaaaattgaatatgataagccaaaacggcctattaaggaatataaaataatttatagataaaacttgtatatatttgtttttaagtgacttaaaagctaatgcgtaaaaagaaactacgttgaaaatatcttaaaataaacttcaaaattaagtttaaaagttcaagttttgtcttttgctttagcttattaggcgaaccgatgggacctgaatcctctagtgacctaagtgcagggagcaaacactatattacagagtgaaaatatagagcacacacatctttagaagctgttctccatttcatagacatggatcctctgcaatactacgcctgcagtcccagtgactgacagatggatccagtcctacatgttattgttacagataatctctacagatttctattatctaaggatgtggacatatctattggtcttgaaattacctgagtgcagagtgcaaaccctgaaatgttcccaacatctctcttagaattgagtggaccgagaaagtgagaggttgagtaacatgaaaccttaaacagcaagaactacatgagaagtaccaacaaggcaaccacagtaatacaaaaaccgctttggtgagatgcaagcatgcaacctgcaagggtctgatgcatgtgtttcgaacattggaaaaagaaagagaaaaataaaatcattgcaaatgtaataaataagctgagatttttgcaaattcgtgagatgagacttccctaattttgtagttcattcgcgtgggccgttttattggaatgaatccagcccaaaaccaacaacatcctgttgggcaggcccggcccaccgatgtcatccctcagagacggactacattctggctgggcctatatggactttcgagaatgttgggctgtccgagtgagcttgggctgaaacagctcgagacaatgtagcatagctctctctctctctctctctctctctctctctctctctctgttcttctctctttttggcgaaaccatagatttttcattctgcttacagtgccaagacttgccttcatttcgtactcgaaggtaccgcgagatgttaaaagtatttttctttttgagaattacacgatgttaaaagtatttaaccatgtgataatttgaagtaggagtagtagattaactctcggcgtcaaaactgtaaagagaacgatctttgtttcggctgtacttgcggaatactccctcaatcccataaaaaaaacctaaaacagaaaatgatatattctaatattacatacaaataggatatgccagattttgtcatatatttgttttgtatggaacggagggattacctaggttgttttacagctatcaaaaccctaaattgtcaggcaaaagaaaatctggtcaaatgaaaggcatcattgatctgaaataatagaagaggattgcatattgtacagcgaaacggatcctcttacgctaaaacaagcatcattttacagctacaccggccatttgtttactaggagctacagctgtgccatactgtaaagtaaagacccccaagcctcttttgttgactagagtaaacaaacaaatgcactggacggctggaacatgcatgggttgttgttgatcgatcggcaacacacgtggcaaggtttagggaaactccatcctctattaataatcgctcactcggaggagaaagagtaacatcaacgctaagagcacgtacaatagcaggctataaatcagctgtaaacatattttaataaaataaataaggagagagaagagcagcggctacagatctatagccagctataacacggactccaagacatagtgtgtgtataacaggtgagactatatattaatagtatagtaagcaactattgtatgaattgaagctagtggtggactatcctattaaacttgctctaatctatcaaataagcatcaccaatttggcatcattttttgttaagtagcgtccttttgaatccatcgagaccatccaatcacatctacaattcgttatctttggtcacatataccttctttggccttgataatcacctgtactagtagctcgcgaccagtaaaagcgttttaggtcactgatagagtgaagattctacggacggacattatgccagtgtagtaattaagtgagctaaacaagttaaaaactaatttacagagtactgtgttctaaaattgacttctcactacttaagtatagaagtcgcgcttgacttacgatgtcctaagcacaaatcgcgttttgaagtttgaaccatcggactataaaatcatcagcttagaggcgccttaggactggttcactttcttagcattttcatctttttcaaagttgaaaataaaatttggtaaggcaacccattaccaacccaaacgtcccaacttttggtaattctacaactttctactctcaaaactaccacccaaattctaccaatattttggcatggtagcaaaccaaacaaaccctactttcaaatctaactttttttgaaacacaaacaactttattaagcaagaacagatattaggggataaaccccggtacacaacaacggatagaagttaaaagcagagacaatcctgaagaaagagggttaaccgaactatggaaacaaccttccagatgaaaccgaacagcagaaaaaggagcaagccgacagagagctgcggtggagccgtgacgactgcagagccacaacgtcttaaaaccgtgacgactgctaccttgggcctcagttgaagtgcacaccacttgacaaaccgttaatccccttcggttgcctccacgggaacggcacaagatcgaggttggttgttgagccgtagatttttggtgtgagcgtcaccggactcagcaaaacatccccataggattcgtcattgaatctgaggaattctaacaaccctgacaatcgaaattgcacagggggtccgagctcaacccgaatgacaaaccatgtgcggcttctgctactaggaatcaaaagagagggccaaaacgtagaccagccaaccaacaacaatggggcttttgagaggctgccaatagacttctgtcttgctttgaggcctgagatggctaaggagagggcgacctgcaacatggaaccataagattttgagcagaacaaacacccaatcacaaggcttccaaaggcttcggcttgaaggaggatgtagatgacgacgagccaaccgctgccgccaacagaggaagaagctgcaccaacagtggcaccggctagcacacagcaagcgactggagttcagggggcgacaactgccacaccgccgatcatagcacacatgccgacgcctgccggcgccacagctagcataggtgcgacagagggaaacaacgccaccgctagctcgggcacggcgaagggggacgacagacgtcgtaacgccgaggacagcgcagagaccgtcgccacctcaacgacgaccaccgaagtgccaggcgcgacgcagactccgtctccaccaccaacacaaacccgcacacgagcagggtgtcggcaaccactgccagaagctcctcctccaccaccaccaaggccatccagatccggaaactctatcttactttggggctcttgctcggggatgatttgaccgccatgtcttcgattcgccgtccacgaggcgcagaggtaccaactcccaccaccgccgctaacgagaacaccggtcgccaccattagaggccagactaactagagaaacagaaccaacctgactaaagagtactaggggaaggtggccggacccctcctccaaccctcgccgacagcgaaccgctgaaatcgaaggggaagaggggctggaggggagagaaatcagagaggttactgtagaggaaaggggaacgagaggggaatgcttcaaatgtaactctttggtaacactaaattttggtaaggtaagcaatgaagtgaacatgcccttagacttgtgaatcaacttgccaaactctagttataagtatatagcagaagcccattaccattaccatttgtatttactctgaaataacaaaatttatttccctacggcccagcgttgaagagactaacagaaccttaacctcgaacagcttgactaacataaactcctacgaaaacgtggctaatagagagcccttgcaagtactacagtgcattctattagggctcctttcatagaatttcatagaacttccatgaaacaactaggactttcatagatttttcagatattttttttcaattcttgtgaaattcctcctctctgaaagaggccctcggtatgcagcactaccatcgtgtatagagtgctatgtatatgcgcacaaactacaagatgatcctacattggcatcggcataaacaagctgcagaccaaaaaaagaaaaattccaccaaggttcctgcttggttatcacgcggacgcggttgtaacaattatcacgtacggtaaccttctcaacttttaaaaccagaccacgatgtgaggtaatcttctcaacttttaaaaccagaccacgatataactcacagtaaccacacggttttttaaaaccagaccacgatataactcacagtaaccacacggttttcgcagtaaaggcaaagttacaacggtaacagctaaaccgtgaagtaacgataatcctatcccaaacggtttgataaacccagattctaactactaatacctcacagaagtgagaaagcaaaaaaaaacaaaaacaaaaactcctatacgcaaatgcaacagaggcacacagctggcagcacaccagtacagtacagtagaatgaatggatgtgtgcaatgcaatgcaacactacgggcagctacacgacaaaacatccaaagtactatcacagccacaaccaccaccactctctcactgtccactccactccactggataagcatggtcaaaccagctgcagctgaatgattagcacgccatcaacacagcagttagcatgctaagcaccgtcattatcagcatcagaaacggtcaaaacactcgaggcaaatcaaatcagcatcccttggaaacaaatcaccatccattaattgtacacatcatcatccacattagcttagcttaattaatccactcagcagcatcagcaggagcaggaggagaagcctagctcagccttaatcttacaacaacaacacataagcagcagcagcaacatgattaagcctaattacccgattaattgtactaagagcacaacaattagaggaaattaaaggaagcgaagcctaagagagattaagattaagaagaagtaattaacaaaccccatctcgccccccccccccccaattcgatgccactacgccctaaccctaaccctagagattggggttggtcaggccgccgccgcctcgctggggacggcggggcgtaccttgggtggccggccgcggccgcgcttgacgggagcggagccgtcgccggcggcgggaggaggggcgggagccgtcttggccttcttgggcgggcggccgcgggacttggggatggcgtcggagatggggtccttggacttgggcgggcggccgcgggggcgcggcgaggagggcttgggcggcggcggcggcgcgttggggtcccgcggcttgggggggcggccccggccgcgcttgggcggcgcgtcgggcgcgtcggcgcggaagtagttgttcttgaggaagatgagctcaccggactccttcatcctggccaggtgcgccgtgagcagcgacgcgtgcgccggcggcaggtccccgtacttcccctcgatgaacttggagatcgccgacttgttcgacccgctcttctcgttcagcccctcgatcgccgccagtatcatctgcacaccacaaatcccaaatcaacccccaagaaccaacccaaacaaagagaaaacaagaaattcacctccgggtagggcgggagaggcggcggcttggaggcttcgtcggcggcggccatggcggaggaggaggagggggtgggggagatggggatggggaattttcgctcacgaagaggaggatatatgaagaagagagagatggatttggatcaggaatagataagaaaatatggaggaggaaggaaggaagaggagatggatgggctcgccttctttatttcttttttttttctctccatttttttttattgttaagctcggctgtgtcacctgtgtgagaggggaagtgagaagatgaggatggacggctgggatgagtcgatccgccgccatcggacggcgcggggagggatgggtcacgcggatcggtgacgtggcaggggtaggggtaggggaggggagaacgcgcgcgctcgagagctttatgttttgtttgcttttgcctcccgtcccgacccgacccgcgggtgccttttttgggggagctgtggaatgacggtattgccctccgtggtggcctcttttttttggttttttctgtggaggtgggcggtggtcaggcctgtgatttggctgcatggacaaagcggaaatgccctccctcccctgagttgtgtgtgtttatatcgttattattgctaatattgttacatgcacagctgaggatgtacaacggtatagtgtggctggaaatacacctgttttggttgtaatgtggtatgcatgtaattggtttaagatgatttaggttttgtctgatctgtttgttattgaagtttaaattacaggtaaatcgtaatgtagaaatagtagaaaagttgttacttccgaaaagtccggcgctgaatagtgcaactgaatttcaagtctacgcaacggttgcctggatttgcggatttaggtgaaatatagttgacctctttcataacgtgttgtgaatttgtgctttacttaggtgagcggaaataaaatcaagtttttaatttagattcaaaatagagtttcacggaatgttcagtggatagacatgtatgcttgctagtattgctatgcatatggttgatgaatagggtatagtgctactataagttatcgtgttttcattagttgtaatatggtgagtgtataattggtaagataagacattctaagtaaaaggcaacgaagaaatatatttggttttttttaggcagatgtgattattatggttacatataatgaacactttaaaaaggaaagttttaactttcaaaatattaagcgaatattaatgtaactaaatttcaaataaataaatggtcactcgggcttatgaaacatgtgatctaataaaccactttttatatcttagctactttaaaagcgcaattgtcttcatccatccttcccaaaaacaaaatcctgctatgtcgatcccctagcttccaataaaagctccaaagacccagcccatcatgaaaaccggcatagaaagaaactaaatcataactttatctcccaatcctattggaacagatgggaatgtaattagttgaattgtaaaattatacctaaatatttttctgcaactgaattaacctttgaacaaatatgatgccatgatcgtgaactcttttggaacaaagagaactacggaaattgtggaggatttgattcatatggaaaaatttctatgtagtcttttggaataaaggaatagctctctcagattattttgaaattcagtaatggactattttcataggaatttggagggcaatctagcataaggttctaccgcatgtttatctcttccatggcacagccacaaggttcctctgttttttctatgtaccatccaaaacaataatttttgaacttccacgtgttcttaattcctatagaaaatcaatgggcatgacactcttcctacgtttttcctattcttatgttttcacaagtatagtggcatttacaaatttgccactggattttcttattttgtaagaatactatttgaatgatagttctgttggtagttttttttcttttcaattttatagtgggaattttgccataacgatttagaacggggtaaattcgcaattgctcctatttatcatggttctttttagtatgaggtagtatttgtatagctagagaacatgagtacagagtaacaatttagatagattaagacaagtaacaaaatttcttaagtaaaattcgtataattttttttaacaagaatttaggttttctcaacttttgttttgatgcactctacctcccataccttaaaagtgagatcatgtgcgcattgcaattgcatgtacatggccaacaaaaacagctactagagttaagcagattagtagctcgacatgtacagttgtgtggaccgtatgaactagccggcactataaaaaaagctcaccgataacgaaagatacaaaattttcgattgggataatagaggcatcttccttttaatttaaaataccaagcgggaagtttacttgcttgagcgcatgggtaaaatcgtctttttggcgcttcgccatcgagtagtagtatagcttagctgccagctaagcccacagcttcgaaatttttgaaattggagcgtgcgctgcgctgggccgagccaagagtgcgtgaagaagaagacgaggaaaaaaaaaagaaaaaaaatattatatatatatagtactcgttttgttttttcccaattcagtttgagctcggagtactaatgctggccgcatttgcttcgcgcgaacgccacctgtcaccaggacacccgaaaagctactcgtacggcaacgcatctcctccctgcgccagtggggcccgcatgtcggtgagagtaagagtagtcgggtgcgcacgcgccgtgtacgcataataataggtgtagccttgcagccgtttacaccgggagcacggctcgccccggctggcgcatcggtcgctgacaggtggggccgggtgcgcctggggcccacctgtcggtgagggatggatgagagggtgtgtgtgcaccgtggagagtgggatttgcattgctgatgaactgctttttgggaacggggtatttaaagcactctcctccctcttccacctcggtgactgactggtccccccacacttctttttattactgtagtaataaagagtatgctagtactgtcactttgtgcacacaccccctctagagtttgtatatgggttaatttgatccatcctattataaaagtgtgattttagataagtatcactaatgttcgtttccatactattcgtaatcatgccacccgaatacgaaaatatttggttcacaagctcggtttgacttggttttgtttgctctgaattttgtattttttatatggtcaaaattgtccttgcatgccaaagacttgactcattcctcttttggacccgaaaccctagccatcgtcgacggcaagcggtggcggtgcttgaaggcggataatagccaacacgaatattaccttccaatcttgactttaatctataaaaattatgtagcttatccaatctacaccaccagattggatttttttcttcaccttcttaaattttaaccgaaatacatttttttacatagtatggctctgtttgaattttataaagatgaagatgaagatgaagattaagtgttttacgtaaaacgaggtggtaataacttgtgattaattgagttttaattattacaaacttgaaaaataaattaatctgatattttagaacaactttcatatagaaaattttcacacgaaatatacagtttttgtgcagtttgaaaagcgtgccatgaaaatctaaaacttaatctcgcctctgttaggttcttgaacatgacctataacttatttagctactatataattagaatgacaaaatgcttatacaaatcgaaagtatgttgacatgcttaaaacctaaatgtgtatagaaaaaaaatgttcagaataattaaatcgcacccacctactaacttcttgcaatagcatgcttacttttttatgttcttacactaaatttcactcacatatatgccaaattgatgtattgtgctctattaaaattatcaattgtttgtggattttttttctttagatcatataatcacatgatgagacgagcatgccttgccctcctaaagacctcttttgtaggctcatccacaagaaaagccaattatgcaaaggcatccaaccgcacttgttcaacttttcctttatgggctgcacaaaaactggccactagaaagtgcaacgtccaggttaacaaaataatttgaaagcaaaaggtccaatttattctggctatgtgttggaccaatttcaagttgacagtcacagttccaaaacgagctcattaaatgaaattattaaaaattccaagcctacaaccaaaaaggcattatgcatgagagtatggaccagtttagatcctcggtaaaattcttcaccctgacagagcaaggctaataatacagccaatctgttggctataaggttatttatagccttctcttagtctacccatataatagttagctctttacaattaatatagggcccacttgtctctctcacagagtttcttggttcttgtgtgcaagccggctgtaagtttatagcccgcttctcctctctcttctctcttttctcctccacctcaacatttagcctgcttatagcctactattatacttgctctcacatcgaatatttggacacatacgtagagtattaaatataaacgaaaaaaataactaattacacagattgcgtgtaaattgcgagatgaatttttttaaacctaattgctccatgattcgacaatgtggtgctatagtaaacatttgctaatgatagattaattaggcttaataaattcatctcgcagtttacaggcggaatctgtaatttatttttttattattttgcgtttaatacttaaaatatgtgtgtccgtatatccgatgtgacacgccaaaactttacacccataaatctaaacacccctatatccaacaatctttctaaatctgactctctgagtatctatttagtcagcttgccaaacaaattagagagctaaatttgtctttttcactccagtaatctctctaatctgatggtggatcccacatgtcaatctatatactgttagcctaaaaaaaacaaatattaattgttacacaaacatttgctcgatatagatctcattgtgacacaatcaaccaaactaagagactacccaccttgtttatgaaattcatagattcagccaaaatgatgttggggagaggagacaatgacacttacaaagacaacacaaaaataccacatgaaattcatatagtttaattgttgttatatatgtatgctagctctctatatattggttgttgttgtgcactcggtggatagatggatggtggatttttatagaaggaatgggaaggtctaggtttaggggttgtggtttttttttgtaccgacactaccgtgatattttctcttcgtttggagcagccgatcgaaggtgagagaggctttgacttgtggatgcagctagctagctaaaccaacctccggagcacgtgatcacgctgcacccatgcaacaacatgtaccaaacccctcatctagtcactgacagcctgaccccacctctcataggcacgcatagcaatcctttcttgcagtagattgagtaacctctacaagcatgtcatccaacctttctgtttggtataacaaaaacttgcttggcttgatatatttacttggcttcattgtaggttttttttatataggtgttctttagttttgtgttttgcttttctttaataattttataggaggaactgtggtattgactaggattcttgtggtgaaacatgcatagttatttagatttgggtcctaaacctggcatggatgcttgcattatacttgttattgtatcccgatttatagcaaggactaagtgtcatatctcttattcaaccaatacgccacctctagtattttcctaaagcatgttttaaatggaggtaaatacttcttgagttcctaacatgtaactagaagaagatcgaactatccgagcaagaacacattggttggatgagtagtattcgagcgtgctacgggaggtaaatggtacaaggagaatgaaacagaagcttttcaagcactgttaccaagcttttggcaggtaaaaacataagcttttatgctaccaagcaggaatattcgcacaaaaagatgtcgggatatcactccaacttcacttgcaagttggcgctagtggtcctaggaatcgtccgaacgtatggatacacccttagggttctaagcttttgaagggcattattgtaacttcatgtgtacctcctaaggctatataagctgacccaatcctagcgaactaaaatacatttttactggtacaatgacgacaagtgttttattgacacatcttgatttcacttcaccttaaggctagacgggaagagaagtactttcctgcctatccccaatttcttcatgaccaatatgcatgcctagtttacataaggttaggccccaactaatattatttagctatgtaatgggatagacatgctatgtgagatttgatctccaatcctgtataaatttgttagggtacatctatatgagtgtgagggcgtgcatgtggtatatgcatatgaaatttgcttaaaaaccctttatgggatttttatcagtccaaccgaaatgttaagctatagttgaagcttaagctaaatcttaagctaattaagggattataaagcaacttcttaccttcggaaacacattgagttctatacgtagcaatcaattgaatcttagttgatgaagaaagatgtgtatgacatacttcaacacaacatgatcttaatcgcgaagattattaaatatgctagcttcaattaatccagcccacaatttttagcgagctaaacctcaattaattaaggccccatcaggaacaggaaatttataggatcactgtatgaatagccaggaagattccacatgagattctcaccaaaatctttgtcgaattccttaagtacgttgcaaaatggggcttagtggaactgcttatcaaacagaaacaagggttggtgtttgtatggaatcagatttgtctgcatcgttcaataaattccggtgactatgcgcaagtgaattgccacagaacagcaagctgacgtcttcgtagtatatttatttggaatcgcagatgttaactatctttctaaaactttgttaaagttagagaagtttgacctacgacaaaactaaaaccaccttacattctggaacttgtaaaccaccttacatactagaacttctgaaacagagggactgagggagtagctgacacaagaatgggcaaaccaacccctggtctgtaccaagctttccatgcaggaaatgggtaggtttgtgtttgctgccgctttgccatcagtctcaaagttgaagtaggtatgacatgcccccggaccggcaattcaaagcacctgttcatctaaccatatgatgtttcagtaccacagttcatagggtagttaaagtgacctttctcctgatatgacagacactaatagtagtaagcctcttcaggatacttaggccattcacaatacgcctccgtggcgttcagcctcagcttgagaaacagcatattctataccacgtcgatcgcgttcggagccttattaggaacgcgtagcaaattttggtcacccgttcttcccactaaaagcctgaaaatgctggcgcagtgacagggaagaggggggagagtgtgaaaactgcccgctccgctggcgccgtcgccatcctcctcgccgcaccgccgagcttgtcgccgtcctctccgcaccgccgagctcgtcgctgtctgcgccgccgagctcatcgtcctcctctccaccgtcgctcttcctcgtcctcggagagaggagcgccggagaggggagaggagcgtcggacaccaccgctctgccgccgctccggtcgccgcctcgctttgttcggccggtggagaagggatagagcagagagagagaggagagaaaaagtgagggtaggtatatgcactgtggaacatgtagctaacaatgttcctaggtgttcttgagctgagttgtatatttgcaatgcattgctaatgcccttacgatgcagtcaccaaagaaagaattaatgtatataataatatagtaacctcaatttgcagagttgaagtgtcctttacaaggtaggagtagcatcattatacaggccagatagcttcaaaagaatcaatctttctgacagatttttcatgttaactatgtgggtcataatgtacatggatcaggcctctccttgtctgtggctggacactgcaaataaccatgcttggtgtccatgggggagaggttatccttcctatctactattgactgactacaacctgatacaagttgggtacaaaatgaatcgacgactaacctcgtgatagggacagagaaaaaatgggttatgaatctttacttgaaaactattgtggtggcgatgcttctgaattctgatcgctggtggttacattgaaaaaaatcaacaaggttagctgctgcctgtcaagaggaccactgatcggggacggtgaggaagtactttgacatggctttcctgaacctcttcttgtactgcatcggagatatgacggtcggggactcgttcttggggcctcccaggatgcctgaagctttcacccaggtctcgagctgcttgtcccaggtgtactggcgcaagtagtcaataatgccaatgacaagctctttcttctcctcgtcgattccaacaagtagtgagtaatccatgacatccgctgtctgcaaagtatttcaaatgattaacagtcattttcagtaatataaaatgcaccaattcatgaagttgtgcagttttacaagaaataagtattttgtgcaatcccttgtctgaaataagaatatatatatgagatgaattatcaagattaatttccataacaacataccgcaagaaaagaagtgtcattccaaacggctctttccaatcttcgttttgccttgctccctaaaaatattggctttgtatgcaatgcctctaggaggtttgaatccaagaggactttactctcactggatgtatagcgtgagcgcaatgaaccctttagatcatagactctagatatcttcctttcaaagaaaagattctccatcaccatgaggtccatctttacttccctaccaccttttaagcccttgatattaacctgaactcaagaaaaggcagcagaagttagaaccaggggaatactctatacacttcattcatcatcagataaatcatgcaacaagaagaaaacaaacctgatatactcctacgattttggccaggcaagttggactacctgaagtcagggattccatcaaatatctgaagtactgaggagcaaactctacaaacgattcaagctctgtcctggtgacttgtttgattatgaatctctcatcaagagtctttgcaaagtaaacattgctttttccaccttgcgcattccatctcttgcagcggctaagtgaacggatgaaatcaatatcctttgggcagcatttcttcctaagtgcggcaaaatgctttgcgaaataacaagtaatggaaaactttgctttatcttcagaaagtggcgattcatcatcaaaagaaaacttaaagtgagttcccttagaatccaaatggtcttcttgtgagagcaaggtcccgtcaagtccatggctgctgtcaatggcatttggtaggtgtaagaaactcaaacttgaattcagtttgcgtgtgacttgctgcacatattcttgtgaagtcattgcataggacacgatactggtaggctcatcatcatagactgcaatgacagcatcatcttcatacccaatctgaggcaacagcagccgtgccccatcatcgatcatatgtgaagcagatgagatatatgtaagtgtacgggtaagaacaacatttaatttctctactgcaccaggagacctttgagaacaagccctccgtatgtttggcattggatctttcaggatactagtaaaatccccaaagtattcagcagatctgaatgacgacagatgcaatgaagtaggagccaatccattgcgttctcgctggtgtatagcaaatttagaatcaaatgaatgaattctgacaggggttacagaattcccatagcttggattgtctgggaaattaaacgatccatactcatcaattttggtaaaaccttgtagaaggtcatcttgtatctcactagatccagtccatgccaaatcaatcttatctgaaaaaatagatgcaagtgagggtaacctttcaacaggttccttacccattgtagctgtagtaactggctgctctgtctctccattgaatctgcggaaaaccttgtccagatcttctgcatcatccacaggatgagttacaagatcaatctgtgaatttgtctcacccatcctgtattccgtatcattcaagcagccttctctagatagcaaggattttcttggacttcctgaagattgcgacaaatttgtggattttcctatttttgtatcccccacaagcaggtcagctttccactctttcagtctgacatctaagaaaatatcaggatttgaaacatgactgtcttttttaaggagtgaatctatgtaacaaagccttcgatcccaaatgtaagcatcaaggagaagaccgcgtctcaagcggttgagctcaagaacatcaatagagacctgcacagaatgattgctatctgtaataactggcaacagcaggatctgcaaaacaaacaaagaaagagacagggggtcaatattaagataacataaccttttgtttaacctgaacgcatacaaccaggaaaatctcgttgcactacctcatatccatttctttccattttaagcaaatctttcatctctatgatctgcctttgaacacctgctttcaccggctcatcctctgatgtaacactattttcattatgatgaagaaaatcatatacctctgaatgtaaggtctccattttgctatatatctgcaaaagccaaaagtcaagtatatgagtatcatattattagtaagttcacagcaaaactatatgatgcagtctatgaacatggtcatcataacttagaaaaattgcatacctcaactgccatccttctcatccaatcttgtcgactgcggcaattgaaatccagtactgaggggggtaggttaactgagagaatatcaacaggagaatatctgaagaaagcaaccatgtttccgtacctggatatttagcagataaattgaaatcacattgaaggattgagcaatgttaattggtgaaggatacagcagatacatacccatagaaacgaaggcagtctctctggagagaatgtccacaacttgcaactcggttagcagtagtatggtttgaaaagcttagctccaagaacttcccaaacgacagaccccaagctgcatctgacataattaccctccgtgtggcaggtggtacaccatccttaggttcgcacttgaggcatctatgccacatccatatcctaccatcacgttcacctggtaacttttgagacagaagccgccgaacactaattgttaaactcccatgctgatgagtatagcacctgacatgtgattctgatgactctttgcatgacgggcagcaatatgcctttgcatgaaaaaaaacatttccaaaaattatgataatgataagaaggccatatgatagtgcacatacggattgtacaggaaatacctgatcaaataagtcttccctgaggtacctcccaagtggcttatcaaagctaccataaaacttgatgcggaagagctgagaacgctcgcatagcatgcttttggggatacaagtgcttgaaagggaaactaagatgctctgatggttgtcagtagcaggaaaatattcaccagaaagctcattcgggccatctgcatctcccatcaaataatcatcatgtggtttgggaccatagtggtctacctcttgaaatttctttcctgaaaccatgccttgacggtcatcatttatgggaagttgtgtcgagtcattcaaatactgatattgcatcaccatatctgaagttctaatgtcatgatccaatgaacatggaaatattttatgacctttgcatgattcagttgcatggaatgaatcatgatcatgacaattcatatgttcaacaggaattttagattccctatgctcagagatgaccccctctccttcctcattcaacgataatgagccaggtgatatagaattttccttaaacataccattgactctagtagcttctgaatgtttgccttgtacaggtttaagtccatgaggaataccaacaccagcagatccagcaaaatagttacttgggtcacttcgaatatcatttaccactaccattggccttgaaggaaccttgggaagagtcgcaccttcatcagcaaagaatgatgtttcaagagagaggtgataagctgcaaacacagcaagttgcacaacacgcttaattttctttagttcctctcgacatgatcctctcagtagaacctgcagaagttgaggtacattgattagaaatatatagtcctttgaaaagaatgcaatggtgatggtgaatctgacaccctccccctacaatgtgtacaagctgattttacaattgattcttagttcccgttgtaacagaattgtgattatgtttcagtgtattcaatggaaaaatcatttcttttgaacaggaatgattcatttttattcgtggcaaaaaacgggcatttaactagtgtaaaaggtaaaatgagatattcaattgaaaactaattacagaaccagtgctactactgcgtatgattgaatatacaagcaaggagttatcaatttatgttagtgaaatgaatctaaatggaatatttagggaacagaaatagattattaccgtgcaacctaaacgcctcggacagccttcaaagaacatcagggtcttcattgacctcctgtttgtctgttttcctgatgagaattctgaaactttatgcaccttgaacaattcacattgacctagtcttgctgaagcaatattgtcaattgacgaggcaatttgtgctcctgagcatcttgatatcctatccaaaagcggtctcttaacattcagaactaaagaaatatcttttgccaagagttcctgggcataagatgagacacttttctcaactagcagcacatttggtcgccgagactcaatctttgcaacaattgccctcaggtgctccttttcctgcatcaatggtatttcattcagcaaaacaagaaacaacaaatatatgcaacacaaccatgaagaaaacacaaacctgttcaagtatagtatcaatggatgctagtttgttcgtgaccttctgatactcaagtgctccccctaaaatgagcaattttgcattcacatgctcagaggccatgcgtttgtgttttacattcttagagcaaaccactcctctaacaagattgctgcataaaaggaacacccatcagtttcatatgatggaaagtacaaacatgtaaaaaccagtcaaacaacaaagctaagaacatacctatcacttggatcccctgatgctaaacatttaactttcacataatcagtaggatccatgctgccacctttcttggtatctggtctcacatagccagcagctagccaagctagggaggatactatttcaagccagcttttggatccattgtcattttccagatcaatacattctcccttaagcaattgagccacaagagcccggaaatgcccaagtacagcattcctcagaccctctttgtgagctatgtctgtgattgtgtcaacaccaactattttgttagtattaaagttaccaagagcaag

SEQ ID NO: 73592 - DNA, 92449 bp, Oryza sativa
  unsure (1)..(92449): unsure at all n locations
taaaatttaaaactttcatctcaaaatttgaaactctaaactcattttgttaaaaaaaattcaactcgaaatttaaactttcaagttaaatatgaaaactttcgactcaagatttaaaatttcaagtcaaattttaaaaactttcaactcaaaatttaaatttgtaagacaaattttgaaaactttcaactcggattttaaaactttcaactctagatttgaaactttcttcagattgaaaaactttcaaagttaaaatttgaaaacattcaactcaaatattttgaaaacacttgtgcgaacgattaaaaaaatggggaaaaaagggaaaaaagggaaaacgcatgagaggagggggagccaaaaaaaatgcgaaaaagatgaaaaaaaaaagaagaaaacacaaaaaaaaggcaaaaagaaaaaaaagaaaacgtgtgcgggagggacagtttcactcgcacgccaatttctgtaaaaaaatagtcgatttttagaccctaggatctgtatcaagattcgtgctaatgctttccgagaaaaatgaaggtgcggtgcggtggcggggagtcgatcccgtgatcgacgagttacaggcttacaacaccaggcttttgaccaactgagcacaaagattctattcgttatgtcctcaaagtaaatcataattaatgaaaattacactatagtgataatttatgcaattatatgccacttacattgtaattacatattaaatacatatgtaattttgggacttacatatgtaattttaaaacttgcagtgaaaatatattaaaattacatatgtaattttaagggcacttaaatatgttattttggaacttacagtgaaaatacattaaaattacatatgtaattttggaacttacagtgaaaatacattaaaattatgtatgtgattttaaatttatttaagtgtaacttttgtgattgttagttttctatcgtaaatttaatttatattgtgtattataataaagttacttatttgttatattgccaaggctcattaatggtcaactttgtgtttgaaatggcggtaatcagtatgtagtccaatccgactgttttggactaaaatttgtggcgccatatatatagatggacccaaaatgttggtctgcacgtgtggttggtctgaaccaagtatccccgagagttcctgccgggaattacccagtttcacatgttccctacgaactgaatgttttgggtgcaaggtattgaatcagcacttgtgttatgccgagtaaatctatggatagttttggtaaatattgtcatcaacacctgagatctgaatatgtgaattcatcgatagtgtaaaaatcacagtggtgattaatgcgatcaattagacatgctgaatctattttctaaaaaaaaggctccaattataaaaagtggtgataacatcacaactccttgagccttttcattgttgattgacattgcatgctagatttaactgcttctacagtactttgtagaaaattgcagtgatttttgcgatgcatgcttattgcagaggtccaagaaggatgagctgcattatggattccatccccgcatcagctgttcaagagggtggaaaagctccaacacagactgaatttcctcttagtggcctcgactctttcccatcgatttcattcttcagatcaaaatcacctcgtatagagatagtgcaactttacaattatctactcagaaggaagaaaagctggttccgaagaataaatctcctaggtggcatgagcaactgcaatgatggtgcctcaacttccgtggacggccacgggctactcttgcctctgtgaaaaactttcagctggtgtcgtctgatgaaaatggaccaactaaccaggagcaggacaaggtgattcctccagtttggaaagattgagaaggacttgttcaccatggactaccgttatccgatatcagcatttcaatcatttgcaatctgtctgagacctcccacggtggcctttctggactcactctgattgcaccttagactcagatcagacaacgcgctcccgcttagacgaaggggcaaaggaggcgaacgaaagcccgaacccgaatcatacgaaggaacgatgttttttcgcgaatgtgcaaaaaaattgcacgtcaatatattagaagaagatagcagagtttgattacacaatgcacacggtcagaaaaccgttgacagggggtcaaggaaaaaaaaacaaatacaaggaagataagctactaagaaagaaaaatactcctatcacaagagggagggtgggttagggggtcccactacactccggcttgcacctgagacgaggagctagagaagagtgaagatagggccatggcgtgatccaaaggaaagagctgcgtgcatgaggttgtatcactcagcacagcgagcgcgagcttggccacaatcctcttgctacacttcggcactattccacggtggcaatggcaggcaccggaagcgggggcagcggagagacgtaccaaagattgtggcaaaaacatcttcaatttttataatagtagagagtaaagatagagacagagatagagaagagaaacaactagccttgaattgttgtgtacttcaatatcaattaatctataccagcattacagaagaaagcaatatctaaaaatttacagccaaaactatatatatagagataccatcagtgagttgtgttcacaaaacgcactttcaagttgcacaagtacatacggtacggctacctagccgcaactgctatctccgaaccaacaacctgcacaccgtgatctctgacgacgacattgacgccgccgctctcgtcgtcgccgccggcgagttgccgtgcgtgctgcagcaggagcgtctcggcggcgctcctgcccaggacgatcctgcaggtgctccagtcgtcggcctccatgtccactccaaggtatgtcaggtggtctgacgcgctccagaacagcaccagcacgctcctggaatcaatggatatacacgcaaaatgttcttcaggatctctactagtacagcacagctaggcacaacaaattaagccattattctgaagcactgcgctggattgagatgccaaaggatgaacgagcgacgatcagtcagtcgtcagatcagatgatcacctggagcagtctggatcttcgccgctgccgtcgcagacttggtagactgtgctgccatcgacttcatgttcccagacctgaaatttcagttagtgcgtatgtataggtgatatatatgcgtaagtgagaacattgtttgggtggtgaaacgatgatgtatgatatatcagagttcagagggggcgtttggtttctgctatctagcaagaaaaccgttacagtttaaattatatatttaatttatacaaccacgagtggtagcattttttcattcttcaagcagataaaataggctggcaaattagtttaaacatttcatgatgccaagatggaaagaaaaaatactgttttgcagaaaactacttgcattgtaatctagttcaatgtgaagaaaaaattaagcacaaacgttgtgactgcagtttagtagtacttcctccgtttcacaatataagtcattctaacatttcccatattcatattgatgttaatgaatctagctagatatatatgtctagattcattaacattaatatgaactaggaaggtggcccgcgcgtatgcgcgggcacttatattattgaaaggtaagatttttattatttgtttaaagattttgtctcatagattaagggaaaactaaagttcggataatgtaattttataataatttaaggtttctatttttcttaaagtatcttaaaaatccattcacaaatttttaagtaggagatggattaagtacttacgacttttgaaacatgttattttctcgagtaaataataaactatatattgcttgtagtatggctacaaattaaaaatgtgagagcaagatactcaaaattcttgtgattaaatcgtctcatgaaggcgcatgatatagtaagaaagagagggaagcgtatatatgaagaaaagaagaaagggaaaaatgataaaagggaggggaagcataggtacccacgcgtacgtaggtgcgtatcgaaggtggagaggtgggaccttgtagtatttagtttcttctaagatcaatttaatctaatggtttataatattgaacccaccgatttaagtgaaaatcaagtaatagataatttgctttttttcttagaatttctaatatgttctctaatttattagagcaccaagtggtagcttgagggtatttgaaattttaatggacttaccacatgtaatgagaatattaacatgtaatatatatgtatgggatatatgttaatattcattctagctttgtccatgtttatatacatgtagagagaaattaaatatgttgctagcaaaccattagatgtctaattaatagcaaataattttgacacatatttgcaattgttcatagtagctcttaagattcatgttaccactttgattattcgttgatcaccatgattcgcacgaaaaaaatatgtactacttagggtttaggaaaactgaaattgatgaattatctgatttatgtgatagctatttgagattataaacaaatgaattaacttctaaatagttaaaaagtcgtttaagaaaagcaccatttataaacttggaaaagcgtggagcgtgcaaacgaaaatgcaaaagatggaatcaataaaaaaaataaggccttaaaactcccttattactcttatcctagtacgaattatattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataatgtaggtgagaactcgttgttttctcattctaaaaatctttaacagttgatatatatgtggtggcttaagattttttattaacaaaagcggtagcgttgcagcgatcgtgatcacctaagatgcctcagacacgatgctttgtcacacgtgcgaaaggcaaaggtgtagatgtgcattgtgcagcggaccaaaaagagaactttggacactttagttattaacaatagatatgttgatttaaataatgggtccaccggttctagtgtaaatgtaaattagttaatatatattttaaattgttaatttaatgggtacacaatatgatggtgtagaatttattttaaaatagtatattatttgagaataatagtccaaattaataaaaaaaaagatcccatgatttaaataatgggtccatctgtttaagtgcacgtataattagttaatatagatcttaaattatttatttgataagtacacattataattgtgtaaagtttattttaaaatagtgtattatttgaaaataatagtacaaattaatgagtacaccggtttaattggaaattatattgatttaatgggtaaacatataatggtgtaaattttattttcaaagattgtagagctaatttagttaactgtgtttataaagaattatatgatggtatattctttgtttgtaaattatgtttatttagaatatatatatatcaattatataaatggaaaaaagaagagagaaaaaggaagaaataattggagggaggcgtacatactacataccaaaataattggaaggaggcgtacgtactgcatacccatgtacgtacgtgagttaggtgggacccatagtatttggtttattttagaatcaattttatctaacggtgtataatattggacccaccaatttaagtgaaaatcaaggggtagatgttttgcttttttcttagaatttacaggattttctctaatttattagagcgccatgtggtaacttgagagcgtttgtaggaagtttaatggacttttagtatataatagatagatagatgtggaaaatgctagaatgacttacattgtgaaacagagggagtagcaaatttcctgtttttatgcaagagctagcatacctctgttgggaagtgatggtatgtttggtctggaaaaatgaaaaaatatgggggcaaatgcggcacaatgtcatgctcatgtgtcactcgaattgtattgggcacatatttggtaaagtaggatgcaaatgcagcgttgccaacgcgcggctgcccaaaagtcatcaggtaaacattgttgcctccatgggtaatctgcaaatgtagaaagcatttcagagtttaatgaatcagcggtgaaagaatatctactgtcgaaacaaggtatcttcttaattataacatcatacttaaaaaaacttgtgactgttttttagcaattcccttgcaaacatgcaacgttagtgaaactacattacaatcaagctttctgaatttgttcagttcggattgttttggcctgttcattgtgattgtggtgatatttctccctatttcctttaactgatgcttaaattcagcaagtatttggttgaatttcagtagcacttaccgcaagatcaagtgcacagaaagaagcaagcgctcctcccattgaatgccctgtaactattatgctaatatctccatataacttcctcgccttgtgaacggcgtttgcgatggctggacgtaaaagtgtgttattgtaagaagagtaaaatccagtgtgaacctttaaccagagtagaaatctcatcagacccaaagaaaaaaaaactcatgtcctattcttcagcaaaaaagtataattacattaacaggtcagtggcaaaaacctttgcgtcgggcatgtccgggtagttcagatcagattgcttccatagcatatccttaatccaattctgtacactgagcagaaaatttaggcatgaatacagagggatatcataactcccgtagaagccactaagaacaagaaaattgtgtagagttatttcagaacctgttctcttgagttcccctgattgaaacaatgatagcgttgagattgtgatcgacaccaacaaatgcctgtcatattgtttaatgtcatgtagtagcattttatttaaataggattgatgagaactgtattgtaaaacagtattagcatttagatatagacctgcaagcagttctggacatcaacgattagacgtctcatctcgaacccctgttttcggaaaacaagcgcccatgacaaaatcaattttaatcgtgatcaaaatgaaactaattaggcaccaaagtgttgggtatcttacttggattaagtcattgcattttgagcatgtccatgtatagagctctgttagatctgtcatatagacctatatatacgagaggaaatcatttttttagataatgggtaacgcctggcctctgcatcctaaggtggatgcacactgccaaatacgagaggaaataattgagggtaacttcatgtcgagaaaaaaaaagaataaactaaaaaggggttgactctattcactgcaagatacaatttactcttgaattacaccaaaaaaaaaattggggggtgggggagtggtgcattgagtattgtatttgtatatgacacatgacacaatttggaaagaataaggtgatgataacttacagctgaggcatactccacaatagtcttggcaagtgtaaggttgaaaccaaagctctgctcactattctggacactggattctgtggagattggaacatctagcctttaggcatgctgatagatatcttatcgaaaagaacagggatgctgatatgtgcaaatctcagttacacatcatacattcatactcatcaagaataaatgctatcagacaagaattagaacataagtaaactttagtgttgcatttgtgtattccttagattgtctgggtgatgaaagcaatgttcctgctagggtaccattccttcttcatgccattagatgaaagaattgagatacaaaggccctgtactttgctatacatttgaaggttcaagttcaactcacgcgtgcaaaatatcctttttttttttgcttccaggtacaatagttattgatttcatataccctatccgtttcacaatgtaagtcattttagcatttcctacattcatattgatgctaatgaatctagacagatgtgagaaatgttagatttacttacatcgtcaaacggaggaagtaaacaatagtcaacattattaatcgtcttgcagaaagccagaaacaatagtcaacaataacagtcaacatcactgtcttccagaaacagccacactactagtgattaaatctactactacagtacaagcaaaccttgcatgagcacattgagatataaaattcgcctcatttttccccccttctcaaattgaaattaaatcgatgaagagaaatcagttgcataaaaaaacaaaattgcatcaaagaaaacaaaaaagaacagaaagaaatcaaataatcaatccatcagctgccgcgctagcagcaagtgataaggctgaggcagagatgagctttacctgttgctgctacgatcccatggggtgggcgcgatgcagcagggatgagcaccagaagcatcgccgccgccgccggccgcctccgcttctccatatgccaacgttgcacctccgctactttctttttcaagataatgaaaaattttattgaatccagtcaattacatcaagatgaacctcctaattcggaggagttagctgcagagagagagagagagagagagacgatggagtggaggaggagaaatcgagaagcagaggaggaggttgcaggacggatggaaggaaggaagaaattggcaggttggtagggcgaggtcgtcagacgcgcagcacgagatgaggcgagaagaggctacggagtacggagtagtactagtactagactactacggttgccgcggctgtgtttagattcacgccaaaattaaaagttcgaacaaattggatcaatatgatgaaaaagttgtaagtttgtgggtagaaaagtttgatgtgacggaaaaattggaagtttgaaaaaaaaaaagttaaaatctaaacaaggctgctgttatggcgcaacaacgaccacgtttcggcttcgctaaaagaaaataatgtttgagcggatgtcagaaagggtttttgacaagaataaaataattaattttataactcgtctgaaaaccgtgagtaaaataattaatttcataactcgtctgaaaaccgcgaatcttttgagcctaattaagccattgggttactgttgcatttatagctaatcatggattaattaggctcaaaagattcatctcgtatttccatgcaaattatgcaattagcttttatttttatctatatttaatgattcatgcatgtgtttaaagattcaatatgatgtttttggaaaaaaaaatttgggagctaaacccggtcttcgttttgttgtaggccatttgtgtctcttgcttttctccttccaactcctacctaccaacatctacatggcatgcaaggataaatctagaacgaaatatatgatgtgtctacgcttacaaataatcataggtataatataatgtttaatttgatctaatacttatgagatttcaaaatttcccctatgtcaagtgaacatcacctaaactttggatttattcacttcgctgccaatttcaatcttactaattttagcaataccaaattttgatacgtttttacgttgtcaaattttgatagcgctggatttatttagtttgatttctttccaaaattcggtagtatttctatgagagaaaagttccagagctaccacgatttgataggataatgttagtaaaaggtagtgtttagtttgttaccctattaaaatttgagaacaccaaaatttgctatggttaaaagtggtgttaaagtgaacaaacttcacatgtacatccgcccctagctgcagtaaacccacttacctctaaaaataaattgtggttgtaaactgagcatggctactcatgctttttttttaacttgttgcacaacattatattaatagtacatactcgtaagggtgtgtttgataaagcgtatatacttatcggaagagggcttctctgacatgggtcactagcatgtgggtccttgagctatggggctcgcatgtcaaccccttaaagtcagagggcaataagttagagaatctctttccatatttacgttacttatggctatgttatgtctctaatctggttaagacgtgtgcaaggcacactcacttgtgacattttgaccaaatttgcaaaactacgaatttagacaatctatcgtaaaagctatcggtttagtaccaaatttaccgcaaacctacatatatttttttagataatggcaaacctacagatttagtagtgaaattctaaatatagattttagctcctaggactactattatgttagaattataaacgttgtacttttgcactaaaatagcactaaatctatagattgcggtattatgctttacatagtttcatgataagctcaatactaaatctctagttctgtgagatacccgctttaaatctatagttttacgacagtttgatttatacgtagttttacgaatttactatgaaatagaaattaatctatatttatttaaagtagaattggctaataagtatccatgggcttagcccactcccacctctctaatccatcgccttggcctcttggggtgggatggtatggtcaacaggccgcctgtggccgaatgaggcctgaacaggcacaaaggcaatacgtaccctttttcaggcccagaaaaagaacagaaatgccaggtgtcctttagtgtttttagcttggatctgcactctgcagaccaacaaaaattgggcacatccctaactgtttcttcgcctttcaaattcaccttgctttgttacataaaacgtgtataattcgcatacaagatgtgacccatgcagttcatgttggactgaaaatacacttaattggctacttaaaataacccagccaatactactgaatactaagtataaatcaataatatgatgctgcggtgctgacagcatctgcagctgaattttatatgaaatttactcaatttaattaagcagggagcaccggggcagccaccctgcaggtgttgtgagactggcaatggcagcacttgtgccctgccaccctcgcgtacacctgcgtcgtgtccctgcagtcgttgcacacgatccatccctgcaaaccaacaccaatcagcaacattagcgtcaaagtgtatgtagtattttatactgtcaaatggcacagggtgagagttcttggatggaggcaagcttacctttcccatgtaatctatgtgcagcatatttgcttcaatctgcagaggttaaaaaatgaacatattatggcagtattcctacaaattaattatcactaaggctttagattggtgagactactgcaactctgcaagtttgaaacctttccaaaatgtaattgaaatgatgagccaatatctggtccggttttttagttcctttgcatatgatttgtattttggtttattttatattcactatttctgaacctacaacaggtctattaaataaattgaaagatgaagtctagttgtataatgctattgtgttaagcaagctcactaagaaatttaatacatacctcagcgtccaaagccctcaagaacttgtccatgtcaaagataggcatcgagcatatgggacaagagaacctacaattatcaggcatccaagaagaacaagatcacacgaaagagatgactaatctagcacacaaagtaaagaaacaaacaaagaaagaaagagccacatggaaacagatcaacacagcatgggcgattacttgtcgtgcttcagcatctcgtggaagcattgcaggtgcatcgtgtgcccacatctgagcacggacgtctcccttagagagtcaaacagatactgcatttgtgatgacgatcgacagtttcgtacataagagactgcattttttttaaatgaacagtatgcagaaggtagcgnnnnnnnnnnnnnnnnnnnnnnnnacattagaacacacacctcgtaacagatggggcagttgttcttcatggagttctcgatgcagcagtgcttgtcgcgcaggctgaccgagtagcatgatcctgtgtttcaacagatatttaaaagtggaattgagagattcagattcaaccatctcaccagtaaatagtaatagcttgggatttcagtaccgagtatcgagagatgtaggatcacactgactcaccacatttttcgcagtggaagaagttatccttccctccaactctattgcaaatttgcaatgcatcccaaattcagtcagctcagaaaatttgaaatgcattcccactttttaagtgatttttttagatggtgtggtaaaaacatacctgcagatgccgcaatcttggcagtggaagtgttccctgtcaacctgcagaacacgaacgtgcatctcatcaacaaccaaatcgaaaatcaccagatccagcagaagcaaagcaagcagcatcggcatctcacgtcgtcgtcgaagaatttgcacgcgctgcagaagtactcgcccatgcaaacgccgcagttgtagcacacttgcgcaacctgctcaaaaaaaaaatcaccggtcagaaacaaaaattgatccaagaaacggaaaggaaagcccagtggattcaacactaaccggctgttcggtgtcacagacgagacagataacctgaagagcagataccccaagataagttttttcagtttttttcagatcaagaaacaggatcgaattgatgtgatataggagcacccaccgattcaaccgcgtgccgatcgagctcgtggccgtctttctgatccaagaacagggagcggcacatcagaaaggcaggagcagaaaaaataaaaataaaattcaggattggtgatgcaatgcaagcaagcacgcgggggagacgaaaccgtggactcgttgtggcaatggcggcagtggaagacgtcgttgcagcacggcgcccggatcctgcacctcctcctgtagtgcttgcatctgcgcgcgcgccaacgactcgatgagctcaaaaacaaaacgaagaaagaacacgaaagcttttcttgtccaagaacagcagcggcaaggaggaggaggagaagtgcagagcagaggaatttacccaaatcccatcctgccgaatccgtggcgagacgcgtcgtcgagctccatcggttcgatggccgcggcgagatccgagcagcctcgcgcgccgctgttgctgcggcggcgcgccaagaaggggacgactactattttatactagtgaggaggcgagctgtgctcgcgagtgtgtgtgtgtgtggtgggggcttggaaggaagggctgccgagaatggcaagaaaatggattgagatcagctgcagtggtaacttccactgtaacttaggactgcacgtatcttcaaccattcattttgatgatgaatggtccagatttatcgctacagtgatcaaaatagaatcataaaactaatattttattctacggtacttttgctatagtgctctgactaacctgtgccatccgattcagatcaaacggtagcaactatgactgcataagttgcagtcagtactactactgcagctgatccaaatctcaagaaaatggagattggggattgggtcgccactgtcctgtcagacacacggattctctactgtaaaaaggaaagtcctgattgagatgtttagtaaccaaatttatgagaatctaaaaacgttaagagttttttagcttatggcttttaactcatatctttaaattctactactacactttctataatctgatggtcctatagtagcaaaacagtatatttgtaaacggaaagtaatttgtgaataaaacttttatatacgtgttcttagttatctaaaagcaaatactgaaaaataaatttcgatgaaaaaaccaaaaatcagctttaaaattaatgttgaaaattttaattttgactaataagtataagcataagcgaaaagatgatgttgtaagttatttggaagagttcgtgattctgaaagaagctgcaattgtttttccaaacagtccaaaagttgtcttcagatgttgcatctgtttggagtaaaaataaataacttctctctctttgaggttcttggtggtcgcctaggaggagccttaaatgccagcactgttttgtttacaactcttcttttttttcaacatcttctgcttgggaaattcggagctatcttttgaaagtgtacttttttaaaacttatcaagatgcaatggcctttgcatttcttcctctcagagctttcaagaattgtagtatataccagcaaggttggattgaggaggtggcgtgcaggtagatcaaagtgacatgctgcccgctccgctccgcaccaactgtattcaagatgacgattccttgcttcctccggcagttcattcccacgatccacgcatcaacccatgacaaactaaccgatcttatcagtttattttcatcgttgtttattttatggcattagcttttaaatcattaaaaatatatatacagaagttttataccaaaatattattttttaataataaatgttaggccttataatcaattgtaaacgaaatgactgaacggtaggactcgatgacctctaaaggtctgcagacacgctacattatcttatctttcttgtaatgggtgaaatttttagaaacaaatccacagaaattgatttattccttctataaatttttaaatttcatgtattcgaaaggagtcctaccgtttagcgagccatctccataaaatttgcttccaggagagtgtttgtgcggttcccctggagcttcttcacctgacactcgacctgcaggctgcagcaaccatcgcgcttctctgcttaagcatttgaccgaacaaaattaggtcgataaatcaatcgatcaaaacaaaattaggtcgatggctggtcgaaccggcaccttccctgatttttttttgctgcttctactggaaattataaacggactttttttcttctcatcagggggtcacatctgggaggccagagaggatgggggcaggagtaaattattcacgaggatgagaggagtcagcataatgcattcaatcactcactgccgtgatgttccgcccaatctccagttagcgaatcatgtgtataagcgataatactccaagatgatcttccagcatcttctttcaatactgtatggagtaattccatgttgcatcatgcttaggcttgtcgatcctgagaaagtagtacgtgcaaaaatagaacattcgaaaatgacgctgttagatccgagataggacgcgggattaagtgggataagccaacagaatgacagtacaatagagccgcagataatctcctcgaactaagcaacagtgcatttggatattcagaaactgctttacaaccatggattaataatacagattctgattggtgccattaagtttcacatttcacacactacacatcagatgacccccgggcatggcatatatgttctcttttggctgatatagctgagtgatcaaaaggatttgcatccaccagtctgaaacattccggttcggaccataagcacatcaccagcacaaacacagaaaagcatttccgcgtgctttcggaagcttttgatagtgtcaggtatatggccggacagatccccatcatatgcactgcgccaccttctgatacaaatcctgtggccagttcctgctcatgttgcttgccacgaggtttgcgatctgcccatcatgaaaaatattgcatgaaaaaaatgcagggggttgcattttatattatagcgagataatatcagaataatgctaactaaaagaaattaaattaatgcatgtctaaaacgtgataacacagcatggtgccctcctctgcggtcatccagataacttatttgaaataaaaatgtattaaaaacaaggttaatggacgtggtcaagcttgccatttgacaatgaaagtctccagaaggatgtgtatatgtggcagatagctagcatttagcagcgtagtgcgtcatgatatgaccagattttacactaagattggacattgttggaaaactttcttgtgcaagctctctatagaatattttaagtgcttcttgggcccacaggctgggccgcaaggtttacggccgtgacagcaatctttacaactacaacagctaaagacatgtatcagcataagactgcccaactgcaatcagccatcaggtacgtaactgtctgtgtgcacacacaagagaatgcttgcgagtggtataacctgctagttaaggtatgtggatgtgttactaaacaggttcttcaaattatttatagtttacttatctatggtagtttagcatcacattttctctgccattatgaagtgcagtgcctacatgctcattgtataagtaaatgcgcaaaagagattgaatacctttgacttgactgcacgcaaggtcccatcagtatctctaacattgtccatacaatttagagcaaccttcaagagatctggcacacaagcttgaacatgcggtgacaagtttctgaacacatcaactgtcacatttggagcctgaggatccaaatgaagaaatgggagtttgatggtttccctcaaagcatctaaagtctgtccagctcgagcaagcctatagatatggagaatagcttcaagctgtctcagtacagtttgttgctcagatatgaggtccttgtcttgaacactgtaagaacgtttccaataaattgatcaaaacacagctttaaaaagcataaaggattaatgctcaacttgtgaaaaaacagaagaggataataacctggcttccgaatatctggcagtttccataatttcattaccagaatgaattagagcagcagcacgactttcaccatctaacatactgcgtgccatggcacatattgcatccgacaggcacttatttattgtctgaagtgccatggcaaaagctccaactcttttatgaatttccactgactgagctcatgcagagcgtaaagtgatattagacggatatagaacaactcaacaaagagagtaagaccaaagtgcagaaaacatagacatcttcaaattcatatggtaaatatctacttctgtaccatgtagcttgccatcaatagtttataaaattatagtcaacggttaaaatgcacgcacatatatcagatttgatgaagcatgtgtgatatgtcctacatgtgacaatcaagacgagtttttactactactatcacaagaaaagagcatttacttgtttacttactttgtcatagaggcctgcctcatgacactgatgggcagcttcaagtaagaattgctgcctgcttctccaatccatcatatacttctttaattctccttcttcccccattccacttggaccaagcaaaagttgaatgccaccatcccttagtaatatctctgtcagcagttgcttcaacattagatttcgctgccgctgctgatcagcattccctcgaccaatccatgatacctctcctccacccattgcagcagcagactgtgcataatactccaaggccaaatcaaggttaccattacgcaaataaatagagccatactgccgtattatactggcagcttctgcacaagcatccatgatacccatcttctggcctgacccaacaccatcagggagaacaccatgatcagataaagcaattgaaatatgcacagcatctacatggtatccttcctctccaacttctttagacaaataaagaattgctggaagcaattggatgcttaacagcagaacatatggatagaccaaggggtcttttccattctttgtataatatgatggttcaaatttgtttaagtaactttgcagatcctccagagtataaggcaccaagccttcatttgaaacattagaagaagatgcactggtgtactcccgcagagctgacaatttgaaccacaagaaatcctctatagtattgaaaagtgttggcagatctttaagcaatctgtcgatttgacgtcgacaaccacagatcatggcataaaggagcaacttcttcctatcataaccaggacggccaggtcgatcacccattctcagcattttgtcacattcctcagaagctgtcagagcagtctctggggatacagcaccattagtagtaatccattctacaagctgcaaagaacatattatttgcatgtatggtatcaagaacaagaactcatcgcaatttatgacatgtcaatagtttaccaggggagcaaagttgaatgcagcacgagatgattgggcaacttgtcttgcctcatcatagtatccggttctcaagcagaaataaatctaaaaaaatgtcaaacaataatacttcaatgttagcagtacaagattaacaagttacatgaaaatcaaagagagagaacattccatgaaggcgcaactgagaaatatttgttgataaattagaataaagcacatgtacccacagaaaactttttatgcatcagatatggctttactttagagtattatagcctacacttgaataaagtaagtcatagaataagccgaattgacctagcataggaatgataccatgaaaagcctaagctagagttgaaaaataatgaataataaaaacactcatggccccagtgttgcactatattcaacacgatgttctcataaaagctccagtattcttcagttgctgcacttactgtattttggtggcacggttttatttgaatgtaaccaattgttttttcatgattttaatatgccattactagacagattgaaatggcaccaattgcaattttgtgttaaatacccaaaactaaaaagggaacctgttgccatgttgtgtccactggtggctgtctacgcagatcagttgcatcaaagtctagcacaccatgatcccgcaaacggacctgccagtcataaggacaaagatgcatgaagctcatgtagaacccaaattgtacagcatcatttcacttgaaaataaaatgatgtacagaaacaatgaaaagggagagaagcatcaaatttaaaacatacccgaagaaatgcgcgaatcttctgaagattgccaacagatccaccaagagcagcctacaaccataaagcacaatcacagcttaattaagatctattgatacaacagaaaagctcttgcatgagtaggtttcctaaaacataagccacatagtaaagtgagagtagggaacatcatttgctaaaagactaatggaagatcacaaccatgtgttaaaaaatcaaaaaataatgaactattctgagttgctcactaacattaaatattatcttccataaatatgcacaattggtagaaagcacatatcacatcacaattcaccttcaggacattcaagaaagaaaattaatgctcaaaaatatgaactaaggtgacatgacacaaaagagtggaatacccataggcaacataagaaaacaggtgtagtaactctcaagagttcagttggatcaacaccaaaattattgtcagaatcttacatgttatattctattttcataaggaattttgaaagaaatgtcagaactaaaaagtatgtgaaaatactcactagagccggatggctattgatggtctcaagtatgtacttttcatgaccccactcaaggtgtcgtctagcaccaatcactagtgacatttttcttgaaatgtttcgatgagttgacccttccccaactaatgcctgaataagacaaacaagaagcaaagtatagctatgagggaataatagataaggatatatcatatatattggatggaaaagggccaacagatgtcagcatgagtgctacacaaaaatcaattttattacctgaattaaatgccacactttatgcatggtcactgattttgtcccaatagcaccaacagataaagactcataagcagccctgaatgctgtagcaggctaaccaaaagataactttaataagcattagcagaactacaagtacatcaatagaatttgcttatgctctgatgataacatgtcgaggctacataaaaaaaaaggcacttgatctatttctcaaattaaattatttggagaatagaactatggatagcaaaaaccacaaattcaatctataaatgaataaatgtccatagagggactaagtaacatgttgaatcatagcatatgagtttaacacttacaccaaaaggtaggctgcgccctctagcatcattaagatctctcacaactgcagcataaactgaagatttgttttcaattatagttttgttaggtatgggcatgacttccttagatggcagaccggacgaagattggggactggaagctgaagatggcatcagagcaggacgagaaatcccactggccatgagattagtgtttcttttcggtaatgtagagagtcggcttagactctgcaagaagtctcgcttctccttctgccaatcatcctacaacatagatgttatataagttgagaaccaaaccgtaaaataatttgaaacattcaccactgagcgacataggagtacaagaccaatataacactgaaaaatgtagacatcttagttacctgaaatggtagtactgtactgttcaattaaatcaaatcacaagttcacaaccctatgacaactgattttgttttctaatgtgcaatgcaataatacatataggtaataacatatacaaacccccagatgatacagaaatttgccgagaaacttttaacatataccaagatgatataagaaagtgcaatctgaaaagcacttcccacaggcttgcaacaactaaaccagatcatatatatatatatatatatatatatatatatatatatatatatatatatatatatatatatatatatatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagaaagagacgacgccgccacctctcccgcccccgtcggaccgcagccgcctccatgccgccgaatctggcggaggcgaggtccggcccgccgcccctcccacccccgccgggctgcagctgcctccacaccgccggatctggcggaggcgaggcccaaccagcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtatatatatatatatatatatatatatatatatatatatatatatatatatatatatatatatatgtaatgaagttagcagcaggaaagggtaaacaacctcgagaacttgcatcatataattgttaaaactccttaagttgtccttttgtgcttcttgaatggatgagacgattgccatttcatgaagctgaaaacacatgacatgtttcaggatatattccatgaaattaggagaaaatgcatgtaaaagatgtatgacggtatgaagtgtgcacctgctgcaggtactcctcgacagtagttgcttcagatggaaaaacatcctcaaatgtggtctacaaaacctcaattttaatcactatgatgtatattcaagtagtctagcaagatagagtagaaaacagaaaatatacaataagaagctgcagattcacatacagcaacagagttgtaaatgtattaaggtatactgatgaattaggagtgaattttagagaatgggacatggggcatacatagtgaacagtaaagttatggtggatatataaggtgaagtgcgaaaaatcgtgcgctgttattgagtaatgatttccggtcaagttttttatatcaagagcccgctgatccaagcaaaaaatagtagcatttacccaataggaaaggactgattcttacactattattataatgaatacatgctatcgttatattagctgcatttaaatacacaaagagaacattgcatagataaagcatagaaatatgagctatcaatttcttactcaagtagataactgtatgttaagtttcttctacaatttaagtagaaaattgaacgctaatctggagcagtataattgaaagtataggaccaacgagatcttgctgcacctcgaactctagagtcgtttcttgtttcaacatagttcatgggtaactatttcaccaaagctagctcacagatactaactaaacatttcgtcaaaactactgaactaaactatttactagtaagttaaactgctcttccaatttaagaagacatgatgtattggtaacaaacaccaaactatcatcttcacttcttcatttgaaattgtaaaggatgtttttcaacaatttggtgcaaggaataaaacatggcaatgcttatgacttgttataattttattacgttttaaccctactttgtgataaccctaggttttaaccagcagtacagtaaaatgtctaatctcaaaccggacaaactgctcgatctgataatcagcaaatgagattagtataatatcactctatgaaatgggatatccctcgccggccatcaccttaagttcgaaggatttgaggtccctggcgagctgctccgcattgatcccctcgcgcgccaacaacctgcagaaagcaaagcccaaaaccctaagtcccccgtaaacccccaacaaccgcctacccccgacgaacccgacgcggagaaccgcgctgcgagcctcgccgaggcaaatcgaaggggggctccggggagaagacaccgacctggtggcggagagcgactgcacgggcgcctcggcgcgcaccgtcttggccttgagcttggtggagagcacctccagctggtccaggttcctctgcgcgcggggacaagcacacgggggaacacgtcaggcggaagaagctatggcggcggcggaggaggaggaggcagatgcgggggggaggaacgggagaggaaagcggcggcgcacctggaggggagggaagtgcggggtgggggcggcctgctcgaggagcttagtggaggagtggaggagctccgaccacccgcccatctccacgtcgccgccgccgctgctgctgccgccgacgccggccatcgccgccggggggctaggaggagggtttggttggtgtcgtagggcgtggtgcggcggagcggaggggggagtggagcgggtttttcctttttcgggggtagggaaaagagggctttgttcttgttgtagatgggcctgggcctaccggctcttgcgaatttgtgcccgattcaggtcagatcggcccatcttctcttctgcatttttttttaattataaattgtgtctatggtatacgaacttgtgtgatggttggaaggctgtgtttagttccacgttaaaattggaagtttgaagaaattaaaacgatgtgatggaaaagttagaagtttatgtgtgtagaaaagttcaatgtgacggaaaagttaaaagtttgaagaaaaaagttggaatcaaaacaggccctaaatcggtacaataacatgcaaatcgtttggcccggtaaaacaacttgcttcgtcagtgcgaattggggtcaaatctcacagtgaaaattcacttcacgtcagtttccacgtgacacagttcgattgcatattgcttttctcgaatgcgtctattcttgtggtggttgtggcataaaaactactccatccgttttaaaatatagcaaccttatactgaatgggacatatcctagtacaacaaatatggacatactcatgtgcaagattcattatactaggatgtataccatccagtataatgttgctataagataattattatgtaatgcaaaactagaaattaaacatcaccaaaaaaaagtttgagattatttgcaaaagctaccagaacagatgaaaacaaatggaagcaagctgaaactaaattgtgctgcatggaaaccaagtcagcgatatatcagttcatttagattgtgacacccgatttgtcctgaatcttgattcgcatgaattcagcaagttattgtatcggattaaacgattcgcaagttgttataccaatctatacccaccacacaacgcaagttagtgtaccgtggtgtgtaatttactactccctccatcacaaaatgtttgacgccgttgacttttttaaaaatgtttgaccgtttgttttattcaaaaaatttaagtaattattaattattttcatatcatttgatttattgttaaaaatatttttatgtatacatatagttttacacatttcacagaagtttttgaataagacgaacagaagtttttgaataagacgaacggtcaaacatgtttaaaaaaggcaaacgccgacacgcctgctcactatgatattgtgaatgtggtgtatagcatatgcgctcttaaagagatgaagatcagcaacaaataactaaccttgctagattcttaaaattcttattgaaagtagactgggagtccgcattttcgtttttgtttcatttttgaaaagcttctgcatgctactacgatgctatcaggtaattgacagttcacctctctctcataaaaatgaaatagttcaaactatcatatcaaaaatgttgtgtataggttgacgtgaattcaagttcaaattaacaataaactttccccgagaaataagagcaatgattcattctaaaagaaagaaataatattgattataagcattaaaggtgtaccatctttgctgcagtacaactggaaaattcaggtcaccatgcaacagaccaatcaaaacacaagatttgctttggatcgatgaggaatgattacacaggttgcaattgaagaaaggtgttacaatggaaggggatgtcctgaaatgctagagatctaagcttccactcaaatgaatctaacaccaaatgcaccagggctataagaattgaaaaacagaacctaatgtacacaggtaaactacctgagctccctccacagcctatacaaccgatgttcgaaaaataatccaatgacaataagtcaagaagaaatcaagttatcatcgcatgcctcgtttgcgaaacagcgcatggtagctgctgaggagtattttctccataactgaagactctgtctataaatattactcttcagttccttttccttaccgagcacgggcagtggatggttgttttgatgagcggccaaacttgtgtttccatttctgtttcccaactgcagagagatcagccaaaggaccggaccaagtaggaacagagcttttctcttgtgtaaatacagtgctaaacgaagagggatcttggggttcgtataacgggtccatgtgatttgtagaaaccaaagagaccgcaccatcctgatgcggaggaggaaacttttcactcttgctttttgcatttgcatgtgttactaatctccttttctgtaagatataaataaatgggacaaattagagacattgcaaaatttacattaagagagtgccgggctccattttgggccatagtaaatcaaatgagaccagtataggtaagacaagaaaataaagtggtgataaagtgttactgcgacggagatgagactaagcaagtggtttcaccacctccaccttaaatttagatcgctagcctagtctttaagtaaaacagctcaaagaaacaaaaactaaaacactactggaattagtcagggagcaagtatgttcacatacatcgatatttatttgaagttcagcatttgcctctggagccggtactgccctaggtcgatcgcgcgtctttgtcttcttagctccatcattagtcctaccgccagcagctctcaaactgttgatcatgccatgaataggtcaggtagcaatcaaatatttctatacacgctcaactcacatgagagcatggacagaaaacatgaatcaaacatcaaatatactaggatatgtgggcatttggatcacttagtgagcaaaaattctaaatagctgagcccagatggtgagagactgactatcagcccaacgatgaggcatgtgtcagacaaattctgtgaaatccagggacattagtaccacagcagtatgtctacttaaagtttcacctaaatcagcacttgcattgcactaaaattacatttgggcaatgctttcataatttgattatatataactttgctgcatgaacattgtgtgccatctctttaggatatatttctatgctaataatattgcttacgggaaaaaaaaacatccatattaataccaaatatcaacaaacttttggtgaactttactgttttagcacttattagtcattttcttgtaatccgacaaaagagagtggcttccattctttttataaaaaaaacaaaagaaagagagagtggccctgttatctgaagacagcactttgtacaaatgtttctttcgaaaatagtgaaattgtttttagtttattgaactattccatatgcatacccaaatattagaataaatacatgttttttcttgtcgtaggtattaaacccgagcaagcactcaagtatccaacctaggtccccagaaaaataatgtgccatttgataagcaacagttatatgtttaaagttaaagatgctatttctcaaatgccaatttaaaaagaaagtgctacaaccacagagtgtccagtactagagagacagccaaggaccaaagcgaataacaaacaaataataaaactaatgagtatcaaggtgacaaaccgtctggcttcttcatctcttcgttttgcatccatttctttgcttggaggatatgctgggagacttgatggttcacatgcataaggttcagttgtaaagaactgcatagattgtaataagcaattctttagtaaaagtgtaaaacaatgctacataatttcaacaaagatgacaataaacagatctacttcacacattatccagtgagatatgtcattcaaaccaaatgtatgctattgaaattcgaaaatcagacttgcagttatagagtgctactatagcctagattgataatatctggtaggaagatgcttccatgctctttataaatcaaaaaatcatactttattaagcaaatagaaggcctaaattgcagccacctctaaataagatacaatggtccaaatgagatcacaagcatcatagtgtcatattgcacaaaagaattagtcatgtcatacttcttggaatatgggataggatgcagaaaaaatatagtggtcataatgcttgcaagtaaattattggatattggctaaatctacactagtagctacccagaacaaaatctagccaaagcaccatgttctgaaaccccaattgcaaactaagttattgcaatgaaaacgtaaatcacctacacccaagattttctaaaaatattgtgcttatagagggcaatgactttgaggcaaacacagaatcgcagatttcagaacttcaaactgtgtcgtaagacaccaaagccaacttacatcacttcttaatgcagaagtcgctgttaaacgatcagctggatcaattgcgagcagtgtttcaatcaatcgcagtgctgactgtggaaaatctttgtaagtctctgatattcgccttttgtatggttgttgaggcttaaatattgttgcatgaggtagcttggactttttccaatattcttctgtgggggagccgcacagcttaaaaattttatgcagctgttccacctaaaagggacagatgattattaaattaaataaacatggaacataaatacaattggcattcattagattggctggaatgaacaacattacgtgcatgaacagtgcaacaggtcatattggatctagcataatctcaagtacgaataaaaaatatagtacaaaataagggttcctttggaacacgggattgaaaaaacgaaggaataagaaagtcacaagattgcaaaacacgggaatcagatgagtgagatagaatcaaaaagaaattttccaagaggttggagctcttgctaattttcctccgaaatctccataggattgtacattccataggaatttcaaaggaaaagataggatttaatcctttgtttcaaatgccttcctaggattttttccaataggatcgaaatcctccatatttcctatgtttttcctacaaaccgaagggggcctaaaagtgtaatacgttgaacatgtggtactacagataaagttagaacttttggtagagcaacgtttccagtttccacatgaaaagctactggttttatcaaccactatgtttacctaaattgaaactagtttagcactccaaggcctccgaccaaattgaatactgtttcaaggcatttcaaactgataattagacaaatcagcatgctgttgctaacctcagtacggcctggcataataggcctcccagccaacaactcggctagaatacaccccgcgctccacaggtcaacgcccaccccataatccgtggagcccaaaagcaactccggtgggcggtaccacagcgtcaccaccctgctcgtcatcggctgattcttgttgggatcgaacaacgacgccaggccgaaatctgcgatcttcagcatgccattgttatccaacagcaggttcgaccccttgatgtcgcggtgcagcactccattgttgtggcaatgctccagcccggacagcagctggtgcatgtagcacttaacctgcatgtcagcatgccatggaaaacctcaattaatttcacgacattgcgtgctggaacatgaggctgcacaaagatcttggcggggggagacctgtggctcggtgaagctgatgtcggggctggcggcgaggccggcgaggtcgtgctccatgtactcgaagacgaggtagaggctgcaggacatgcgggaggtgacgaggccctcgagcttgacgacgttggggtggtggaggcggcggaggatgaggatctcgcgggccatgaagcggacgctctcgggctccaggttgtcgaaccgcaccttcttgagcgccacgatcttgcccgtcgccgtgtcccgcgccttgtacacgttgctgtacgtcccctgcccgatctgcgccaccgacaacaccgcgcgctgttgatgagctcagctcgcgacaatggcgagcgcgagggcggggggagctcgtaccttgtcgatcttctcgaaggagtcggcgcggcgaggggtccagccgtcgatggcctcgccgacgacggcggagagccaggcgggccagccggccgccacctgctccccgcgcgccctgttggcgaagctccccccgagcccgaggcgggccgcctccgcggcggaccgcgacgaccgtgcgcgcctctccctcctggccggcttcggcggcttcttctcctcctcctcctcctcctcctcctcctcggccgccgccttctcggcggcgacggcgggcgggggcggggggtcgggctgctgggggtggtcgggggagggggcggaggggcggccgtggacgcagcccatgggaggggaggggagtcggggggtcaccggcggcggcggcggcgcatggggtggaggcgagtggggagtggggagtggagtaaagcggaggagtgaggtgtgggggaccgagctggatgcctggctggcttggttggctgggctgcccgtggaggctttgactctctcgctcgctcgctctacgtgactctgtgcaagtacagtgtcagctcagctgtccgtgccgtgcttccaggcctatttttttcattcgtaataatttattattatccttaaattaaataaatagtgatccatccgtctcatgaggagtgtatttttagttttttgatacgacgtttggattttcgtcttatttaaaaaattatgattagtaactttatacgtaactatttttttaagttttttttataattttttaaaataaaacggacggtcaaacgttggacagaaacccaaaaatatgtttttaggacgttggacggaaaccaaaaatatgttctttgtaggacggagggagtaagtattaatatggattttcacaaacaggatggacactgaacgaacgatgtccaggtgtagactatctcatgaatgacaaagggtgtccaggatgatgcggcctttgactagttcagtctatctgtccggtcgccccatctacgatctatgatgaaagaagagaacacgaaaaagtaatgaaacacgttcctattgggatatgtcgatgtggggctataattgattgggtgtcgcgcgtgtccttttacagatccgccttcagtaacgtcatgctgctatcgtaaatttgtacatacatagtgaataatatgatctagctttatccttcatgccttcattcatgcatggcagaagacacttgcaatataagctagcccatgatgtgctcatgagcatcggtcaatctagtcggcatccgccaatgatacaggtggatgtgaaaaatgaaacctatctacatgcaaaaaaaaaaaagaagtgcagtggcaagcctttgacgatgacagcgatgacgcggacggagccatggagggcgtggaggctgccacgactggagcgctaataaacgcactatccatatatgtcggacgtggaagacatgtgaatggttagggcaagcagccactacatgacttgcttgtgatcataagtatgttcggttctgaattgtttgtgatacaacaagtctgacccccgccatatggtggacgccgtcgacaacaacgtccacagcgggacgaaatatgtaatagcatccaagactagacgttgttcgtcccagtatccaacctattttttaaaatgaaaattaaattactatttatttaattcaaggattattatttattataaataagaaattcgggttttgaggtgaacaattttattttctaaggggctaaaatcgtattacttcatctattcgtaaaagacaactagcagtacaggacacatatttgctgacctcacttaccagctagatcgatctaggaatctgaaaggacacaagtttcacggtaatgtgtagcgttaagtacctgggaaagacacaaagaggatacatcctccacaatgtcgccgcacacctctctcctcacagcgcacgccctcatttcgcttggagaatgagtatcccattttagctccatgttcttggcatggaaatggtagatgcgaacatggtgtggaatattttctacgacatgctcaggcaaaatgacacatcgacgcattgtgatgcccaaaataggagtataagcatttttaatgaggtagcaaaagtcttctctctttttaactagaggagtagaagtaaaacaatagtttttggacaccgtttatgtaaaatattgcttcctttaaccgtaaggatgtgcataatttttcatttttgaacttttaattgggtaaaaaagctatatcttttgggaaatgttaaatatgtttaaaaaatattaagaaaagttagtgtgggattgattttagaaaatgaggataattattgatgttgtttctttcctccggctgtttgtttagggtatatttagatccttggtaatttttttcaccctgtcacattctaatgtttggacatatacatgaagtattaaatatagaaaaaaaaaactaattaaacagattgcgtgtaaattgcgagatgaatcttttaagcctaattactacatgatttgataatatgatgctacagtaaacatttactaatgacgaattaattaggcttaataaattcgtctcgcagtttacaggcggaatctgtaatttgttttgttattagactacatttaatacttcaaataagtatctgtatatccgatatgacacgacaaaaaatttcacccttaatctaagaacagccttagccctcctttattcatgagacaatggtgattacgagctcctatacctcctactactagtagcttggtgatgtgaattgatggcagcatcaaaccaggtgaaggtggcatggactcacgcgtagctcgcccttgagggcttgaggaggcaaacctgacttgccccttctttcttaagacccaaagctaatatatgtggttaagtcacgtcacctcaaattaccatagccattagatgaaatagcaacagtttagattgcagtctctacttagcttcccttccattaacagtagcccaatatacatgggcaagcccaatccactgcctaggcccaattcgcccgttcccactacactgccgagcgtttccatctacccgcgccacctgaataacggccgacgcgccggctccctacctcccgcgcgcctccccgcctcctcgaaactgctcgcctccttggtatttggagagacagaaaactaatcgtcgccgcacatggagtaaaatttcattagaaaccgtcttccacagcataacagtcttctcgcattacttcgattggtttcctacttcatctccgtcactggaaacggcctctccctcccatgaaacctggagcagcccctcacctttaagaaatcacacgagtatacaatcttctcccaaaggtctgcttcctcctcttcttgaatcacatatatgttcattcaatttatggcctttatttctttttccatggacgctagatttatttgttcctcttgccactgaagttatcaaagaatagaaaaacagacagatggatttggttttgtcccttctttatgtttctactagcaagattgaaatttatttggtctgtatacttaaaggagtcaattcatggtatttataaggtttctactagcctgttcatggtatgtaaaccattttttcaactttgctgtacctataatttgttgtgtttctaaactcctattgcagttcgtccctacacctattgcctactatcattgtagcagcagctatgggctattactgaggtcagtacccataacattcccatccaaagcagcgactgattgggtttttccatatgattcctctatcaagaaaatatcccaatatattggtacctcatattcgttcatggtcaccggctttcaagatattattatatgatcatcctacgatatcttcttttcaagatattactaagcatttcttctgtaaaaacaccgtcaggattttcatgtatatactatcatagattgcaagtgcaaggttatgtgtgattattttaacaatgaacttaatttaggtacatatattggttcctggatctgtgcatgctatccttccttgctatatgatgtttctactttaagttcagaattgtaagctacagttttgtgattgatgtaactttattcttcggattttgttctgtctgaggtttcaatgtagtccaagaatgtaaatcacatcagccaatgtgatcaaccacaaaacagaaatgcccttgatcgccatcggcagtaatgcatataataatttgattatcccggtgctcaaaactttttctcgccaacttctagatctcagattttttccaaccccccatatggtaagtttattgatattatggtcattaatttctgtttatgctacatattgctttctccttgctttccggagtcatccgtcagatatcacattttctctttagttcattaaaattgtattaaggtacaatgttgtatcaggaataatttcagttatatatctgtttagtcagtaaaatatatatgtggtactcaagcatgaggtaaagctgaccctttcaaaacatgaaaatatttcatggaattgcactttgttttgttgttattgcatatgttctacatgttgcaggcacctactttttgtgtcatcttaacacggtgtttcatctgtagacttgctacattgctccaactccacagatcaaagttagtactttagatggcagcttaattagttttaaggcactagccctagagctaaaaaaataattacagtttaatctgcttattccacttagacatgatttataatataattcacttaaaaaactatttcctttaataatctaatctatatatgcattagattataccacaacatcaccaatcttttgcacccatgaatggtactttgatgcttcagactatcacataatatttctgtactatatgaatcatgtatttttcttattacacaaatgtacttttgatatagtttttaagtttacacatattgcacatgagtattccgcagcaacgcgcggggtatcatctagtattctaaataaaaggtgttaattatctcctgaggtcatactactcttttttttaacaggccaaattatccaataaatttagtgggttacatcccatccaagtgcactttcaagtcaacatagaaatctatttaagggcatttagttttgtgcaaatacaagcaatccggctgagtttgaaaagcaggggatcgagaagatacgtaaaacgagacgatcaattagcacatgattaattgagtattatctattttaaattttaaaaatagattaatatgattttttaaagaaacttgtctatagaatttttttgcaaaaaatacattgtttagtagtttggaaaacgtgcgcgtggaaaacgacgtgttttctcactcaatgtcccctgaacgaacgtgtccgtgtaggagggtgaagtcttactctaaaccagcggcttctttagaacaaaagaaatttgtatggttcaaatcctataataaaattcatacatgcccatttgaaacaaacgaatagccataccaaaatcatacgaaattccttatatttcctcaaatcataagaattttaaagggttttcaacgtaagatccaatctcttgaaaaatccaattgtgtctaactcccatcagatgacaagacttatctttgtctatccatgtgtttctaaattcttacgttccggaggaagctatatattttgatgcatctctatgcattcagcttttgctgttagagtgcgtagcccggcccaccaaccgtgagccgtctaggtcacattgggtctgctacagcataggcctaaccggagccacaactttaggtcttgtgtctacacaacctaaaatactagtctgatgggtaaggactgcccacaccttttaagtcgtgctgtcccatcatcaattaccgatgtgtgactaaacccaacatttgcagccttgaaaaaagtgcatatcaaccatttgcttttttttctgttctgaaataaaccaacctactccctccgtccaaaaaaactcaatctaggaggggacccctcctagtacaatgaatctgggttgagttttttttaacggagggagtatgttctgtctatagcagacttcctttttctgctctaaattttattctttttttttttttgccttttgagatattgcgtttgtcattcatgtgtatcactaaacaaatctaacctgccacgctcctgttgccggtgttcgagaaaagcaagaccacgaacatgttacctacaatagaagtagggttgtgtttagttcaacgcaaagtttagattttagtagaaattagagatgatgtaattgaaaagttgtgtgtgtataacaggttgatgtgatggaaaaggactgaagtttggatccaaactttagatttaaacacagcctactacgaggacttgtgcaagaaaatgtttctgaggtatttgtcacatgtcagtaacttggacttgtgcatttcgaggtatttgtcgctgagaaacttgttacatctgttcccttgcaagaccaagctgttaagtctagtgccacaatatacggctgtcaggcaaagcagttcacaagtaaaggctgtgattttcatcatgcagttgcgtagttgcgtcttgcgtcagacaaaaaaaggctgtgattttcatcatgcagtgtactggtctgctttaaaccaacaacatgtgtatatgtaaaaaatcagttactattggaacttcgtcgatattagagtcatgtagcgaatctacttactattaaagtaaccgctgagataggactcttaacacaacgaattagataggtcctcccagtacgtagtacataacaaatccaaacaagaagttgtctagattcattgtattagaaatcttatctcaagctcggttgctttattttggatgataagggtaataactttcatatggacagtgacagttcacgcatgggatgcttaacaagttgaacctactgttgtactctaaagcctaaaaggcagtagctttttctaaaattgttgtacggagggggacttctgcactacaatagaaagttgttatagctaaaaaaggcaaaacacaatcgagttcactgatgcacgttaatgataaagatttagttagtggtgtactgatctaatgcacatcaatgataagatttagttagtggtgtactgtatttcccgggtttggtttggttacataacatgtgcttaagttgctgtcctgcaagcttctttttgaaacataaggcggaacttcgttccacttttatatttagaagaagagaattgacccagtttataaggataaccggacccgaaaaccatacatccgcatggttaattacaggaaaaccggctaaaacccaccgctacactactaaccatgatggcggagcccaaatgcaggacgtcgtcgccaagctaaacacaaaagccacccaacagctcccacaccgcagaagaggtgttatcgttgccgagctagccgcccaagcgacccagcagcgccgacttcacaaccacagcgacactaaagccatgaaagtcgccaaagcaaaaagcagctccgacatccaacaatggacatcagccaagccaccgaggagccacttcctttacacggccagcaccacaactcctaggaagagactgcaacatgtcatcgttgccaggcgtcaccgcaccccatcagcgagtagctccgacttcatctgcagaaacaaccaaagagcgtgacacccaccacgagaaacaaagcggacccaagaaggcgaaggcctcgccgaacacaatgtatgagagcttttgaaccgaaaaggaccatcaacagtcgtcaatgtgttggaacttctccgaagcgacgccccaaaggaggacacgacgtcgtaactccgccgccgccgctcgtccgaagccggaacaaggttttcacctggagatttgtgggggatatgaaagaaacgccatgacaacgcctccaagaaggaaaacggcgcccacgggcgccgtcgtcgtcgaaccggccaaaggcacggcaaggctttcgccgacgtcttcgtatcacccacacaagcacccccacaatgacggccacagaatagtccatgacgtctcacaagcattcatacctcgaccataacggcaaagacaggccctccggcgcggaggcgacggaactggtcgcggacggccagatccagccagggcggcgcaagccggctcgacatccgcgccgctgcagctccgtcgtcgtcgcaaccaccacgccgccacagcctctatcgccaccgctgtgaccccgcgcggacggacgccgacgccgacgccgcgaccggcgcgagcgagccgccgctgcccgcccaccgtgacgccgcccctgcctgccaccatctccgcgtcgtctccagccccgttgctgacctcccgtcaacaccgcgacctcggcgcaagccgctgctgcccaccgcgaagccacccctgcctgccaccggtcttcgcaccctctccagccccgacgttaacctctcccccgccgctagccgccacctcccagcgcctcgcccggcccggatctggacgggaacctgggccgccggtgacgggagcgtcaccggcctgcgcgcgaacgtcgtcctcctcgcacgtcgccacttccgccgcctcttccgcgctcctcgttgagcgtgcgcctccttcctgtcgccaccggctgagacgcccgatccagccgtgtggggaccggatccggtcctaccgacgccggatctggccgccggcgaccgctgcacccgcgagacctctctccggtcatggcatcgccccagccgccgcgcctgcgagaggaggtagggagcctcgccgccgctgtcattgcgtccccccggctttgccggcgggcgctcgagcggcggcaaggtggaggggagaagaggaagaggttggcggcggcgcgctcgtctggtcgccgcccgtgccgccctggggctgagcggcacgagggccttctcttaattagattatttcacggaaatttttctcctgcaagcttcgactccttcgaaatacagcaataggaaatacagaaataaagtatcgtattggtcgaagcctataggaaaatttggtaaaagacatgtttagctactgcatatgagaatcataggaattttgattcagacgattaaaatagacaaaatatatcagagcaattccaataacatagctttgctattagctccaataatatccacatcaagcatttaagttaactagtaagagtagtatatatacaatagatagctactccatccgtcccaaaatataagcattttaagagttggatacggttattaagaaagtagttagaagtaaatggtggagggttgtgattgattgagtagtggaggtaggtggagagttgtgattggttgggaaaaaaatgttggtggagaagtagttatattttaggacaaatcttgtattagatcatctacacacgtatccgtatgcattcattttttttatttttcttttagtctgttttttttcgggtcatgcttatcctgtccactcgttcttttcgagaaggaagcagtagcccaatgaaaaccatgctgctactagtctttgatcaaatgtctgaaatacttcaaaaagtggatgaatgggagaaattttgaaacatattcttgtagtccaacgagcttcacagaactatattattttataggatttcaatcctttaaaattcctataaaattccatggtcataagagcatccctagcagctcatctatattctatcctccatatgcctatttgaatggtcctacaaaaaaaaattctcacttcatatttatttttactccaacagatcattcatattacatcatctatcctatattttactattatctttcaactgccatctattttatattaactcttctcttctctcttctactcatttctcaactcttctcctctctcgccgaatccccttcacctccaccacccaccgccgccgccatggcctccgacctgcttgcgccggagcaccaggtggcggggcactgcgcgtccaccgacaagctggcaggcgggcaaggggcggcggcaaacgaccggaggcgggcggaggagccgcggaggaggcaggcggcggcgagcgggcggcggtgtcaggcgagcggcggggacggcggcacgggcggctagatccaggtctcctcccctccgctcccctcccctccgttggccgacggcggtcgaacgatcccctccgctcccctcccctccgttggccgacggcggtcaaacggcgaaggtagccaccggtacgtcctctcttctctcttccttcacccttcatgctcgatccaaatgggggcaggagaaccggatgagagcgggcgtttggggatggcgtgaggagaagcgccaaatttggcacttctctctccgtgtttggcgatccgccaattttggcgcatctgatggagcctctgctagagcgatgtttttcccctccatgcaccaaaaacgggatggtggctctaaggaactcaaaagttgagccacctatagcgcatcatgcatactagacggtactgccttggccagcaatctacagtcttaacagatatacaggaaataccaaagaccacttcaaattcagaagaaagaacatgaacttcactgtagggaagtaagaacctgaaagaccttaacagccattgcaatattgcacgaacaagaccctcccggccaaaaggaccaaaaatttcagttcacatagaacgagcaagcacgacatgtttccctattccaaaatttagtactactaggtgcttcaatacagttccactagtaaacaagtctcaagtctcaacagtggtgcctatactatggctaacaggcatggaacagacccggcatgttccattttacagaacagcgagttttcaacccaatgctacccaagattgtctttctccagtgtatccctcattcatcaccatgctttttcttctttttctttttgtctttcttaccagacgcttcggtttccatggcaacatccttagcatcttgtgaatcagatttcttctttttcttcttctccttcttctcaccttcagcggtggctacaggtggctcctcgctctccttggacttctttttctttttcttgccgccatcagcatcggccacaggagaatcctcgctatctttggacttttttttcttctttttcttctgaccctcttggtcaccatcctcttgaatggtttcctctgcacctgcaggctccgcctcttgatgtttcctcttctttgaagcaccttcaggcttctttggtgtttcttcagtggattgtccaagtaccagatcagccgcaggattgtatgtctgacaaattcaggtgccataatcaggttgagatgaattctgaattagatgtttgcccaagtaaaagtaagcaaaatacacaagacagcttttacagtgactggacaaaacgttaggtgcaacgcagtctcgaaaattagtaagtttcttgaagagtggccaagattaacagaaaacattaagcttcctcaatatattttcaagacaaaaatcaagatactacctaccttggcaggagtgattaaagccccagcacccttcttccggtccttttcatacacttctatcttgggctttcccttagtagaacctgcagacctgccaagttctttaccctcaagaacccgaagccgtgtctcaagctgcccaaatggatctcatgtcaatccaaggagtcagacaatattatggataaagaaaaggtatttcagaaagtacataccttgactcgactctcaagaccaatggagttatcttcaccatcaccaagggcatcataccgaatggcaagagcagtttttgcagcaagagaacgagaaatcttccccttgtgctttggagctgcttgaccaattaaggatgcatggtagatgagaccatactttggcgtagcatgctttgtctttagagctctgaacaaagcctggagggaaagattgtgttacttattatttttgtgggaaacaaattataatacaccgcaaaaagctactccctccgtcccataatatagcaacctagtacaggatgggggcatatcctagcattagggaccaagtacaggatgtgtgaaacatattatctcccagacatagactgaaatataagatcaaacaaagtaaaatcacaaacaccacacatgaagcatcctttccccatgttactagaaaacaaacccatacttccatttacctattttgcatcaagtaatctgagtggaaaatggttaaatctttcaagaataacaaatagcaactgaccttctctgcaccaagtatctgaattgtgctgccaggctgcttggccagatttaccaaactgccgccatgtgcaataagtcgagcaccaaccaattcgccaacaagtgcagtcaaatttggtgcgatagtgttcatcctgcttctcagataatcaaacagctgggctctgtactcagaaagagccaacacctgatcacacagctccctgatatttagcaagtcaagttcactaacttctgttcccatggatattactgccgcctcttttagctgtgcttcaacctcatcatctgaaagtatctgaaaatagcatttgcttcttaataaagaaccagttgtggtggatactcacggccattacattctgatcacaaatgtgcagaatttacctcagagaaatcaaggctttctgcgttagtccgatcacccatcatcttcacaacttttgcgtactgtatgttatcagctacaattttagtgagctctggaaagtgccacccataccattcacgaaccctcatggcataagtgttaagctccttgtcaagatcatccaataagccaatggcctgaatgatcatagtatcaacctgtataatcagaaacaatatagtgtttacctcagttaccgtcccatgaaggggttatgtacaaattaaaaatagtaagacctcttgtatatccatttgatgctgaactaaataattgcaggtgcgagttattcgttataaagttaacagaaacataagagtaacaaattgagcatgaaaactaacaaaaggaaaatgattgaatcatatgactcagagccagggagaagtactgaataacatgttcaataaaagcgaacggtaggataaataaaagctcaccttttcaggactgaacttcagcttatatctagacaaactgtgggacaagccaaggctcattggaccaaggtcttgtgcacccaaaccagagataagttcagtgagctggtttcttaaccctctcatgagctccatcacagcactattatgaaggcagtcaattttctgcaaaagcacgtcaaattataagcatgattggttgttctacataaacaaaacaaccaggagcctaactaaccagcttctcctttatagcatttccaagtttagagtcagccacagctaatgtttcaccctcacagtgcttctgcaagaacttgcgcaaacccttggtaggcttgctgtcaataatgagggttgcagcagaaagggcatcagatgtgttctcaaacttgttgaaagccttcagctcaaccacctaaatatagttgatttgttttgtcaggaaagaaaatcaactgaaaagaacaaaataaatagcagtaataggaacaaatggatagactcattgcaattcggcgtaaagtaacatgacttctgtacatgacaatgttctccacataatgtcataaactcaatgtgcacaaatttatttgtcgaatcaatctatagacatcggacggacagaatatgtgcacaataggaggcaaactaaaccattacatctctctcccctgataaccataacacattggaaaggaaattacagttcagaacatggtaggattagtcagtttttttttgtttctcgaaaaccactttgcatctatcaaaatcatatccccaattagcaaggcaaaatcagctaagctaaaacatatgtagtactcaccaacctacagaagccattggtccttgtgctaatttaactgactccatcgacatgtgtcaaatcatgcattaacgctcttaataaacaaaaaaaaagagaaaattttgtgctgtaaggaagaaaagcacaaacctttctcgccgagtcagacgtcgtgaactccttccataaatcctaaaaaaaacaacacaaaatgcgttagcacgattagtccacttaacactccatagaaagtcaaaccaacagctgaagcggcggcggcggcggaagactcacctcgaccttgtcgagcttcccctcgtcgagcaccttgaagagggcgaaccccgcgggcgtctcgaacagcaccagcatctctctcaccgcccgtgtcccgcaactactagataaccccccccccccccaccaaatcaaaaccccaacctcaaacctccacgctcaaaccgagcagcagcagcagcaaaaaaaaaaaaaaaaaaaaaggatggcgcgcgcaaaccttgggtcgattcgattcgacgacgggagaggaaagcgcgaagcgtacgttcccggctgcggtgagacggggatggaggggagatggcaccgccgccgccgccgccgcggcgagggtttagcgcgaggagttcggctgcggcgaggcgggggagaggggagagggagagagccggcgccgcaagggttttagggcttaggctttggggaaatttatagtggagagtagttgagaactgggggcccatctcgccgttggtttggtggggcggagatcgtcagccgttggatggcttattaggtcggggactcagggttgcaatccgtttgattattatggagacagctgtattgcaaaaatggggaacatgtgacgggtgggcaaaagtgaccacaaacagaaaaccagtggaaatgatcgatgccgaaattttcggtgagaaattcgaccaggtttttccactaactgaaactattaaggttaattcggtcatcgctctcagttaattgaatgaccgaatttaaccgaaattagaggggaaagcctaaatagtaagagtatcttagtcttgatggcttggtcataagttgaaagttaaaattgctagattaagaacaacgttttgtgttgcccggtgaaacctttgccgacaacttccttagcctacccctttccatacacaaaccaacgaaggcaaagattcagctaatgatgaacaaactccaagcacttacggggtggaaacccaagatgttatttcgagatgctcgcattgcgttgatcaatcactttcttatggcgctttccctctacttcatgtcagtccttgagcttctagcctggcaattaaggagattgagaagaagtacaaaaggttcatttggaagggtgatgcataagctttcgatgaaacttgcctggtggcacaagagaagttatacttgtcgatagagtgtgatggtcagagcgtctagaatctattgacgcatgggagtcgtgtggcacgctaggtggtgttggatgcgtcaaacattgtccaatcgcccatgggttgcactagcgtcaccgccaaaggttactcaccttctcgcggcggggtcaaatttgatcctcaggaaacgaagacttgcatccgtttggaaggatcgttggttgcccaagggcagctcaatcgagagttggacacctattctcacctcctttgtcaagaaacaggaggccgcacagtggcattcgtgctctaggaccatgcatggtttgctgatatcaaaagcgagttgtcctttcaggtactcgtggagtgcttcaaggtttcgatatgaacgcggaggtggtgttggagcccagcactcttgattcccttcctatgggcagtaacgataaatggcgaattctcgggcaaatcgggctatccgatgctttattgtgggcgaactatgtgtgcactgggcaagatcatctggaactggaaggcctgagcccgaagcgatgcaaagttttcatgttcctcactatgcgtggagcttgcctcaccaccgacaatttgcagtgacacgggtggcatgtcacttggcaaactgctactttctctatggcagagagttagaatcatgtgcacacatcttccacaattgtgagtttacagcgcatgtgtgggagcgggtgtgaagccgtcttggctttccttgcccgccgccttctcctaacctatccgattggtcgattgaggcatggaagaagattggcaaaacaagaccgaataatccttcaatacggatgtaaattcagtaacttggctcatttggaaggagcgaaatgcgcatgtctgtgaacggaagaccacttcggctagggccctatgcacggcgattgcggacgagtgaaagacatgggaggtggttggcctgctgaagctggcggacaccagaaggcgctaaggtaagtctatacttaggtagtggaagcatgtgtttcaacgtgagttgagctacctaggagttcaccgttgctgaccgcagttagcctggtgtaagcattgtaaatgttttttctctcccccttcttaataaacttcggctggtttttgccttcctgataaaaataaactactacgatccatcttggtaaattagtgtgttatatattgtttcctattatgttatttgtttgccaaacaatcataaaagaggaaggtgctgccaaattttgttatggtttatttgatttttcaattatcacaaatctcagttatgaccgaaaacgaacggcttggtcttgagttttgcttaacgtatctggccaaagaagcagcagcagccctgatttcgataaacttgtctatttaaccaacgtgtgtatgtcaccagaagaaaatcagttaggttttacgtacttatcaaatctaataacttccgtacgggcatcgacagttcatgcatgagacgcatcttgaagtattggaccagcagcagcgtagtatatgtaggccgagtttagttccaaaatttatcttcaaactttcaatttttccatcacattaaaactttcctacacacaaactttcaacttttctatcacatcgttccaatttcaaccaaactttcaattttagcgtgaactaaacacacccgtagtcgtagtaagaaaatattaacttccgtacggacattgacagttcatgcatgggatgcctaacatcttggagtattggaccatcagcagtgtaatatacgtagtcgtagtaagaaaatatttagttactggtgtaatgatgtagtccacataaaatgatgctccctccgccctctaatataagggattttgacaattcatgcatgggatacttaacatcctggagtattggaccaacaacagcctagaatacgtagtagtagtaagaaaatatttagttagtggtgtaatgatgccgtccacataaatgatacttcctccgtcctctaatataagagattttgatattttgcttgtatgtttgaccattcaatttattcaaaaattttgaaattattatttattttttttgacttactttattatccaaaatactttaagcacaacttttcgttttttatatttacacatatttttaaataaaacgactggtcaaacagtacaagcaaaatatcaaaatccgggacgaagggagtaacatttagttagtggtgcgctggtgcaattccccgtgtttgatttggttgtccagaattgtttttttttttttggggacggagggagtacatacaacatgcgtagcgttgctgacttgctgcaggtacagagataatcagacaagcagccaaggctttcaatctggttggcaaagttgatccaaaagttccgagtcacccatagcatcatgcatgcgtagtgctgccttggcgaccagcaacattgtcaccacagcacatactaacaaaaaagacaacttcagaatcagacgaaagagcacgaactactgttgggaagtaagaacctgaaagacatcaacagcaactgcgagaacgagatctggccagccaaaaggacaagaaactttagttcacatagaatgagcaaaagcatcatatgctctccaattccaaaattcagtaggcaattgaatacaagatccatgagtaacaagtccaaacttgatgcctatcctacaactaaccggcatggaaaaactcggaatgttgcattttacagagcagcgattcttcaaccctatgctactcaagataacatgtccttctccagtgtatccttcattcatcgctatggtgtttcttctttttcttcttctctttcttgccagactcctcggtttccatggcaacatcctcggcatcttgtgaatcagatttcttctttttcttcttctccttcttctcaccttctgtagtggccactggaggttcctcgctctccttggacgtctttttctttttcttgccaccgtcagcatcggccgcaggagattcctcgctctctttggacttctttttcttctttttcttttcaccttcttggtcaccatcctctttagtggtcttctctgctggtgcaggctccgtctcttgatgtttcctcttcttcgaagcaccttcaggcttctttggagtttcttcagtggattgtccaagtaccagatcagccgcaggattgtatgtctgggatcaagtgcaaagcatcaggttgagatgacttctgaataacagatgcttacacaagtaaaaagagtgccttggtaccaataacagatgtttgctaagtataaaatgttagtaatatacacaagacatctttacagtgaccggtcaaaatgttaggtatctaacaaagaacaactgccttgacaactagtatttttcttcaagtactggttaagaataacacaagacgttaagcttcctgaaaatactttcaagagagaattcgtgataccacctaccttagcaggagtgattaaagccccagcacccttcttccggtccttttcatacacttctatcttgggctttcctttagtggaacctgcagacctgccaagttctttaccctcgagaacacgaagccgcgtctcaagctgtccaaatggatcacatgtcaatctcaatgggtcagaaaatattatggacaaaggaaatgtatttccacaaagtaaataccttgactcgactctctagaccaatggagttgtcttcaccatcaccaagggcatcataccgaatggcaagagcagtttttgctgcaagagaacgagaaatctttcccttgtgctttggagctgcttgaccaattagggatgcatggtaaatgagaccatacttcggcgtagcatgttttgtcttgagagctctgaacaaagcctgaaaaaagaaaaacagatgtcagcacaacacagaaaaattgagttgtttgaatcaaacttacctcccagacttagacagaaatataaggagatgaaaaaaaggaaagttacacaaaacaacaatcaagcatcccttccccatgtgcctagagaacccatcatccaagggacaattttgcataaactacaaagagtggaaaataattaaagagttcaaggttcacaaatagcaactgaccttctctgcaccaagtatctgaattgtgctgcccggctgcttggccagatttaccaaactgccaccgtgtgcaataagtcgagcaccaaccaattcgcccacaagtgcagtcaaatttggtgcgatagtgttcatcctgcttctcagataatcaaacagctgggctctgtactcagaaagagccaacacctgatcacacagctccctgatatttagcaaatcaagttcactaacttctgttcccatggatattactgccgcctcttttaactgtgcttcaacctcatcatctgagagtatctggaaaaaagcatttgcttcatattcaagaaccagttgtggtgtatagtcatggccgttaaattcagatcaggtatgtccagaatttacctcagagaaatcaaggctttctgcgttagtccgatcacccatcatcttcacaacttttgcgtactgtatgttatcagctacaattttagtgagctctgggaagtgccacccataccattcacgaaccctcatggcgtaagtgttgagctccttatcaagatcatccaataatccaatggcctgaatgatcatagtatcaacctgtataaccagaaacaatttacctcagttagcttgtcaggatggggtcatgtacaaataaaaacagtaacgttaacctcagtccatcacaatgctgaagtgctagactaattaattgcaaatggaagttaaatgtaaagttaacagaagcatggcattgaaaaatctagtttggaaactaacaaaagataatgatgttgattcatatgactcagagccaggaagaagcactggatagcgtgatcaataaatatgaatagtggaataaataaaagactaaccttttcaggactgaacttcagcttatatctagacaggctgtgggacaatccaaggctcattggaccaaggtcttgtgcacccaaaccagatataagttcagtgagctggttccttaaccctctcatgagctccatcacagcactgttatgaaggcaatcaattttctgcaaaagcacgtcaaattataagcatgattgtttgttcaacataaacaaagcaaccaaggaacctactaaccagcttctcctttatagcatttccaagtttagagtcagctacagctaacgtttcaccctcacagtgcttctgcaagaatttgcgcaaacccttggtaggcttgctgtcaataatgagggttgcagctgaaagggcatcggaggtgttctcaaacttgttgaaagccttcagctcgaccacctgaatatagttaatttgtttggtcaggaaagaaaatcaactcaaaataataaaataaacagtagtaagaggaagatatggagatgctcatcacaattcaaagtagaaaagtaacacagcttatgtatataatactgttctccacaccatgtcattccaatgtgcatcagggcatttatattataggagactgaactaaccattaccctcttctctcaccatacaaattacacatccaaaacaaaactgcggttcagagcatcagagaattattactcagttgtatttttttattcctgaaaatcactttgcttctctcaaagtcacaaaaccccaaaaagaaagaaggttgtaatcacctatgttgaatcaacctactgaagccatgggtcctggcttatttaactccataaatatgagatatcttgtgcaataacgagattattaaataaaaaaagaagaagaatattttgtcctgggagtaacgtgaaaagaaaaaacacaaacctttctcgccgagtcagacgtcgtgaactccttccataaatcctaaaaaaggatgaacacaaacgcgtagcgcaattagtccaccgaacactccacagcagcaaagcaaacgaagagctgaaaccgcggaggcggaggcggtggcggaagactcacctcgaccttgtcgagcttcccttcgtcgagcaccttgaagagggcgaaccccgcgggcgtctcgaacagcaccagcatctctctcaccgcacgagaacacctacacctggatcacaaacccaaatcaaaaaaaaaaaccacaagatcgaaagcttgggtcaaaccgagcagctaggatatatacaccctcaagaaaagaaaatggcgcaaaccttggctcgattggacgcgaatcgacgatggggggaggagagcgcgaggcgaaggtccggctgcggcgagatggtggggagggggagtaggcgccgccgccgccgccgccgccgcgagggtttagagcgaggtgttgtgggatgcggcgggagagggggtgccggcggcgagagggttttagggcttgggcttggggggagtttttatacgagggagcgggcgagacttggtggcccatctcaccgttggttcggcctggtggagatcgtgggccgttggatggattttttttcattttaggtcgtgggagtgggactctggtttgcggggcccgcatgggcttcttcctcgcaggagggaactttagaattagaatggagctgagaggcgacaccggctacgaccaccgccgggcgcgcgagtctctccagttatggatgcaagtccgcgaacccgtttatatgttaaaatagtgggcaactcacgcgggtaacctattaatttgacctaaatatgtttatgggacgacccacttatatctttcgatacggtaagatacggtaagctagaccataataaggaagccaagatttaatatataagtagattcacatgtcgacccgcttgcttacctatctccagctgctcatctaccctggtggctctaccaccactactacagacgtcggtgaacctctgccaccgcgagactccaacgagcattctttctgctatatcatccctgcgagtttgacctggtgagttttttcaattcaatatcctcaactcttttcggtgctcagaccctccatctcctttcttccttgactccgtgaacatatccctgtctacccttcgaattcctcttgcactcactctaatctgcctctttcacttcacattacaaatctcctaaacttctggttatgttcgtaactagagtacttttatgttctatctgtgggttttgagttctctttcgtaaccgttcttatattttttatcaaaaagtctatacaaaccattacgaaaagtaaaaaacaggtcgaaacctgtatgaccaacccactattaaacaggccaccaatcatccgtgacccattaaagctcaaatatcatctcatctgtttaaattaagagagtaattatatttataacgtcataatatttaaaaaaacagtcgatatgtatttatattgtaagttcgtaaattatatatataattttagtgcatttatgatgtaagtctgaaaaattacatatataattatagtataagcacgatgtaattagcacgcgtgggatcgtaaacaaaatagcattgaaaaacacggctcaaatcaataatgatggagtcggcaacggctgatttgggctcaggtggagttgagatccagaaatctcatcattgctcgcagatcgaatcggcaacgacaactccggtgaaatggtgaatcataaacaaaagtaggtcggaaaacactgctcaattcgaaggaaatgcaaagaaaatagcccagtaatctcaccaaatcatgctccaagttttgccgcctccaatcaaaagaagcctgtcgaagattaggcaaagcgaactcaaatctatgcagaaatcggggaaaatcaaatcgtctctccaagcggaacgcaagctgtcgacaaataaatattcaaccggagaacagcagggaacagtaacgtggacctagttaattagcaagtacaatctaaaccgagagcgctctcgatttagtattaaagagcgacgcatccgtgagagaaggtttacttgcaactggtacacttacgtgagagatggtctagttgtttactattgtacaaagtgtatctctttttttcttcttatagatttttctcttaaaatatttattcgatctacaatatgactacaccattgtgttagttggtacacttacgtgagagacgtacgtgagagatggtctagttgtttactattgcacaaagtgtatctcttttttttcttcttatggatttttctcttaaaatatttattcgatctacaatatgactataccattgtgttcgttgtaattaaatatttataacaatatcttacatgattatattataataaaaaatatttatattgtaaattacttttatcatatatatgtaagttacttttaccatacgtataaattacttttaaatttgattaagttactttttagacattcactgaacaatatactttactttatcgttagttctataatatgttgattagatttaatttctagataaacttaggtttttacctccataatagatttacttttgatatcgtgacaagttactttttttacttttttaagttacttctataatatatgtaaattacttttaccatttattgaatttacttttatatatctaagaagtaatttaatgaaatctaaaagtaatttagatatattataaaagtaaattgtatttttcataaaaaaaatattatcatgtgagattttgttgtaaaaatttaattgttacgaatacaacggtgtaatcggatcatagatcggatgagtgatttaaaagaaaattctataagaagaaaaaaaacatgcactattgagtgtactagtagcaacaagagaagtcgttggttaagacagtctagcttacatctctctccatcccataatataagggattttgagtttttgcttgcactgcttgaccattcatcttattaaaaaaaaaattagaattattgttttattttctttgtgatttactttattattcaaagtactttaagcacaacttttcgttttttatatttacacaaatttttttaataagacaagtagtcaaatattgcaagcaaaaactcataatcccttatcctatagaaaggagggatgctagcatggatctcaaaaaccatctaacggctaaaaaacgaatgatggaaggcttataaatctgtcaaatgatagttagcaattccgcttaataccactaccgttcgtatactgaatttgactttgttgaacggtacattatgtgtgttgtacgaatttgatcaaaatagtgtgccgtgcatacgtttttttttctttttttctaaaacaaagtagcaggaaaactcaaagcactgccaagcgattctacacgtctgattctgcatgtccttcgattatctcaatgcgttcatctcgtgtcgttcgactgatgatctccatgtttatctcttgggcccttggggcaatacgttttatatatgggcttacgtatccttaagcaaaactaaaaacaaaaccttatttttttaaaaaaaaacaaaaacaaaaaccctaggtagcagccagcacacgctctccaaacatggcgccgccgccgccgccgtgcgagagacggccagtaagcctgagcgatgacatggtcgccgagatcctcctcctcgttcccgccaactccgtcggccgcctcgccgccgtgtgcaagcagtggcgccgcgtcgccgccgacccgaccttcctcgcggcccgcgagcgccgcgcgccgccgctccagctcctccgcgtctccaggcggccgtcggactcgaacggcaggcagtacgacgatgccgagctgagcgtggtcgtccccgccccgctgatctccggcggcgccgagggcgaggaggcgcgccgccccctcgcccgctacacggcgtcgttccccggcggctacacccactgcaccctcctcgcgtcctgcgacggcctgctcctcttcgccgaccaccggcggcgcctccgcgtcatctgcgacccgacaacgcggcggtggtcgggcctcccgccgcacctgtcgtccgccgcgctgggcttctacctccaccggccgtccggcgagtaccgcgtgctgtccaagggccccgatccgtcgcgcaagcacagctcgtcgtacttcgtcatctcggccggcggcggcggcgaaccccggcggcgcgaccgccgaccagctcgtggagagacacccgtgctctcacctgggccacgtcgccgccggggggaagctctactggatgggcgacctcgtagaggccggcagacacccgcacctaaacccctacgcccccgcgaagctcgtggcgttcgacacggtgtccgaggcgttccggctggtggcgccgtcgccggagacggcggcgaacaacggcgacgacgacgacgtgctgatgttcgagctggacggggcactcgcggtgctgaaaggcggagcgatgtcgacgctcaagctgtgggtgctcgacgatgacgtcggcggcggcggcggcggcgacgccggcgagcagtgggcacctgtctgggaatgcaaatatagctgcatgttaccagtctctacgccggcgagcgtggccgtgtgggatgacgacggcggcggcggcggcgacgccggcggcgccacgttcacccggcgtcgcatcacgctgtacggcgtggatgagacggcggcgagggggagggcgctccacgtgttcgcgtgcggcgcgcgcaacggcgggttattgcaggtggcgttcagggagaacacggtggcgcacgccttcttcaagatgcatccgtcgccagccgtgcgcacgtttgggtttctctgatctcgagaggcggctgcgatgatcgtcgacggtgcacgagtggaattggtgtgtaatttattgcacatggaaaattgctggactcatttatattttttagactagatgtatgcatgcagttttaattttgtatgttttttaacatgcacaagtactatttgttggaaatagtgcatacttagccattaatttagcatatacagcaagcataacctacttgcgacatgataggacaagaaaaactcataaattctatcatgctagatatcaaacaagacataaataaccaagccaagtaagttattaggctaatcacaatggtaatctagccgcaatattttaatctagatgaacagtaccatgcatatacaaaactcaggtacgaacaaaactagattagaaatgcaccggttcctttcctttgtaaacgaaagaattcactcactgaatggatcgacggagatcagcgagtcgaagcactgcagtcaatcgatgatgtcgagcggccgtgtagaaatacgctgcccagaaacctttacaccgcccccgtgcaggtgcgaatgcggcgaaggctcggagacaccgctcgccggaatgctcgttgcacgatgagcaccacggccggcttggatcgacggcgacgcaacacggcggtagttgaggaatttcagagtagatggctgttgtgttctgtgtccttcaaagacgtctccttcactcctatatagagctaacaccgaacggcagcccacgctcaatccgttgctcctccgcgtcaaagccggatcggctccatgagaaacgcagccgccaaacggccacaagcgcatgttctcgcttcacatgagaaccaagtcttcaggtgattgaatcgatcagcagaggttgttgtatgcaagcatcttttcatccaacacatgcttatcgtgcgactaagcattaggcatttaaattgatgaaatgatcaatgtctccaagcatgttatttccatcactattcattatttttgttgaaaaatgctccacctagccgcctctggcatttcctcctctcttacaccgggatgttgaagtgcgggtttggtgaggcctgcaccacgaggacataacggcatgtacaagggttgttaatcactacttaaaacacacacaaatgatatggtattataggtggcggaacagttaaaactggttcctatacactttttctcatccccgcgggaaaaaaaaatagaaccaacacttttcaaaactatggatgccggttataaagaaatactactgacaccaatactataagtgtcagtttacttagaagaaacaacacctataatatattataggtgtcagttaattagaaaaactatatgaaaaaaaaagagccgagcctatcaaccacccatatatcccgtcttgtccttatccctgtaaccccccctctctcttgaccctgctcccttgccctcattggcggcagatctagtggtccttctccctctccaccaacaagattttcttgtggcagatccaatggaggcgatggcatcgttgctccagcgagcggatccagtggcggcggtggctttcccggaggtcctctaccacctccattccccttccgtcccaagcttcttgcacggcagatccggcggcggtgacaacttgttatggatgatgttgttgttgttgtgttgttgtgacgatgattatgatctagagttcattgtggattgatctaatggttcaaagcgtttgattttgggggcgaagcagggtggatgtgctcggtgccccccctgtttttcatcccgagaaccttaaaggtgccggttcctaaactagcatcttcgaggtgactcaaaggtgccactgctaggtgttagttgggaaccgacaataggtgccagatttcttaatcaaaactaacacgctttgtgtggcactgaatagtgatctcttactcttcctaattacgagtgttcgttgatatggaagagagagaaagaaaagaggcaaacaattgttgctactggtaacaacggcttaacaacgacacttagcctctagaacatagaaacactcttgcatgagggtgaaaagaattgaaagaatagtaataaaaaacaatatatttccgttcccatcactactaccaaaaccatcattcgtggcggccattttgggttttcactggcggaatttgaagccgtcacaaagcaaaaagccagtgaaaatcaagatcttcgctagcggttatcgaccgccagtgataattcattttcgctggtggtcgtcttaaggcagccgccagcgaaaatccattttcgctggcaacaggcataagacgaccgccagcgaaaatgaattatcgctgtcgggttacaccatgccagccgctggtgtaaatgctggccaaatttttttaaaaaatgatggacggagcgacaccgctccgcccgcctccatcaacgctccaccattcaaaaatttcacagaaatttacccaagcattctaaaattcacaaaaatttacattcaaaaatttccattcacccaagctttcaagcatcacaaaaatttgaagtcgtcgtcgcggcacctcccccatcagcattggcagcagatccggcctcccaggtcatcgcggcggtggatccggccacccctgtcgtcacggcggtggatccagcctctcccgtcgtcgcggcggccggatccggccggccccgatctcctggcagtagaggcgacggcagcccgcggcgatggtggcgacgatagctggtggcggtggaggaggaagagggagaaggagagctcgccaccggatccgtcgcctgcgtcgtcgtcgtcaccgagactagacgtcgccgagcctgctggatccgtcgcgccagcaccgtccccgctgcagagcccggtcaccgccacgacccatcccctttgccaccgccggagcctccatctcctgcgccgtcggtggagagggaggaggagagggctacgcgtcgttgggaagggaggaggagggaagagtggatctggaggatagagtggatctgggagtgttgagaggaggggatgggagggcaggggtggcgcggggagccgctggtcactgccgccagagccgccatcgccgtcgccggtggggaggccgggatggaggaggagagaagaggaggggtaagaagaggaggggatgtggagagaaggagaagaggatgaggtaggtgagtggtttttaatgtgagggatattgggtacgagctgggttttttctggcggttctgtttattggccaccaggaaaaattcgaccgtcagcgaattatatattttcgctggcggcgcacctaagtgaccgccacctatcagggttatggataccacatacctaatagtagttgagtaaatctcggcaggacccaccacataccatgtcctatacggaaacaacctgtggatataggaggagttccgaataaggaaagacaaccagagttctacatggaaacgacaaggactactcggattgtatccatattggttttcctagttctacttagacaaggggacacctatgggtataaatacaaggccccctaggaggagaggggacacggacaatcaacacccacaatcaacatacatggaacaacagatgccacaacatacaagccaacatacgccaagacaagacgccggatatcgacttcggagataagcacggctagtcccctacggtgtctccggatactgtcaggagagactaaagcgctatctctgatctcgccgggcatggattcgaggaggaagactaccctgttgtcgactatgagtcagaccttcagaccgccaagtcgacaacagttagataggctacccaaaatattgtactggtgtgattatggtgaataagagtaatatcggctttggccaacaggatgtagggttattacctgacaattcaggggcccgaacctgtataaaaatccctgttcccgtctcttttacctcagtctcgcgtataccctggtaccaatgatctccatactatgcaaataccggaatcgcaacatcaaacgtcgacaccaccaaaaattgacatttttttgctggcggccgctttagacgggccaccagtgaaaattcattttcgctggcggtcggttcccccacccccttgttacgactttgctggcggtttttacatttttccgccaacgaaaataataagccaacgccataaaaaatcattttctaatggtgaattattataaagatatgatctctaaataataatttttgtattgtcttatagactatatacttgtctctaacatcgagcatcctctcatcgacgtgctcgcgctgctagtgcttcctaccaacgacatcttgtcacgacgagaagccaagctggctagattggctacactttcaaagcttttaaattttttgatgtttctacggtcatcgaaacttgatatttgtggcagagaatgccatcttcttaccccgatgaaatcccacgtattgttgctcgctagctaagaatgtctagcgaacttagccaatttatagtgacaaaataatggccaagtagattttgcccccgagaagatatcctctcgttttgtacatagcgtttaaaatttttgaaaaaaaaatcaaaatagatcaatatataatatatctttccacaaacattcaagttaaaatttgaattatacaacgcaaacaaataacaaatttgaccacagattacgcattatattcatagtcaaatttcaaatttgttgtttctcttctacttttacatattgaatttgaacatacacatatttgtgaagtaatatatcatatattgatctttgttactaaatgtctttaaatttttgataactttttaagcgacatgaaaaatcctaaaggtatgaatggagtagtttcccaaataatggcaacaatatttgaagctgaatgtgaatcgaagcaagtaaatataggaaaaacatggtaacctacgttttcttttagccacttggaagaatggcgatagaacgggagacggattctaataacttgagtggacgtccacccgtttattgtatgtcaaataaatggttatgaaaaaaattcaaaaaaaatgactagatagatcgatatttaatatatcacactataaacatacaagttcaaattcaacttctacaagttgtaacaaaaataacaaatttaactgcaactatacatgcatatactaatttaagttttatttgctttatttttacaatttatagaagttgaattttaatttgcatgtttgtggagtgatatattacatattgatctatcttgtcaattttttttcaattttttttcataactatttgaattacatgtattaaatgggtgaacaatcaagagtttcccgatagaacgtgccgttgttgattctattgtcatgtaccatctccctgggattgcgtgtcacgtatcactgctagttagcagcggaaaggattggagagggctacgcgtcggacgtccggatatttgcaaatctcctgatgatgttgcattatatgttaaaatatgttgcaatatttcattgctcgaaaaaaaagtttcaacatgaattgtttttgggattgtctgtatatctgttgatagaaaatctcacttcccatctttcaaattttgaaccatcggatacactttgagattcgtgcagaggtattaaccctaacactcctctcgttcccctcccctcgctcatgtcgccgccgccactccctcccatcacgcattccaccgccaccgcccgatcccccgccgccaccgccccgcctcgccggctggccgaagggcgtcaacggcgccgtcgaggccccccggccagccccttcccctccctctcctcttctttcctcaagcggatggcggcgcactgtccccgccgccgtcttccccgtctccggcggcagggcaccaccaccggccgcctcctcctaatacacccttctgctttgcccccgccgcctacaccggcccatcgccagcttccgaccccgcggcttcggcggcgcccgccgccgcctcgccgcccaccttcgggctgccgcctctcacggccatccctctaaaaccggaactcctccctcttacccctccccctcccacccttcccacccccacctcaacccgggaccctaacccgtagggtcctctaccggagtctagggtgtcgccggcgctggagaagaagaggaggtcgccagagttggaggagaaggccctggagcacgaatcacaaagtttatccggtggaccaaaatctacaagatttggaggtagattttctgtcgacagatcgttagcatttccgaaatacttattggccacatcttaaagaaaaataatcggagttgccagaaaacttcgccaagttttttttcctagaacttttaaatttgtgactattggagagttgtgcatgatggaaaaaaccgatgcggaaaggaaaaatcgggcacccgtctctctctcgtctgttccccgtatctgtgttccagcgccggcggctgttcgcggggtggtcggtggcggcggcggcgtcgtataggagggtgaggaggcggatgatgggccagcttatggcggcggcagctatgcaaaggtcattggtgacggcgttcgagaaggagcggagctgggggtcgtccttcatccagaagcactggacgatgcaacagctccggcgaggtgacccgcaatcgtggtgaccgcagtgcggcttgctatagaagtctgtcgctgttctcgagggttctcaagggttggatgttcgagaacttcctccgcgcgtaagctcaacggcctcttcagccggcgatgcaacagctctcaagggctcgatgttcgagaacttcctccgcgcgtaagcttaacggcctctttagccggcgatgcaacagctccggcgaggtgaccagcagtcgtggagccgcagcgcagcttgcaagagaagtccgtcgaggtgaccagcagtcatggtgccgcagcgcggcttgccagagaagtccgttgccgttctcaagggtaagggttggatgttcaagaacttcctccgcgcgtaagcaatgtttcggctagtgtactcgtgatgtttttctatgtatggatcaaatgttgcagtggattttaaatattgtttaatgggtctgtctattcatttgtcgtgtgatttctaacaaaaaaaaatcacccaaattttttctgcctttatatttacatacaacgaactacaaaagaaaataaaaaatacatatttactcacacattatttttataaaaaattatagtgcacttacatatcatatcaactgaatttacaaatgtaattttagttatgtaggactgtaattttatattttaaaatataattttagttatataagactgtaattttattttttttaaaaaaataacaaatacatatttacttataccaaaattacagtgcacttacatgtcatatcaactgaaattacaaatataattttagttatatatgactgtaattttatattttaaagaaaataacaaatacatatttacttacacattagttttatcaaaattacattgcacttacatgtcatatcaactaaatttacaaatgcaaatttagttatataggattgtaatttatatttcacgacgacgagagggacggtgtcgctcgccgaatagcgttggtcgtactgccggtggccggctcgccggtcagaggccaccttgccaccatgtttctctatcatggtgcacgcgtgggctagctgacacagtccgtgaccgtgagctgcagctcacatcacaagtggtgcatagcgtgcggccaaaaaaaaaagtgtgaaatgccatagaaaaattcacacgggagatggatagcaaaatcgttgtttaataatatcatcttgacggatacggggtttattgttgtacatggggtaagtgtttcaatgactttaaatcgtttgttgcatatgttgatctaatttttttcatctagcgatctgaccgtgcttctctttttttttaacaattgaaacattctttcgcaattgatgaaataatgctttttatagggtgaagcaacgtccgatttaaaaaatcgggcgcccgatttataggggttcgtttaaattttttttgcacacggatcacgcgccaccaaaccccgggactcgacgccgacgcgcccaccacccgaagccaatttgatcccacgtcacggggggcgcctctgcgtcgccgtcggagaaaaagctacagtagctggacaaccgggatccatggtgctacgggccttccgctggcaagaaagatcctgtcgtccgaggcgttccggctgatgtctcgtccgccggcgacgacgaggcggtggggaacacggacgtgctgctgttcgagctggtcgacggacgggacacctcatgcttctggagctgcaccagacgcgccgtcgccggagacgacgacgacgacgacgacgctcgtcatcaggggtgtgggcggccgctcgaggacaaggatgcatgcggtgggcgccgtggccgccgtgtgggaggacgtcgatcgacgaccgccgcgccgcggcgctcaccacccatcgtcgcattgatatcaacgggggtgctggacacgacgacggaggcggcggcggcgaggagggcgcgcggcggcgcatcttcgcgtccgacgcgtcgcgattcgcgttcagggagaacatcgcggcgcacgcatggcttcttctcgacgcatatccgatccgttccatatgatgtacgtactagatcgacggtgcatacgaggccacgtacacacaaacaaactacggggagatggattatattagtttgagatttgtggcatcagttttttttgtgtttttttaattatatgatgaggattttttttagataatggaattatatgatgaggataatttgttgaatggagttaggtattctgtactttttgtttagcacaggaaccatcatctcttacgtcaccccatacgtcaccggtcgccgtcgccgtcgccgtcgaaccatagagaagccaccgctcctccctccctctcgactcccgtcacctgtcatccttgatcctccctcccctccccggcaacgctccttagtacgccctcgacaacgaccactcatcaccatctctactcctcttgacaactcgctactatccctcctttttactacattataaatcgttttcattgttagaccctgtttagatgccggcaaaatttttcaccctgttacatcgaaagtttggacacatgcatggagtattaaatataaacgaaaaaataactaattatacagattgcgtgtaaattacgagacgaatcttttaagcctaattgctctttgatttaataatgtggtgctacagtaaacatttgctaatgacgaattaattaggcttaataaattcgtctcgcagttttacaggcggagtctgtaatttgttttattattagtctacatttaatacttcacatgtatgttcgtatatacgatgtgacacgtcaaaactatacactcctgatctaaacacagccttatacaaaagtttgatcaaacttataaaaacacattaacattcatatagcatcaaattaatgccattatatcttaaaatttgttactatttttatgttacttgattaaatctaaatgggtttgactttgaaattaaaacgacaaacggaaatggtactacccaccaaccgagatgcggacgagactccgctgactttgtgcagtttgcagttgtggcaccgacatgtgggccttatagccctgcacaaagttaggggatctgtttcctcgagatgttgggcgcctgacacgctgaccctactcccccggacgtcgtcgtctccaaccaacaacaacggcttgtttggcaacttgaggtaaaaggattgagagtttacacgagggaattgatgatgagattaaaatgggaatttgatttttatcccaatatcttgtttggtggaggtggtggaaattgataggaagtttagttggagattaggtcattaatgaaaatggatggctgtgatttgtttaggcaaagtaaaggaggaattccctcccaattaccacatctacccaggtattgaaaagggggacttcctttctcaattccctatcccatcacgccaaaattcacatgtctcataaccaaacaaaatactccctccgtattttaatgtatgacgccgttgactttttaacaaacgtttgatctttcgtcttattcaaaaaaatttatgtaattatcatttattttattgtgacttgatttatcatcaaatgttctttaagcatgacataagtatttttgtatttgcataaaaaatttgaataagacaaatgattaaacgttggttaaaaagtcaacggtgtcatacattaaaatacggagggggtatttaatagcctcatctttctaaactctcaatcccttgtaagagcaagtacaatagcaggctataaaccagctataaatatattttaaagagataaaggaagagagagaagagcagcgagctacagatttgtagctagttgcaacacggactacaagacgtaatgtgtatgacatgtggtaccaggtattaatagtatagtaagcaactattgtatgaattggctattacattggttatagatgatttggagctagtagtgagttatactattgaacttgctctaaaaactccctccgaccaaatgggccgcaaagacagtgataaataatccatgtgaggcagtcacaggtaaaaaaaaaaaaaaagcttctctaatcctagctcgtgacctgacacctgtccagatgtgaacgaatcgagcggaggctagcgaagtagtagcgagtgtagcatcttctcgcgcgctggtctccccaccgtctctttcgccatttgcacaattctctcactcctctttccccctcccttcttcttgcttcttatcccccaagcaataacgaggcgtcatctctctcgtcatcttctactctccctcctctagtcctcttcttcttctactttgtacgcgccactcactctccgagcttgacggcggcggcggcggcggaggtcgtcgagtggtggtcggggagatgggtcaagatgaggtggaggtaggtgcggagaagaaggatcaagaactaccggaggtggaggtggtcgaggaggaggaggaggagggatccaagaaggcggcggcgggctgcgactactgcggcgacgcggcggcggtggtgtattgcagggccgacgcggcgaggctctgcctgccatgcgaccgccacgtgcacggcgccaacggggtgtgctcccgccacgcgcgcgcgccgctctgcgccgcgtgcgccgccgcgggggccgtcttccgccggggcgcgggcggcttcctctgctccaactgcgacttctccaggcaccgccacggcggggagcgcgacccggcggcgccgctccacgaccgctccacggtgcacccgtacaccgggtgcccctccgcgctcgacctcgccgcgctcctcgggatctcctactccgacaaggcggcggcggcgaccgcggcggcggggggcgacgacggtgggtggtgggccatctgggaggagccccaggtgctcagcctcgaggatctcatcgtcccgaccacctcctgccatggattcgagcctctcctcacgccatcttcccccaaggttcgcttttacagccttctactgttcactgtccgaaaaaaaaaaatcccccccttttctgaatcaacttctatttaatttactcccatttatccggcttaattcttgtctgctgcaaaagattcagaactcgccggatgggaaggtgaatgaggaggtcatacgacagctaaccgagctcgccaattcagacggcggcggcgcgcagatttgggctcatcgcgaggcggcgcaggccggcgatcatcagttaccttcatggggaacaacaacacaacacaacactggacatggcaatttcggtactgcaaacagcaatgaggttgcaaccatgccgacgcctggttatgaggtttgatctacaatcttcagcatatctgactaatttgcagtgctgtttaccctatggatgtacttttgtcactgcaattgttagtcaagcgataaatggtactagattggtagtgtccgcagaatcttcgtctgaacggtagaaactatacagattctgtatcatatgcggtgaagatattcctaggcatgctttgctgtacctatgttgatggggaatttattctgtagtgtcaactcaagcgctagcaactcaagatacatctgagtcagaataaagtcattctagtgaagaacccctaaattctctttctctttttcagagagaagaagccccaaatttgatatgattctgttcttttcctatctattgtcatattcgtgattttgtgtaagattcttatttggtttacacctactgacacatacattaattttttaaacctggacaaggataccattctacccattgattatttattgacagtcctgttcagatagggggaattgtatccacactgaaattggccatgaaaaacgcagagtaggcctagttgataaagagctaagattttgattgtcagttcttttgcgcaaaatagatgcttacttggctatctattaatataactttatctatatggcagaatggtggatgggataacagcgattaccctgcgctaaatgatccgtgcaaggtcgagttcacatatgagcaacctccagccagctcagctgaagcatgtatttcatcatttgttcagatgtctgaactttgccccagcatgagcaatggtagcagcatggaggaaacccaccagacaaaccctggaaatggcacgccaatgcaagttctacccaaaatgccagaatttgttccttgccccgacaggaacttggtcatttctcgctataaagagaagaggaagacaagaaggtgacataagcttatggcaagcatgatgtttttatttcctcttgaagcttctcttggactcttacccaggatttttcgatttgaaacataactgtgtgacaatgaaattctaattattgcagattcgacaggcaggtccggtatgagtcccgcaaagctcgtgctgatagcaggctgaggattaagggccgttttgctaaagtcaatcagatttgagccttcatttctgtaatatattttgcatcttggacatgagtaatactaattaggaccaagcagatatagtacaagaaaaaatatcagcattttgtatgtaactatgtacccacccagtggctacgccacgctgaggagaatttagtttcatcgaatctctgtatatagtgttgcatcgaactcagtgatactatttacatgcaaaggatattgtcattatggctgtttccccatggttttactgcaaactgtctgctgtgttactactgcaaaagctctcctttgatgaggatcagtaaaatagtgtcaaattcggatcgcagatatgttgacattggagaggacaattctgtgttaagagatgagtaactcgtttcatggcaaaatggttacaaaatatttaattccctgtaatcggcttgtcagtttgtcatgaatcatgaattcgtgatgctagaggataaaacagagtctgctgcataccagaagctaatgaaatagttgatgcacgacaaatcacagtaatctgtcaaaagattagctttgatttatttatatcataccagatctgacacagcaaaactatcctcctttggaattaggcaatgcattgtatggtacaattgaatggctaatggcgtctgaaacattaagaacaactcacatctctacaaacactctggatgaagtagtaatttacaacttacaagcaccaagaaactggcaatggcagccaagaaggcgagcgaggcctagaagatggtctgctcgccgagctcctgccctgccatgccttccctgatcaccctctcgaagaactgctcgagcgtgtcgctgccgtagctgggcgtcatctcgtcgctgtactcgccggtgtccgggtcgagcaccagcatgctctccgacgcgtagtacctcccgatcttgccgaactccgccgcgtcctccaccccggggaacaccttggccagcgcgtcgagcacccagatggcggcgtccatgacctggatcggcaccttgatgaacctgggctcgcgccccagcagccggaacagcatctccccttgctccagcggcgtcagcgccttccccggcccgccgatggggaggatcttgttggccttgccctcgtcggagatgcagtcggcgatgaacgcggcgaggtcctcctcgctgatgggcttgcaggcgcagagcttcccgtcgccgaacatgacgtagggctggccgttcttgacggtctcgacctggccgcccaggctcttgaagaaggcggtggggcggacgatgctgtaggtgaaggacgggtcgcgcgacgcctcggcggcgagctcgccctcgaacctgagcttggcgcgctggaactcgaggagcggcttctggacgcagacggcggagaggaggacgaagtgcgcggcgccgaggccgcgcgccgcctggagggtgtgcagcgtggcgcggtagtccacgcgccacgagtcccgcacgccgccgccgcggctggcgaggcagcacaccgcggcgtggatggggccgtgcggcgacaggtcggcgcggagcgcgcccgcgtcggtgacgtcggagaagacgacgcgggcgggggcgaggtccgcgacgacctcgtcggggccgttgcggccgcgcagcccgctccgggggcgcgccacggcgaccacggggtggccgcggcggaggagctcgcggacgacataacgcccgatgtagcccgtggcgcccgtgaccagcacggtggtctccgacggcgccagtgaccggaacggctgcgccgccgacgcagcaggcggtggctctaccgacgaagcaaggaaaggccaaccccgacgggcacccttaggggcggcgttggcggcgcggaaggagacgaagcttggcgccggtcgagcagtgggggacgtggtggaggatgaggaggcggcggtgaggtgggaggagaggaggagggcagccatggcggctgccggctagggaggcggaggtgctcgacggaatgcggggagggaggcggagggcgacgtggaggccggcagtatcagagcccggccggcgagcgtttgtggtggtggtggcgtcgcgaccaaatccgagagcgcgattgcgctgacgtcactttgatattttcattttcattttttggattttggaggagcagcctctcatcaaagcaaccccaaaaaaataaaaaaaggaactcgccactgggctgaaatcagcaaagctcaatgggcctcgctgtgaaggccacaataacagaggcccactcagagcccgtctttccaaggctttattaaagcgagaggactcgatggccccgagacgaaaccctagccttcgccgccgccgcatcagttggcgatcgatgcttctccaagttccgtcgtgttcaaccgttttcgttcgatctcctctttctgattttggcctctttgtcactggtttatcgatggcgttgtttgtctatccccatttgtttctctcggtggttttttgttcatctttgaggttactgtgatttattttttccttcctgcaatacatcgtcttgatttggaagtttatggattggtcatgctcttgttctgtgtgtttttttttttgttgttttacatcctgattttcgatctagcgattgttgaatcttggagagttggtggtgttggccggtgatgacagcgtatggtatgagcctcagtaactaatctgcgcatcgggtagtgataaacccgggttattgacggccaagattcatgtgccaaaatgctaatctgaggccagccaaaccatctctcccttgagcaacttaccttacttcgtttccatatcttaaataacaagcgtaaagaaatggcgagctagtgttcaaacccaattaggaatgacatctgaacaagcagaagattgagaaatgtaacgcagacaccgggttgatgccagtatgccactcgcacataaattacgcaacatactccttatttgcaggcacagtagtacttttgagtttttatcataacttttaatcattcgactttgtttgcgatttactttgttatcaacagtattttaagtataacttattcttttttatatttgtactaatttttatatttgtactatactggacggatgtagtagaacgcagcgctgtaaaaaaaaattgttactttgttcaaaatggttctaatatggtccaaaataatcgctccaatcgttacgaggtaatcccgctgccgcgatcaactgtgtttgatcattacataccgccgccgtaatgatcttaattatcgtcgtgcctaagagcaagtttaatagcagagctcactacttactagtcaatgctataatagcagagctctttacttacttactagttaatgctaaaactaacatgtacagtagattagctataaggttatctttattttcttcatcctctctctttctttcactatgaatttaatatataatatttggagcttgtgtgtagttagcttttgcatgatagccaatactccttacttttgtttatctctcttctatataaatatataacttgcttatagcctactattattcttgctctgagttgttcacgcattgctgattgcatgttgattgctggtggcgtggattgatctctcgcttcgtgtggtgaatccgtccatgctggttgctggaactggaaggctgaacggctccttttgctgttgcctagaacatttccgctgtcacattcctttgttccctcgatcgcacccaaccatttcgttgtccgtgacaatctgttccaggtttcaaccaagagagggcccatggccttcgtaatcctcatcttaaaagctactccctccgttttaaaatatttaacaacgttaactttttagcacatgtttgaccgttcgtcttatttaaaaaaagtttgtgaaatatgtaaaactatgtgtacacgaaagtatatttaacaatgaatcaaatgatataaaaagaataaataattacttaaattttttaaataagacgaatggtcaaacacgtactaaaaagtcaacgatatcaaacattttgaaattggagggagtatatcaccattatccaaatggagaatcctataacaccattatccgccgaagcatgaattcgacttctttttttctttcttgaagattatcagttcctcttttgcatatatatttttttctgtctcgtttaaagttcatttttcacgggacagcaattggtagcgtattgtttcacgcaaactggatttcctttacatacacttctgaccaaattatagtactccgtaaaagtctagtagaacactacacggccattctccccagcgactgcacaataccaatttttcgccttcttctcgggacagtcggttgctcgctcgctcgccgctactcccttcgtcactagaaagaggacgtggttgcacaaatcttaatactatgaaacttaatactttctccgtttattttataactttgacaagtttaaaatttaactagctaacgttatacagacaaatttggaggtaagggcggtggctattgttcaagcccaattaggaatgacatctgaacaaacaaaagattgagaaaaggcatacaccggattggtgtcaattgcacataaatgcgcaatatattagcaggcacagtctgaatacgagcatacgagtaaaacttatcgctgtacaaaaattgttgctttgttcaaaatgattttaataaacagtgtttgatcattgataccggcgccgtaatgaccttaataatcgtcgtggctgagttgttcacgcattgctgattgctggtggcgtggattgatctctcgcttcgtgtggtgcttgaaacggcggctccttcgctgtcgcctagaacatcttctcacgtgacagtcctttgttcactcgcaccaccaacatctttgatacttcctccgtttcataatataagttattctagcatttctcacaattatattaatgctaatgaatctatttatattgatgttaatgaatctatatatttagattcattaacatcaatacaaatatagaaaatgctaaaataatttacattgtgaaacgggggaggtagaattcatccggcccatggcctccgtaatcctgatcttgaagctaccggtttatccaaaaggagaatcctatatatcgttattatccgccaaagcgtgaattcgacttctttttttcttctttcttatagattatcgattcctttttgcatattattttttttttctccttttgtatcatcttaaagattttttttcattggcctgtatccggtcgggtattgttctacacgtatttctgccgaaatttatttagatagaacactacatggtataggtcattgtcccacacggctgcacgataccaatttttcgccttcttctgccgtcctccggtcctcgggacagtcagtccgtcggtagctagcacctgctagcagacgtatgaccaaaacaacgctcataacccacgtgaagcggaaacaccgagaaaaaccgcggaaaacggccgaaaccaacgagtggattgtaaatcctcaaaaatacatttccttgttatttacatataacctactaaatagttattttttaaaaaaattaaaacaagataaattattatatgataaatcactccataaacatacaagttaaaattcatcttttataagttgtaacaaagaaaacaaaataaactataactagtaaacgtatattcacaattaaatttactttattcgttgtaatgtgtaaaagttaaatttgattatgcaggtttgttgagtaatatatcatatattaatctatcttgtttattttttaaaaattttatcatatactcgtactatttaaatgaatcgtacttccttcgttcgataatataggagattttgatatagatagtgtaagtgaaatatgaaaatatcttatattaggagatggttggagtaaacagcaatgctcaatccattgttcgagtagtttttccccgaaccaacgcaatccacacgcgacgacgccgcgaaccggcgcccaatcgacgcacggcgcgcggggccgtcggtttttggcgccgcacagccacgcgtcggcgcccgccgagtcagcaccacgtcctcctcctcttccgcccagatccactcccacagtatggccgccgaccgccgcgtgggcccaacatctcagtcagcgccaacgcggtactactagctgcctgccgggtgggccctccagcccaccgtccaaatccacctacgtggccgcacccgcgtccctacgtgccgccttatccacaaagaccacagacctcaccccggttggtgtggagtggggcccacgctgtcattcggtggacgaggccggtgcgggccccgcgcgtcattggatggaggaggaagcgagcggcggaggaaaaacaaaaaaaaaaaaagaacgcgaggccacctggcgcgctctgtattattgcggctgctgctcgccgtgccacgtggcactcgactggcgcttttttcggtgtttttctttttgtttcttttcgcttcgctgtgaataaatacgaggcgaaaaattaaaaattcagtaccaccaaaccaaacccaaacgagagagagaagaacacacgcacaccccgagcgaacgcaaaggagcgagaagccgagaagaaaggagcaaagtcgcgatcgagtgacgtaagcggcgacaatggaggctgtgctgatgcagcaggcagcggcggcggcggcggtggttgcaaggccggcgaggcggcggtgcaccggggaggaggtggtgggtggaaggcgaccggggttggtccggctcggatttgcgcggcggcggtggtcgaggctgaggctgagccccgcgcgggcccacctcgccgtcgaccggagcagggaggccggcgaggaggcggcggcggtggtggaggaggagggggaggcggcggtgaggctgttcgtggggctcccctccgacgtggtcaccgccgacggccgcgccgtgaaccgcggcaaggccgtgtcggcggggctgcgggcgctgaagctcctcggcgtcgacggcgtcgagctgccggtctcgtgggccgtcacgcagccggggcccaccggcgacgagctcgggtgggcagggtacctcgccgtcgccgccatggtccgcgacgccgggctctgcctccgcgtctcgctcgacacccacggctccgcgctccccgcctgggtcgcggcggcggcggccgccgaccccgacatcctcttcgccgaccgctccgggaaccgccgcgacgggtgcctctccttcgccgtcgacgagctcccggttcttggcggcaagtcgccgctccaggcctacgaggccttcttccgcagcttcgccgccgccttccatgacttcttgggctcgactgtcacggtaagcgaaatcaagaacaccttcgtctcgttctcgaagttgcagtgtttcttaatactagtttttgttggattctgtaggatgtgacggtgagcttgggtcccaatggcgagctcaagtacccttcgtatccgcctgggagcgacggcgccggcggctatggcggcgcgggcgaattccagtgctacgacaggcacatgctggcgcggctgaagcggcacgccgtggcggcggggcagccgctgtggggcttgtcggggccgcacgacgcgccgcggtacggcgagtcgccggagagctccaccttcttcaggtccccggggggctcgtgggagaccgcgtacgggggcttcttcctgtcgtggtacgccggggagctcctcgcgcacggcgaccgcgtcctggccgcggcgcgcagggtgttcgacggcgagcccgtcgagctgtccgcgaaggtgccgctcccgcggtcgcgccccgcggaggccaccgcggggctccacggcgggtacggccccgtcgccgagatgttcgcgcggcgcgggtgcacggtgatcgcctcgggcatggacgggtccgcggcggcggcggcggtcctcgcccaggtcaaggccgcctgcgcggagcacggcgcgcggctcgccggcgagagcgcgtcgctcgccgtggcgcgcgacggcgacggcgcccccggcgcgtggggcggcctgctcgccgccgagcgcacgcggccgtgccacttcacgtaccagcggatgggcgcggagttcttctcgccggaccactggccgctgttcgtgcagctggtgcgcgccatggagtgccccgaggaggcgcacgaggacgacctccccgccgccgccggcgacggcggccggctcgccgtgccgtccggcggccgcgccgcagaagacgccaccgcgaagcaggcgcagacagtgtagacgcagctggcacgctgcgactcgtagctgtacatatgtgcagtagtaataccagtatactgctgtaattacagcagtacaatttactattactactccatttttattaggaaaatcagcggtaaattctcagtgtgtagctgagaattatgagatggatgatgccccctgtattagtggggtcaaatgagtatttgtcaaaaatggtattttgtaatgatcttatgatcgagatgagagattgtattctagtgatgctattgcatcattgttacctcaagaatcagaacatgagacgtgtaccccaataattcttttgtccatgacattgcaatgcttatacgatgatgattgatgcatgattaacatacgtaatctgcatgattagctcgcgttggaagaacacgagcttcttatcctcaactgagattaggtccaacaaaatactgcttcggattaacaaatacacacagttttggctctcagatacatcctgataccatggtaaccactagtttcttactcagtagaatttataaggcccattaggcattataaaaacgctcgactcaaatcaacaaatgattaccgtatgtattcgtcaacatatagtagtatatacaagtcagaatgtgaagttcaccgctgaaacgtttgtagcttctctcgcttttgccctttcccaaaaataatttaataaaaaataattaccattttacccttccaccttccatacctgattgcccttttaataccttttttcaggtaccttctctctatcatatctgatcaagggtcctaattaatttcaagcattgaagaagatctctactaacaaatcacacaatccacaacactgcttttgacactgttctcagcactgcagcctattactccatgtattacactaatttaaagaacacatcaagttgcaacttgcaacacacaacttggcatttttggctacacaagcctgccgtttacaatgtaaattgggggagattaaaaagaagaagaaactctctaggtttcaacagccggcaccgcccaagaatgtgtaacaattagaaaaaaaaaacaaactagaacagaattacaagccaggaggccagaaagatcacaggtggctattatgtacactgcagcagcagcatccggggcagcaacttcaggagatggacttggtgtttttttttctgcccaaatccaaacaaatccttgtgcttcaatgtcaagcgtgactcgtgcacgctacgcctgccgatccagcttatcatgcttccacggttcgtccttcatccagcacctgcaggtacattgcattcgcggccaaaaatcttgattaggatgcggttcatctgattgtgatttagctgcatgaatgcagctatgcctggacagtgatggaaaacaactgcgcaactgcagcttaagaggtatttttgcgagttccattggcaactcgtcagcctataaaccaaggctaaatttgaatttttgaaacttaatttcagattggtctacgtggttttcttattgttttctatttaaaccgctaagagtagaaacataaaatccctactctaaaattatttttctttgcttcgtgtcacgtttcatggcacataaaccgtacccaagcaagtatgcaactgtagtttacagaacaggctgaatcagtagtgattacggagctaagggtaaaacacagagggcagctatcatctggtgcaaattgcatacatgtgttgccatctattctcttctgatgtgacatcccaacagaaaagctcgatttgcatatgggcagaccgatgaattcagatatgcctaacagccagctcagattttggatcaactactgctctactagtactcctaatctgactatctagtgtctgaagtttggaaggttctgaaaatgtgagtcagctttcataatactgttgaagaaacaattaggtaaactgaagaccatctagataaaagcaagtattaagtgtcattatatcaagcagggtaagtaaccatgtgtaaatgtcgatagtagtaaagctgaatagagagaaatgatcaccttatctcattcacaggctattttggtatcaaaactgctcagacagattgcaaatgattgaaatgctgatatcggataacggtagtccatggtgaacaagtccttcccaatctttccaaactggagaatcaccttgtcctgctcctggttagttggcccattttcatcagacgccaccagctgaaagtttttcactgaggcaacagtaacccgtccacggaagttgaggcaccaacattgcagttgctcatgccacctaggagatttattcttcagaaccagcttttcttccttctgagtggataattgtgaagttgcactatctattcgagctgattttgatctgaagaatgaaattgatgggaaagagtcgaggccactgagaggaaattcagtctgtgtcggagctttcccaccctcttgaacagctgatgtggggatggaatccataatgcagttcatccttcttggacctctgcaataggaatgcatcacaaaaatcactgcaattttctacgaagtattgtagaagcagtcaaatctagcatgcaaagtcaatcaacaatgaaaaggttgcgtatatggaattatgacagctggtcagccgccttctctatataattattcctagccatgtgtgctcaaataacagccagaaggctcacggagttgtgatgttatcaccacttttatcattagagccttttcttaaaaaatagattcagcatgtctaattgatcaatcatgcaattgcagtaatcaccactgtgattctaactatcgatgaattcacatattaaggtctcaggtgttgatgacaatatttaccaatactatccatagatttactcggcataacacaagtgctgattcaataccttgcacccaaaacattcaattcgtaggaaatatgtgaaactgggtaattcccggcaggaactctcggggagacttggttcagaccaaccacacgtgcagaccgactttttgagacaacagctccatcatatggtggatgggcatcatagacggtaaactttgttccgagaaagtttgacctgttaaaacaaaggtggttagctggttcttttaattgttattgtaggctatatttttagatctgtaagaaacaaacaaaaaaaagatataactgaagattaagtttgagtaatgcacttgacatccaaatacatacagttttgttctaagttgaatgaatagtttagatgtgaaatgcatagcacttcaatttcttgtactttccaaattctaacacttacagcaaaaggagagggggaaaaatgccatgtgatgcttttatatgaaacagcctatagtacatctaaagggccttccttacacatactactaaagaaactaggaacaaatttagctttagcttttcagtgatgaaatctcaaaagatcaccttagcttgccaatataggtgttgctcccctttgacatatcactcatgtcaagggaaatcaggtagtctgtgcatgtgggcttcctgcatttgcgtgcagcaagtaggaacttcccatcatcggcaagtgctgtaaaaagaaacttcccgaaaatagtaagcatatatccattatacgccagcatagctgtacttaatttggcgtaccaggggtggataaacagcataccttctgtgagcccaatatacagataatatgtctgagtagtccggtttcttcttatgaaacatttaagagtgccgtctcttgggccaggctgcacatcacgtagacttgagtaaattaggactaagatgacactaaaatgaacttgtcaaccaaaggttacagtcaatgaagtggcgtcaatttctacgaaaatgacagcagagaaatggcatttgatactggaatatcatgctaaacatgtgaagcaccgcaatcaaaagggaaacggcttcatcagatagcatttatgcatccatcacattttcttgatatgcagtttgttttctagcccaaaactagataaatcacataagggagacaccttccaaaaattaaaacatactagaatgccatggttcacaacatccattaaaaagatgatttggctgcttgcaatccatcagagcaaagccgacatacgcaacagcgcaacagaatgcagggctttcatccttcaccgcttgacgaacgcaattcagcagctaaccaatcaatcataaagtgttgacacaatgaacaaataattcctaaagattaaacaatgaagcttcaacacaatgaacaatcaaattactaacagttcgacatcgcaaccgggaatttcagaatgaaacgagagcgcgaacctgcttgagcgagatggggaaggtgagcttgccggacgcctccgggacgcggacgatctccttggtgatccccctccagctccggcagacgccggcgcacgccaccacgtccctccgcgacggccaccacacctccgactcctcgatcctcaccagcacctcccggagcagctcgggcggcagctgcgcccagcagctctgctgcatcgccgccgcctccgccggccccaccgccgccacccgcggcgcgccgccgccgccgcggtgggaccgcgaccgcaggctgtgccgcgagatgctcccgaactcgtccctcatctcctggatcaggctcctgaacgacatcttcctcctcgctcgattccccctcctaatccacacctctcctccaatctctcaaatctgcaggctgcaaccgcgccaagaaaaacccggtcacgaaatttaccaccaccatttccatcaaatcttccaccaaacggaacgccaagaatcgcaagaacagggggaggaatttcaccgtactgaccgagagacgggccgagctaatttcaccgtaatgtctccatggcgtcgccgcccatgccggaatccatcgatgaacaccaacaaggcaccgaactgagctggaagcaagcagggcggggaccaaatccctcgacgcagcaagcaagaaatggcagaaatcctcacgcggaggtaggtgtctccgccgctgaatcccagaatcaatccaagggccaagaaaaccaccaccagctcgaagaagcaagaaaacggctcgaattcaagctctcaacccaccaaacagaacacccaacatttatccgaaattgagcacgaaaattctgcaatggattcttggctggaaggaggaggcggagggagcaagaacaagaagaaggcagaggcaaagattccaagaaacgaaaggcggaggtgaggagggaggaggaggaggagcaggtgccttgggaatttttaggtggtgaatgggtgattgataggtggtggtggtgtaggaaggaatggttggggaatgccagtatactagtactacctatgattgctactacacaaaaaagggaatggaatggagatggagcttgagagcaggtaggattagggttcctccctccctcttccttccttgctgagtggctgaaaaagatgggcatctcacaactctccctccctccctccatgcacacatccatctatccatccacacattcattgtagcacaattaattaactaataaatgtgtgtataagtacagctgactagtactaatccactcgtttcaaactataataagggttggctttaatatggagtaaatattaagaaaataagtagatatacaaatgaactagctaagactatatatagaacacatagatggtacaaccagaatggacaatttactgaataaaatcatattatataaataatagggttttatatttataataatttcgttttaaaagttattacttactctatattttactcctacagtactggttaactttgcatgagaggcgaattataatactaatagaccacacttgtggaaaagaagaaaccaaattatcaattattttggcatgacactctgtcccaatgtcattgtcagggcagggatgatgccactatagccaagggaagcatcattgctcaagcttaacccaagtagtactagtactcctcatgattgattgcttccatctttgtgctaattaggcatggagtgcaggacacttgactgtacctgcccctcactttccaagtgtgagtgagattaaagcacaagaaatgaggatttctttttttttttcaaggtacaactctgccagtttggccaagcaaaatgttggtactatcatctttgcatcatcatcatcatccacctgaggaaaaacagtagaaggtcccttttaatgttcaggtgaaaaacatgagatgttttattgggcttttctgctatttttctttcacctcacatgtgttagtggcctgcatcaaataacggggttttttttttgcatgcatcccttacatgtgaaggcagtggtcgcgcgcggagaatcgagaaagtaaatgaccggcgtcactgcctctcattctaaccacaaatagttaatggtcaataaaataaaatgagttactagtaatctctttctttttctctcaaaaaaagttactactatttctatttacagaaaaaagtttattcccctgtatttatactcaattgcatacgcaccccgtttataaatattacttcattgtcatgatctttgagataaaatatagagcttttattctgtaacttgatgattccccgtatgttgttgtaggatattagcttaacattggtgtaagctttggtgggaaaaatatactacttgtgcacacagagttgcatgatgcaaagattgtaaaaagttgcaataaaacatgtggttatatgatttaaattaaaactttactttagtgttgatttccggagttttgatcgtagtctgttttgcagccttagcttccaaatgctagtagtaataaacatgtttatttataatttataatttgttatttttactttttggtggtttattcggcaaagcttaagtaatgagatattgctcgtgcaaattcgtatccccttcatccaaaagtaaataaactaagtacaggatatgatacatactactaggataaaagaaaaattaaaatacgaggttagtttattccaaggctgagagagtaggacacactagatttttcataatttggtccttttgaaaaccttattctacaaatatacctctgaaaaaacttattctagaaatggtcttttttagagcgccagagttaatggtgccgccccctgccaccatggcggccagatattgacgtggcaaggggagcgcaccagcctctctggcgccacccccagctccgagtcgggatgctctctctctgctctcctcaaattcactcgaaattatataggtaagagagggtttttttatgtaagaggttgttttccgttgtttttgtttttcctatattccaaaaaaccaaaaaaatagtacattgccctttttacatcctataaaaaaaatagagtttgttgagtttttctcttttacattcaaagtatcattccttaaaacaggcataactttctcatacggactcgaaatcgagcaaattatatatccacggacatgtacagaaaagttacatccgattctccatgcttctttaggtttggaaaaattagaaccttcaaattccgcttgaaagattttgtttttgaggcgagaagtttttcggtagagttttagaaaattataaaggttgcatatttcatccatttgagtttaacttttttatggttggttcttgtggactcttaaaaatggttttaaaaaaaaccatttttgggataagttggttcagggagtctatttttaaaataattttttggaaaggactaaattttgtaaaaaaaaatccaggtagaacacatcggtttgttcctactactagtagctctatccccatatatacgctggcacacaggatcaggcagctgtctgtcctggcatcacttgcacagtgctaccggtggcagctgtaatggagatcgtactagtaccgacggacgagaacgcaggaggagcaagagccgcagacagacagacagtgcagcaatgcatgtccgaggagggtcgccctgcaacttgcgtccttgcgtgcggccgccggatgatggatggaaatcgtcaggaccatctgcctgcactcgcaatcggaatggtcaaaaaaaaaaacagaggattcattccctcaactagagaaacatgacaagagggtgagcaggcgtgacaagagaccgcgcccagccacgctacgtcgtcacgggctctatccagttcttctctcctctcctcttcggcagcacggtagtattaactcctggtttcagtgaaaagctttcatgccgctttcattgctaggtactccctccgtttcagaaaaaactcaaattatagggataaatctggacacatggagtttgattctttttggatgaagggaataagcactactcccgatcttatagggatgtggcatatcctagtattcctaatttgaacagaccatgtcacatacctttaaaatcccttatattataggatggagggagtagtaatggtgaacatgggcttgccctgaagactctagcggtggtgtgtttggttggttggatgacggatgagtccttatttttgaaattcaaaggaaatttaaacgattgtaaggttttaaggtgtttgttttggaaacatgaatcattcatggaagaaaatattccctcgtaatgatatgacaccgatctcatacatcaattgtatcagctcacgccacttgtgtacaccgctcgtcattgagactcacatgttatcacaccatttatatacctccaactaaagtaaaatacgttcttaaaaaaaagaacccaaagaaaaataatggtgatcctatccctttaaccaaataagagacgagaccatcctatcttatgtcgttctcaaactaagcgtgtgctagcatcttttttttttcaagctttgagcttgtcggagaaataatattctgctataaatcacaaatggatatgagttctttgtttaggactggaattggatatgtggtgagggcatactagtatttatttgttgttaaatttaaccaatttggtattgccaaaattgcttacactttggttacatttagcggggtccagacagcgcttatccatttcgtggcttgatggtctaaaagaacacaagcatccttccaaattagttgtacaagattccaccctccattatatctaacatgaatcactgtacatattaataaagaaggatatgcataaatttattttaggagcaagatcatgagctacttgacctgcattaataattaacctttccgaattaaagaagcgaaacaaacatgtgaaccttttccttcaaaagaaaagtatagcaacatgtgccttttttataacagaaaaaagggttgcaaaatgagtggcacactacaccttttacttgccttgttgaattttatagcttacttgtgtttgtggatcaaaaggggcacactcaaagaggaggagatcaattgagaatattgccactggtagtatattactccatgatccgtgaaaaagtgtggatacacctttgagtatctcaaggacttgggtaaagcaggctagaagaaaacaaatcatcaaagttgcctttccatttggcgacgcggattcgctagtgtcatcatcttcacaaaaactagcaaaatactctgtgttgcaccgggctataattatattagatgaactaattaaaactaaatcatcacccttaagctcctattaacgatgataggataaacagtgtgttgtgtacactgtacctgaagcaaatagagcttctcactctagtacattgttggtcaacaatgacgagcccacgagatagatggtggcccccatttgtcatatagatggagtgacagaaccaccaccactggtatcttttaagatagtatagaaatatatatattctccatttttaaatatattagtgtatgacacaattgacttttagatatacgtttaacctttcgtcttattaaaaaattaataaaaaatataaaaacaatgattcatgcttaaaatatattaataataaaaataaatgatacttgtatagtttatttaataagacaaactgtcaagctcattcctaaaagtgcatttttttttagaaaaaaggaaagagtatcacttaacattatattttgtggaagattgttaaagccacctgacctgcatttgtaatgtagatccaccctcggttcaccatgactattgtaatgttacttatttagtattctaagtgccgacgaatgatggataaaactaagttcacgcagttatatatttgaagacaaaaacgaatgaattacgtattagaaagttaaaatggttcatttaaaatagttctctaagaaataccactgttcttttacaaaacaaacatacggttaggagcttggaaggtgcgcacaacgagtaaaagtaaacagctgtgctcttcatctctctttggggttgtattttggaagagaaaaacacaacgaattaattcagaagaaagagacgaaaatgcaaggtgcggtggtgctattgctcaccctgcgaccgaggttgcccagccgtttcggttcggttggggagtcgtccacatcttcgttaattcgccggccgatgcagctggtgaccgtaagtaatcggttgagacagggcaaaggatgagtcaagaacaagaagacgctgctgctgctactgctgaacaaacctgagtacggcagccatggctccaatgtcgcgtcgcacgtgaaatttttggatcaccttctccagcaaacgtattcctaaggctcccagcagctcatgatttgcaatcgcaccaaacggcaattatgcttgaaaatgcacccagaaatcaaagacgggaaagaagagaaagatggaggatctgagcgtgataagtaatccctccatccaaaaaaaacttaattcccaaaaaaaaaacttacatagtttatttaataagacaaactgtcaagctcattcctaatttaaacaatttgtccagactatactacgagggatcatatatctgcgctatagcggcctctgtacagtccgagttagctctagagcttcgtcggtaaaatctgggcaggcgatgttctttttcgagtaaataccatcaccggtccctaaacttgtatcgttgtgtcatcgcggtccctaaactcgtaaatcgaccgttcaggtcctcaagcttgttcaattgtgtcatcccggtccctaaaattgcagatcactcgtttagattctccaacttgttcatttgtgtcacctcggtccctaaacttagatttgaatatcatctgggtcaaataggacggtgtaaagattttatatttaaaaatatttcataacgttttcatgtgaactctaataaagataaactttatatcaaacttgtagccctcgacactttatagttgatttttttattttaagtcattttttgtcccacaatgtaattttaaaattaaaatttcaaaatctataaacatgcaacaatattttgggaccctaaacagttttaattcaaaaacttatcaactacaaagttgtaggtcacgtcgagggctataattttgatataaagtttgtcttcattagagttcacatgaaaaagttataaattatttttgatataaagtttttagaccgtcctgcttagggaccggggtgacacaactgaacaagttggaggacctaaacgagtgatctgcaagtttagggaccgggatgacacagtcaaacaagtttgaggacctgaacggtcaatttgcgagtttagagaccgggatgacacagcgatacaagtttagagaccggtgatagatttactctttttttttaaactcatgcatttaattaaagttcagagagagaaagtacgtgagtaggtacagtgctcagagcacaggtctgcaagtttagggaccgggatgacacagtcaaacaagtttgaggacctgaacggtcaatttgcgagtttagagaccgggatgacacagcgatacaagtttagagaccggtgatagatttactctttttttttaaactcatgcatttaattaaagttcagagagagaaagtacgtgagtaggtacagtgctcagagcacaggtcactgggatacatccagttttgcaaaggagcccctcaagattgggcaaattacactttaagacaacattttgcagaaaaggacttaacaagaaatcgaaaaagcaatcaggtccttctcctttgtctgccttcaacgctgccgaggagttcttgaagctcggctctgatggaggctggatcaagatgagccgcttaagattaagccaccacagaatcccggaaggggcctcacacacatggaggtttggatggtgacaagcaatggaagaaatcagcatcatcacatataaattctaacagagctgaaaaagaggaacaacaccaaggcagtgctttcaaagatgataaatgaatacaccagaccagcgaaaaatccaagaaaaacatagcgatctgctgcagaaaccaggaggcgaatccttatggggcctccgcgcataggaggttggaactgcctcggtggagcttgaaaacctcagacgccttgaaagagagtttcgctgaatattgaaaacaaggctgccatctttggaaggaggtcgccggagaaagaaaagaaggccggcgctacctttgactccacaagattggatgaacccccgatgaaggcgcttaatagacacccagctccaacgaagaccgtcaccggttctgaaaccggcggcactcaccgtggtaccaggacgagggaagccgacgctgacggctgcctcggaagccaaaagaccgaaaacaactacgggagaaccatgaccatacgggaagacccgactaaaactacaactaatagaggggtggaggggccggacccctctccatcccttccacggcggcgagccaccggggaggaggagggagaggggccggaggggacgaaggattcctatagaaaggattcaagagaactctcgagagaggaggagaagggtcccccctgtctagtgagctcgcaggcgatgttctttacggatgattggatagagtacgaatgttatagtgacaaattgtatattagtatatgtattatagatctataaaataaatttgcttagaataagttttctaagcaatgcggatacagaaaaactttgggtgaatacccaacatgatccttgaactcaggggcagagctagagtgaaatggagggtggtgccacttagttaatttactcactttagatcaagtttaagcttatgcggatgcctaagtttgtattgaggagggtgcatatatggtgaaaatagatgagg

SEQ ID NO: 73593 - DNA, 4365 bp, Oryza sativa
agcgtcatggttttttactcttgcaggtatataagctgctaatagcattgcataattgatggactttcatgtttaaaagttatatttttcctaataaatttacatttgatgactcatgttgattgtctttttagaaaaatatcatatgggtgcaacatatcatagacagatgttgtctaagatatgtatattttcttcgtttttattgatttacatgcaaatatgcaacaaattatatgaatatgaattacagggaatgatagcttgatacacacaaaatatattcatcaataaattcttaatatttcataagaaaagagcgagccgatgaacattaaattaaaaagaatgaaaaaaaatcttacttttagtttgaaattaatttgtcaagccagtttttagcaaagtaatacacatgcatgcccgcgcattgcgcgggctatcttcctagtttattgtaaaaagagatacaatgaacacccaattaaaaatagaatacaccttactctaatttcagtttattttgttagaacgatttccaaaacctagttccatctaaactctggatcggaataggactctgaatcaaacggaatacgattccatcttgtgaagacagaagacggaagcgtggtcgcgattcgtcgccgccgccatcggcggaggtggcggaggctagcttcgagcggccaaattttgagaaagcctcttggggcatcgaaatttcagaaatacatgacagattctggaaaattcaagggagaatgtagcatgccgacgagcctcgatgaactattgaagctaaatcctactgaagctagcagactacgatgaattattcctgtcttgcaacccaagagacgcatgtcagcaacagcaagtcccttccctctcaaagagaggacaacaacttcacagtgcttgatcaaaatctcctcgccattttccttgttgtcatcttccccttcaaccacatactgtgtgtgttatattacctcggtttcattttgtttgacgttttaaaagaagaaaaagaagatccgttttgtttgatgtttctgacagcttcgacaaatttaatagaaaaaaaaagaaaaagaagattacatcgtcattctgaatctctatcggacgaaccggggacttgctcccaaagttttccaggaatcattggaggcagatggtgtaatttttcttgcacttggcgtttgctgccttaaaggacaagtgcttgatcttgacgctgtcttcacacggatccacgcgacttctcttccggacaccgaaagaaatcgaaaagaaggatgcgacatcatcgtcgtggtagcgcagctgtcgcatatccaaaggccttgccttggcggcggttgacgcagaggcgccacctcctcaccacgagctgagccggagcgccgccgaggcgagccactcgtaggcgccgcgtttgacactttgacccaggccagccaggagctgagggaggtgagcgcgctggctgcagctccctcgccgggacgaacaggtggtggcggtggcgtcgccatgagcagatcgatgtcgcgccgcgtgttcttgattcttgagagggttcttggcctcttgcggtcttgccttgcctccctgccctcccggagcgcgcgtccgtgttgtcggcggctggactctgcacgtcgcagcagagcgccgccctcttgccggcggcggcgggggtggggttggagtgagctccggtcgccggagggattgaggttggggctcaggcgagggaaggcgagaatgaagcaaagagcagagggtataaaatataaataaccgtcggcttctagaagagatggaagcggaggtggcagaatctggttgggttgtccggtccgggcccaccagtaatgtggggaccagtcttgtcttatggtgcacgtctccgcctccgctgcctcatccaggccggcgacggcagcagcaacctctgacgagacgacacggcgtaatggcatggcgtggcgctcgcgtatcctcgccgttcccccgccgcctctgaagacgtctcggtgcaggatggccgcccggcgatcgagcagcatgcctttgcgccgcgcaggtgcagcgagtgcctcatcgccctggctggctgccacggtccgtagccagtcgtggcgcacggtgcaccacgtcgttcggcctcgatgtcggaaacgtgtccagctagttcatcgtcgaggctgagctcgtctgcagcgccagcgccgtgtacggtttcgccgcggtgccgccggccaccgcgtcgaacgacgacatgacgatcacctccgatcaaacctgcggcgccaaaacgcaacaacctccacgttcttcttaatcgcaagcgaagcgagacggatagagaggcattacctgatcgatggagcatggccatgagcgctgtgaccttgttccggagatccttcatctccgacggcgagagctcgggggcagaattgctctcctgctcttgcgggttcgagctggccttgtcggcggggtcgcctgcgtgccgaggctaagcgacaccccgcgccgccgcgtactgcaccacacgggggtggcgtggcgtggcgtggcgttgcgctcgggtgtcctcgacgtgcgcgtgctccatgcccacgcacgcgctcccccgccgccgccgttgaagaggtctcagtgcaggatggccggcgatcgagcagcaccttcgacgacgcgccagccgtggactcgcctggcgccgcggcgcgcatgcatgttatatgtcatgagaccatcgccatcgggcacgatcacaaactacgccatcagccaccatattcatcggccacctccttcatcagccaccatataatacttccttcatctcataatataaggattttatcccttctaattatcccataatataagaactttttttagaaacaatataagagatttttgtgtagtacttatcaattttctacctattttaaccccaactacccactccccataaccaaatctcttttaatagggatattttattgttgctatcattaattttttaaaaaattatcccttatattatgggtgcgttattttagagaagtagaaatcagaggtagtctatcgctcgtgctctatctctgcatttagttcaccatcccacgccagaattaagttggattctttttattttgacattagttttgagttggattgtgagctgtgcttgaactgactattaggccttgtttagtcatatcccacccaaaagtttttaccctgtcacgtcgaacgtttgaacacctccataaagtattaaatataggttaaaaaataagtaactgcacatattgcgtctaatttgcgagacgaatctttttagcctaattgcaccatgatttgacaatgtggtgctacagtaaacatttgctaatgacggattaattaggcttaataaatttttctcatggtttactaacggatactgtaattagtttttttattagtgcccaaacaccacatacaataccctatataatacccgatgtgacacgccaaaaacttaacacccctggatctaaacactcccttagttcctaaatttttttcccaaaaacgtcacatcaaatctttagacacatgcatagagccttaaatatggataaaaagaaaaactaattgtacggtttacatggaaatcgcgagacgaatcttttgagcataattagtccatgattagctctaagtgctacagtaacccatatgtgctaatgacggattaatttggtttaataaattcatctcgtagtttccagacgagttatgaaattagtttttttatttgtatccgaaaaccccttccgacatccagtcactacgggagaaaccatttttgctaggttggccaaaaactacactagtcccattcaaaagaccagggatacttttttttttatctttagtcccggttggtttttaatcccgattcaaaacatggcaggcgatgtcagacccttcactactaaagatctatttgtaatctcgggtgttaaacaattgggaataaaattcggccccgagcgcacaacccggccgcctcttcctctacaatctctttctccttctttcctctccctcaccactcacccccatctcctcctacctctcctgcgcctccggcccctgcggcggcggatcgaaccagccgcgcggcggtggccttccctcccgctgattccgctcctccctctcctgcacctgcagcccccaggcagtggaacgagctggtctgtcggtaagcggctgggcggccgaggcctctcgtggcggtggcccacgcgagggcggcagtggcctcccctccgcctgatt

SEQ ID NO: 73594 - DNA, 2033 bp, Oryza sativa
agtgggcagcaggtttacagcacacgtaaaaagtccacagagaaaagatggaagatgccgggctgtgtctgcaactgcaaaccacaaccacaaggttttgctcttgctgctaatcttgcattaatctgctatgtctccccatccccaagttggagtaaaagcagacgtttctagaattcgtgtcgtcgtgtccgtggttaattacatacactatttactatagtagtagtacttatcttccagggatgtggataattacatgttcacatcgatcctgtggtgtaaacatgtctctacatccattgattcatggcgcacacatcacacacagcggcaatgtatctcctaacatatgttttttttttctaaaagaaaagatggagaccagcgacatatttataatatcactaaaatcatattgaaattttgcttgtgtgtgtaatatttgtggatatcagaatttgaatcctgataaatggagtcatgcacttatgatttcaccatcataccaccgatgcttcttctccggtgttttagtattttttttagtacttgcatgcttgtattttatttatggatatgggagtaaaatacaatgccaaaaaaaaaatgcttatttgtaccattaagatatggacataacttaattggtaaggtttgttttggtatgacctgtctatccaaatctgagtctctccaacttaccacggtagatgacttaagttgtgtttgattgttgatagcaatggacctcgaggcacactaatgatttatgattttgtaaatctttaggtatgccggttcaacctttcagacatcttcatagtggtagaaaattagtatgcttataagggttagtgtgtacacatgtatataaacgtatgcgattgtactgtatttttcatagaaagtttcaataattaaagatatatctcttttgtaccgtgttttatgagaggtttcaatagttaaagacatctccatgtattcaagagcaatcacaccaatgcctaggtattattctctatctaaaataaattaaattttgcatataaatctggatataacctatatctacattcatatataaaattttattttaaaacggataaagtagagtgctgcaacttaaatttcaggtctcactgtgtgcttgttggcttacaactgtagccaaattttagtttctttatcatggtctatcgtcagccttcgcttttaaatcgctaataatacaggtataaaaaatatattttactcttaaattatctttgattcattcgtttaattctctatggtttattattagcgcaccatttcttgcataggatttgttaacacatatattcttgtaaaatatttttactctacaacatatggtcacacatgcaaaaaaaaaaaacatgttttttcagaaaaaaaacacacatgagataagtcgttgtaggattgtaggacacattgtgggtgcacttaacccatgaatgctgacgtcacggacagcgtctggcccacggtgggccctaggtgccacgtggcccaatcatgcttacccaaacagccccaaaccaatgtttcccgtgggagaaaagggtaacttttctggccttgtcaatctcaatcactttcacacccacgctaagcatgatcttgtgggctgaaatctctttcaaatgactaatctacccctcaatggcaccatcacatgcttgtttaaccacaagttgagacattttaggaaagtataatttgggaaatcagagcactgaaatgatatatgtggctgttgataattagcagaagctagcaagttgagacctttttggtgggcaattttgggaaattgatcagagcccagaaataatgtggctgaggataattagctaatctagcaaagagattaaagtgggcaaggaggataagactgtgtgcctggacaagcacaagcacagacaactggacaagagggcattatataatattatattacagattaaattattgggagcatccaaaaattaattaaaaaaact

SEQ ID NO: 73595 - DNA, 6472 bp, Oryza sativa
atataagacaaccgcacgggataaaaggattatcccgtgcggttgtcttaagcggaccgcacgggataatagattatcccgtgcggcccacagcctggcgccgagatcgcctggttccaggcggagccacttacggcccgcttggaacctaaaggggtcggcgtccaagaaaatcacatgtctagtagtgttgatggcctccggtggagcaaggccaacttacttgctgctttctggcacggcaagcacgatgcggtgatccgttgacgtgtgcccaacatcttcagcatgttcatcgcctacatgtccattattggtgtatggaactattccgacgcacgtggatgagctcggcctctgatgatgagctagctggacacattcctgatgtcgaggttgaacgatgtagtgtgcatgcgggggtgacaatttccccgttggaggtagggcctcagtggatcactacccctataggactaggggtaggtccaaatatccaccagcagggcttacgggatgaggccctgatttagtgcagggtcgagactatagtgcgacctcgccacccataggacctcgaagtataagacatgcagcccactggccatcaaatgaggcagcccatgcatataccagctagccaccagaaccccatcagaggaggcaacaccatatggctgtgttctttccaccaaactgccaacctcacctctcttgtttttcgtgcgcacgctttctaaactgcaaaatgatactttttttactaaaagtttcaatagaaaaattgctttaaaagacatattttctattttaaaattttttaagctaatacttaatcaatcatgcgttaatctatcgctctattttgcgtgcggatgggaagggttcccaactcctctaaaggaacatagcctattacgttctagacatcaaaagcccataaagaaagtagcagcccactttgaaggggatataaatagaataacaaaggccaaagcaaaccctaatccatctcagtacgatgctcccggtggcggcagcacaatctggcgatcgaagacgaccgcgtcggcttctttccactcaccacccgccggtgccctagggcgtctcccccatcgtgctagccaactacgcaagcccacgtcatttccctccctctccggtcgacttcccacgatgtctttttctctcccttagttgctccctctggctgtagttgcccctcagtgttcttctctctttccaggaggggctgggtgtcctagttgcccctctggctgtagatatgtagggacctagccgtagtgcggggtcctagagaggctgggggtggggactaatttcaacccattctcccctctggctggggccatgtgaatccacaagcaagcggggatggggatgttcctgtccaacccaacctcacccaacattaatggtgggcctagacaacgtacccaaccgcattgcgccgccttctcttctcttatggcgattatttatatccttgcagcgtgtgtcatctttttctccattaagcttcatgcctcgcctcacctcgcctgagtcccagccatcaattgcaccgacgcccggttcccactagatcaacagggccgcgctacgggagggaggcaagagcaccgtctcaagaagccaatcaagaaactagacacatggacatgccatcgccactaccaccagctgttcgacacggtgaggcagctatagcttgggtgctcacaagggcggaactacatagagccatgggggttcctaggcacccggttgaaaattttttgtaagctgtaagtatccatctttaccatgtcggcaccccgtcgacctaactttgtgtaccccaagcagccaatcaggccgagcaagggcaataaaccaatagagacacatagtgatgagtattcttgtgggcatagcaagtttagtttggctgttaagtataacactagtcgataatttgacaaattgtcatgcttagagcccaacagaaccagcctcgtcaaccttatctttcgtcaaccttatcttaattggtacttcctcgtttttaatagaggatgctgttgccttttgaacacatgtatggttatttgtcttattgaaaaattttatgcaaaatgtgtaagatataaatcatgcttaaaatactttaagcgataaaacaactcacaacaatatcacatatatccacacatgtaatacatttttatccattatagtttatataaatatcaacagctcctttcatcaaactttaatcacttgtaggaaaagattgacactctatcaaacttctcatatcacaaatatatatcacactagaatgtcaatccttaagggttaaaatattgaaggtaggaggtgatcatcatcagcaagagcacttatctttgtttaagcaaaagaataagagagatattggtcttcacattttattgttatggtcagagttaactctagcatgatagttgccgagatgtgttttgattttttcttgtccgtctcctctttatacgatattcagcggctgtaatttaagttgacttgataactatcctattgataacattcttatttgtttatatctaatgttcaaaagaatcttctaataatttttatttctgttgtgatagagaaaacaactctccataaactatatatgatgctatgtttttctatacataatacttatattagtataaataatacatgtcactaaatcgtatatagcagctatcatattttgttatcaaacaatatcacatatatccacgcatgtaatatacaagaataagagtattagtgcatttttatcagtttataaaaatatttttcctccaacataaatataaaaaataataacaactgttaataatttattcacacattataacaacgtagatacctatctatatatctaaaagttgacaaggttactgcgagttgatggtcctatatttactaacacgtgaagcagagctaaaggagagtatacttatacaaattgtgcattaaggttcttagaacacccaattatattgtttattttgtatgactgatttttttttcttccgttctaacaatcctttacatccaaattgtgcacccaacggtttatagatgatgtggctcattttgatgtcattttaagattttcttttaatattcaatactattatactattaaacaattcgatactaaaaaatccataaatattttatcccttactattctatataaaaaaccaaaacaaaagactatataaattagtatatatgagctataaaataatctgtgcactaagagacatgcctaattcataattataaaaaaatataagagtaagatctttagggcaaatatagataagtccatcttctccatctgactttgatcacttataggaaaagatggacaagcctaacttataacagctataaaaagctggacacaacattaaacttctcatatcataattatatatcacactagtaaaggatgtcacactagaggatgtgtaagcttaagggttaagggttacagtattgaaggtatgaggtgatcattaggaagagacccatttaatattattcctccaacctaaatacagacaataataacaatggttaacaatttgttcacactttacaacaacgtagatatctatttatatatctaaaagttggcaaggatactgcgagttgatgatcctatatttactgacacgtggagcaaatctaaaggagagcataattatccaaattgtgttcatgaaggtggatgaaggttcagaacacccaattattgtttgtttttttataactgatttttttctcttccgatctaacagtcctcttcatccaaattgtgcatccaactgttcatagattatgtgcctcattttatccaaattgtgtatctaacggttcatagatgatgtggctcattttggttgcattttgggatttcattttaacattcaattatattaaaccattcgatactaaaaaaatttctaaatattttttaccttattattctaagtacaaatgcaaaacaaaagaatatataaattagtatatatgaactataaaataatcagtgcaccaagatgcgcacctaattcaaagttacaaaatatataaatggattggaggatctacaagaaaatactgtcaaccaaaatatataaatggatgggaggatctaaaaatgaattaaagagttcaattgacaagagcaatgtcataggataagatttatctttgcagaggactttgattgctttggtgttgtatgggtcaggtattaagatgctgaaattggtgcagagagttttctaaagagtgatgtacaagcttcggtatggcgtcatgcttatggctatacttgtaaagtgaccaccaccctcctcgccatgcttatggctatactttgtaaagtgaccaccaccctcctcttcttttgtagttaaccatctactatcgaagaagaagaagagaatatttatattaactagagaaaatgcctgtgcgttgcgacaggtggatgctattttaatcttattattgttatacaatttaattaaggtgaaatttactgtggaaattcgcttaaatcatgagctgtaattagagtctgatcgtctcaagctagtatgtgagttttttaaaagagatttcctatatgactcttctgcatttccaaaagcaaatgaacttaataaacgactcaaatacggatatatatttccaaaagtgaatgaacttgaaaaccaactcatacacatatgacataccaaagcactggtaaaaacatcttcaaagaaaaaatgccagtgcgttgcgatgggtggatgctattttaatcttattattgttacacgtttaattaaggtttaatttactgtggaaatttgcttaaaatcatgagctgtaattagagtccgatcgtctcaagttagcatgtgagtttttgaaaagagatttcttatatgattcttctctacttccgaaagcaaattaacttaataaacgactcaaatacggatatgtattttgaaaagtgaacaaacttgaaaaccgactcatacacatatgacgtaccaaagcaccggaaaaaaatatttttaatttttataatagtagagattaattaagaagggaaagatagatcttttttagacaattttctgatctgaatatttaggcagcacatttgtaattaagaatgtaaatatcaatattcaagcaaaggatctgtaattaaccatgtaaatatcaatccgtgtcacacaattgaacattcgagtaagcagaagatagatatatatgtccgacaatttcatagtttctaaatattcagtcatagcattcctaattaaaaatggaatgattgatccatgttagaaaaatcttctgatttctgaatattcaattagagcaattttaattaagctggtagaggtgtatccatgtgtgataattttccgaattctgaaaagccaaacaatgcatttgtagttaagcatgtaaaggtctatccaatcataacaatcttctgagttctgaacatcgacattcaatcaagcaaagcatttctcattgaacacagaaagatcgatccatagatggagcacctggatcgccatcctcttccggacctcaagcaccaaaagtgctcgtcaacggatcgccacggaattccatcatccaccaccgtggcgtccggcaaggtgatccaatctcaccgatgcttttcatcctaacgatggatgccctctctgctctattcgccctctccacttcttcccctgttggggatcccttattgggtgtctctctacatcgacgatgtgatggtcttcttacacccctcagaagacggaatccttgcaaccaaagaaatactgggtatcattggagatgctcctgggcttcacacgaactacggcaaatgtgtgacgcttgcaatcagatgcactaacgcgaaagtggacgcgtcttccaaggcttgcttccttgcccggtcactaccttcccttggggcttgcctctttgaatccagaagcctcgccgagaaaacctgcaccctatggttgataaggtcgcgcggcagctgcccctatggaagtcgtatttgctgcaaccggtggggtgggcatcgtcgtctgcgaggtcgccttccaagtcaagattctgcgctggacggaaggaggcggccggggacgcgtcggcaaggttttcttggatgagaagattcttggcgccgcagcagcaggaggaggccgggggcccgggcgcgggcctgtcaccctcggtgaggttttcttggaggagaaggttcttggcgcagcagtagcaggaggaggggccgggggcgcgggcacttcgccgtcgatgaggtcatcttcaaacagagcattcatggaggactcaagggtcaagg

SEQ ID NO: 73596 - DNA, 9043 bp, Oryza sativa
tttaactcatgagttaatctgcgagttaaatttaactgatgatgacatggacgaatctcggacgtccatttctcgatccaacggtagttttcaagtttccactatatatgtggtttgcactacatatttttccgtacaaacatatgtaaaatgtcacaccaataacgatgtgtgaggttggacagccaggcaaccgtgtatacgtgccccacaactaatccacacatctgtttttgtttgtcactaaatattgctcctactgattgaaatcattagccaactatatatatatatatatatatatatatgtggttaatatttgtggccactaatatatacttatgtctcaatattatgattataaacctaatgaataacgacataataaaactatttttcaagacttttttttgcattcatttttgtttaaggaaaaaaaaaaggccagcaggaggaatatatgcaagaagaggagtacatcatactcaaaggaaaaaaatatgagataacaccgataaccctgagaagagattgacactatatccatgcaacccacgttaatggtaccatatatagggatgtaaacatacaatttaactacctggataaaaactcgcttgcttagtttttacttactagtataaaatttaaaagagacaattaataggatctgggaagcaaagaaaaaccgattgctggtcacactttacatatttagtactgcttacactcgaaggattttagctttagacaacctaaaataatactcactttattttgaaacatctagtattccgtcctagaaaaaagcaaatcctatgaatctggacacgcaaatgtctagattcgtagttagaatttgattttctttttttatggaaagatactacatatctatatgacattggttagtttatttttaactaaccaacgtcataaataaaatacgtagcaaagggagtatgataattcagaatttgaaagaaaaggttatattcaaaacggtaagtatatgtaaccgaggaaagttgttaattttcatatgcatcatgctgcacgtggatcagaagcacacctaccggtccaatttacctcttcatgtaaacgtctactaataaatattgggtcaatcagaccagaacaatctaaagtcttccaaccagctgggaaatgctgcgccctcagcgttttgcgctgtcgtggaccttgccgcgtcgcgacacgtcagcccgagctggaaaacggtaggatttcgcgagctctcgcatcggcccttctatttttgcaaaaaggcccttcattttattgataatttgttttaggtatatgctctttagtttgtactgtgttctgcgttcttatgtacagggcctctacaaactgcaatattctatgcaaagaagagaaaaatcgaaaaagaggagcacggtctgaataacagaaagtgagggccttttatgaaaaaaatacaacccaaaaccccccaccccacccaaaccctagccgccacttcccaccacctcctctccttccctcgctctgctctctccatgcccaggcgagggagtccgccgcctcgcctcctcacgcgagccactgctgtcgccgcaccatcgtactgtcgtcgccatcctcctctcgctccggtcgatgcatccgccaacgaggaggccgggaccgtcggatccggtgaccccggcctcctcgtcggcggaggggagaccgactgtcaccctctctactcttctccttctacgtccggcaccgctacaacgacggccgcgcggatcgcgtgaggcaacgggtggctgctccctactcttctccctctccctctccattctcttcctttgcagatcggcggaggcttgcaacaacaacaacggctgcgtgggtgagcaatcgaggaggccaggaatcaccagatccggaaggacggcggcccggttcggagagggagcatcccgatctgtggcattgaggcccattgtaagtgtcgatggcggtcgttccttcacagtggtgagttccagggggaaggccctgctcccctgccctttctttcttcactctccccctctctcggatccaaatccaaagatgatggggaggttccatgttacagatccagggccgctgggtctattgagctcggtatcgacggcagcagcagctcgggcaagatggaagaaatgtgtcagacactgcctcctccgagagcatacaccagcgacgaggccaaagtcgatcttccgcaaccccgtctggcattataacttgtaagtttttgttctttttggtgttcttggtagaccgatgaaaatggtgatggtctgacgtgcaaattgatgaaggtagggatgatatgatgtgtaggttgatgtttgaatggatatgcactttttgcgtgtgtagatgtaatacatgttcttgagcactttacaggttttgtggtggggtttattaccgactgacaaaaaactgagatacatgttcagttatttacagtggcacacatgaatgcggatagatagaatgctactccctccatctacttttgatagtcatatttccaaatctgaaaattttatttttgataggcatatttcaatctaacaacctatcatcttaatgactttctcggatttaatgcataactcttcattcttccacacataattggctacatgggcattgagaaatgtaaatattaatgaatcgcttgtttacgaggaatgactagtagcatgtttaaatggatgataagtacaattacttatccttggtctgtgtgccaagatgaaatatgactatcaaaagtagatggagggagtattgtttttctcttctatgagacctcttaagtactaacctattaactgcttgatatatcatattgcatatgtattcatctgttttgattcaaagatataagattcagaaatcagaatcacttcagcttcagcttgcttggagcacgccggcgcagggtttcctcgacgggtcttggctctgccgtgccctcctcgcgccgccctttcatactgacagttgttcgaggttgcctcccccgctcatggcgacctccacctcagttggagttgggaagctcctttcccgacgtccccacaacacggtgaccttggcctcaacccggtgctgctacgctcagctcaacggtgagccccttgatgtggtaaatccattgatgttgtagctaatatgtcatatgtttgcaacttcttacttcctctttccttctttgatgtaacaaagaaagtataacctcggtctttttagtaaaacaatatttctctaattagtatttgcgagaactatatatttccacacttcagttaatagaagaacatgcctcaattgacgatatatgcttatgagatctcacactatttttatccttggcaacaactggcttcaaaacttatatgattttttatttccataacagcaagttcagatgcatttcatcttttcttgcgtagttccagtggagcttaattattttgaatagaattcaaatgtcacttaatatttgcataaattcggtctccattgaagcaatgtttaatatttatgaaatacatttcaaatgcttgggcatgatgcgctataaatttagatcggttagaccatgttatcaaaacgaaatgtctatatcagcagcagggaacaacatccaacaaatttttggattcaagtactcgagctgtatggactttttcctaatctgaacatattgtcgagtgtttttgactgttgccaactaaaatggaaaacttttatttcagttgaatttctctgttccaaatttgaatacttaatcattgttttctcttttctaatatgtcttgtacttccttttctcttatacctgtatcttaaatgacaccatttagtatctaattcatgtgcctcattcttggtttcagattgctcaaactacaatgggcaataacaatattgcatttgagggcctcatttttggttgccctcacctgagcatatgtaggatacagcctgtggtgagtccgatgaatttgcaccgggagtggactgctgctggctactcataaattcttcctaagcttgattttataccttatatccctccttaataaagtgatagtaaatagaaataggattgaccgttctttgcttttcattttctattggcaatccttaatgtcatttgtaatgtccctgcttgggtggttgccttttattttatatcagtaaatgattacagaaaaaagatatgttgataaagtatgtcatttgctaattccattttattgtacagcttgggaacaaggtggccgaactgaccttctgcttgcttcctgcagatgatgccgttagtacagagttgttccctctctcagcctcccaccatcttctcctgtctctctctgagcatcacctccattgctgtcaaggtgatgtttgagctcaatcggtaggaggtcaatctggttgcactccatctcatttgagagttggttcttccctttcttctctaccttacatcaagatttgttcacttaaatttcttttgttttgcttcaggtcaaagaaggttgaatatgtaaataatttgccaacatgattttctcatattgggtggtttagtaagttaacacttaataccaatcacttcatttcagcttctcactaacaagcagccaaggtctcttcacggattattgtccatggatggccaagcttttcagcaaaatgaaaaggtgaaatataatgaaatattattcccttgctccataaagcttcagatgtggagtgagcttgctgctctgcaagctgacattccatttttaaatgtagagtgtgcttgaattaatcaaagaagcagatttatatacatcacaaacctttttttttatgctgttgctcatttaaaaaaattgtgaagtttgtgctgtctattacaattacatccagccgtgctattcatcttggccaaggaggccatcgcgtccatggcattttactccttgagtgcactgctttaatgctattataaacataaaagtgaacttatggaagtccagatttcctattgtaaatttttgtgctattctcatcaaacttcatactgtaaattctgttatgtgtaattcctattgcactattcttgttgtaagattaatcataaaagtttagagatgtttggacatgttgtattgtaaattgagatttaattttctatgaggagtaaactgtatattgcagatttggtcctcttataccataatgatttttccttcactttgtttacctaagtaatgacagactctcctctggatgccactggtgcagcgcgcaaagcgcgccttcgcctctagtaaaataaattggccggaccaaatgcctagtagatacaaatcggatcatgtggttttagcccctcgattcaatcccatcctaatttagttctgattaagatgttggcgggggtgggcagaaaaagaccgaaccgaaaagaccgggaccgagaccaaaaaattcggtcatcaatttggttctaggtagtgaaagaccgaatttttttcagtcaattcggatagtctcttcgggtaaccgaatagatcgaaaagaccgaattctcaaaaaaaaaaagtctaaatacaacctacaatccactatgtttaataggattaaactctaattttcacatccctatttcttctaggcatacaaccttacaagagtctttactcataagtgcttacaattttttttaaagatttttgtgttgaaaattttcattatttatttgcatatatgaaaatgttgttgaatttcggtcaggaccgagaccgagaccaaatttgtcggtcctgatatttttttcgctgaaattcggtcttcacttttcaaagaccgaaaaaaccgaaagaccgaaggccgagactgaaaagttttggttagatcgaatgtccaccccttaacaaatcgcgacatttctttcttaagttaattccacatcattggtatacgtttcactgatggtatttcctccattacattttaaatgtagccatgagttttcgtgttcaactttgatcgaccgtcttatttaaatttttttatgattaatatttttgttattattagatgataaaacatgaataatactttatacgtagcctatgttttttattttttttttaaaaaaataaattgacgaataattaaatttggacgcagaaacgtatgtctgcgctcaaaatggaacatagagtagcatttgtggccaaagtcaataaatttatgtccattcatcgacaagacggacgacgggagagaggttgacggtgaaatgaattgaattctgatcgatcgtgccgcgttgatatgattcatcacaattcataagccatggatcgatgatggatatatcggagcttgttgctttcaccggtttgtagaacagtaatacaacattttaaggatgatgatgatgttaattaattccgctgaaattgacgaagatattccggtcccagtggcgaatctagaatgtaaattgagcgagggctcgtgtgtatatatggcagtgtgactgaaataaaataagatatgtcaactaagtattttaagatgaaacccaaatgcatatgatgaaaggacaacgcattgctttctccattttaatttgcagttatattaatttatacacacaaatctatcaagaaattggtggtataactataacatatttgtcattggcaatttaatttgggcattgagtgtttgaggtagctttccttgccataatactagatttaagctaaatgctaattagagtcattagttgctaattagaggaaggggatcatggagctggggcttgcgcactgacaagccctagcagtggatccgccacagtccggtcctggataagttgcatctccgatcttccccaatattcgcgtggtgagtggtcaaaaacatatgacactttcgataagattcagtcaaacttttaaaatctcagctatcaataatttttcaaatgcttgatttgaagaaacagatatacatatatttgtctacaatttactatcacaacatatcaacatcatagtacatactgattagatttataaatatattttaatataaaattgattgtcacaattttaaaaggttgaagcaatccagatcacaggatcgactcccctctagggtccgcgcttaccgtgggggtacggtaggggtttccagcggtagggtttaatgaattttgcctaaattcaaaattccgaaaataaattgagaaaacttattgatgtagttcttgatttgtagtggcacatggtgaataaagtatttgaaaaagagtaagataaatttaaatttgagggcaaaacggaaagtacattacaaaatgtaaaaaagaaataatgaaatgggccttaggttgcacatttttatctggcccattaaggcccataagtggagaaaatatctcctggatcctctcatctctctttgttgctttctctccgcatacatactttcaaatgtatggttgttgaatcgttgttgttgaattattatgctacgagatgttgtattgcttcgaagtccataatatggaaaagatcataccgatttttgtattttacactcaaaagttaggtttacaagtatcatatatattcttgtaattatccccaatttctacatacatttaagtgttttttttatttttttgagaacgtttctgttttgcgaatatcgcggttaccgcgccgaaaccgcgaaaccgccaattttttaattcaaacatttgaggacgaatttcacgtggttttcggcggttaccgtggtaatggccttagcgcgggggaggggtgggggcgataacccccctcaaacggtaagggaaaccctgctcccctccccatcccacaagcacgtttttttttcctctctgtgtaaaactaatcttgacaccatccaacggccaacatgaaaccccacgcatatccaaaacggtaaaaataatcgacggatttctcccttaattttctgtaaaaaatgttaaaaagtgccaaaagttcttctgcaattgcgcagggccgtaatgatccaccatgaagtttcgtgtttatcttcaagttgtgttagttgtgccgtgccatgcatggctcatactaagttacatttgatgtaaattttcgtcaaccttgaaggaagatttttttttggtggagtcctttgaattaaatcatatatttttttgattttgttggtagatttttttttatgtgtcgtctctttatccttggttagttcctgataagtggctgcagctaatattaaagcaaagacagaatctatccattatttttttttataaaaaaatggcttagaattatcaaaccttttcgcagtatatccaatccaatctgggctcagaataaattcaaacattttttgcagtatatccaatctgggctcagtatatcctgcacggcctaataaatccaatcctgggctggggctaacttcggaagcgatgatccaacgttggctgggccgaaatttggatcatgatcaatggttaccatccaacctggactgggcccaaatttgatggtgatcattggtcccaagggaaaagtataccggaggtccctgaacttgtcaccgagataaaaaacgtccttgaaccgcaataccagacacccggggtcccccaactatacaaaacaggtcacccaacgtccttgaccccagttttgatctacgtggcaactgagtcagcgtggggcccacgtggccccacatgtcaggtgtccacatcatctctctttcgcctcttctctctcccttcctcccctctctgctctctctctctctcgcagaccaggccgacgggtagggagcagacggctgagcggcggcgctgcgacggcggccggcggacggcggcggcggcgccctcttcttcttctcccactccctggaccctgccgctcccgctccgtcctca

SEQ ID NO: 73597 - DNA, 1539 bp, Oryza sativa
ttcgccgtcgatgaggtcatcttcaaacagagcattcatggaggactcaagggtcaaggccaggagaagggaagccatggagcggatcgggctggctccgcgtcttcctcgacatgcttcttgttcttgttcttggagcctctcgccatggccgtcgaacgatgggttctttgagcagctcgtgaacgcggcgaagctagacgagggtgtagtagccggcgacagcgccaggtgactccggcaagctcctcttgtctcccgattggccggtgagagagaacacacggtggtgtgcctcggaagtcgtggccgttgttgagttatgagcagaaggggtcgagggggaggagggggagaagcgaagtagccgaagagatataaatgggcgagtccacgtggatcgtcagatcaagtattttttttttaagaagaggaagaataagtttgggcttttcatgtatgagatgaagaatgttcaggatctttttgtcacacattgccatttatttaccgctaaaacattgtcaggtactagaacacattcagagtatcagattagctgcaccaatgcagtatacatggagaaaaggaagaacttaaaacacattctgaagatgatgaattcaagtagatgaacatgagcatttgtttcaagtcatcagtccaatgcagcatcggaaaggggtttgatttgttattcaggatgaaattgtgccagaacccggaaacatgccatatagcacaaaaaaaagtgtgatatatgtttcagggaaaaaaaagtttcagaatcatcgctcatgctcaaacatcaatcccaatctcaatcaatcctaataaaatccaattcaatttctctcaaaccaaatcttgaaggatcttgaatcaaatctaaatgcatatattattgtatctctatccttcacctttttattcaattcaagaaatctaagttaacatggacattgagtttccaatcttgttaatccattacattaaaaaactttttaatacgaaattatccaaaattttaaactcactgttctttttactgggactggtcttttccctgtagcgtttattctgattcctcattttaacatcgagtttgattttcgtccctaaaccataataccagatataacgcgttcctcaaattacaataccgtgcacccgagatcgtaagcagtatagtgtccgattttgactgtcatggcaagttgattcggctgagtcaatatggaccccacgtgtctgcagcctactcttcttcctcctctttctcccactcctctctattccccatatctcactcggcctcctagcgcgtccaaggacgagttcgctgttaattaactaccctgacgagttactgtaactgccgttgattaattagtgcgtgcttgctaaaatttgcagccatgggagatgtacacgctggacactacgattgacctgaaaatcagcaccacgagccgaaggtcacctactggaccgtcaaggcgttgtgcgtgcccactgacatcttcttccatcgttaat

SEQ ID NO: 73598 - DNA, 10397 bp, Oryza sativa
cccttggtcccaatccaatttcatcaatcagcagcccaattaacacacaaagcatgtatataatactccctccatattttaacgtacgacgccgttgactttttaaccaacgtttaaccactcgccttattcaaaaattttatgcaaatataaaaatacttatgtcgtgcttaaagaacatttgatgataaatcaagtcacaataaaataaattataattacataaattttttttgaataagacgaaagttcaagcgtttgtcaaaaagtcaacggcgtcatacattaaaatacggagggagtatttgcacgctgtctcgcgatcagagacgctattcagacgttgatctatgatcatctcgtcgttgtcgatatacctaaggtgtttaatctgatggatgactaattaattaatcgatcaaattgtgcgtctcctgatgctacacatatacatgcatatcagtatatcactcgtagtatatacttaattaatttcctttgaaaattgatcgatttacagacagattaagcagcaatcaggacaaattagccacaggttaactaataatacaaatgataagttcatcaattaattgggcagctagcatggagtcaaaaactaaaacttaaatgcaggtgatgacgaggccagcatcgatcgatctatccatatcacttaccaactacacatctctccttgatcataatttttcccgtcatgctgcgagaccattaattaagtagaccatccatcactgaattagcagcaacagtacgtatcgattgatgatgcacatttctaatatgtatatgtatatatatatggtcacgtgcactgatcgagatttgattcacctagacttattcatttaatttctgtgtgattatcatcaggtctcaataaggccaataagatgaaacggagatgaattattttgctccttcaaaagagcgatttgaatgtccaactccatcaaaatccagatgacatcacttggaactggtctgaatcaggtgtttactcatgcaagagtgccttgtaccaatttgaaggctcatttgcctcaattgaattttgaatcaagctggaaggcaccagctgaaccaaaaatgaaattttgggggtggttaattcttcaccaaaaaactgttacagcacaaaaccttctcataagacactgaccgtgtgattggatttgttgcctttgctcgagcgcgttcgaagatacaaatcacttgttcagtgaatgtgactttgtccgtcaggtgtggaacctagttcatgcttggcaaaatttgccaaattctacctccaatccgcaagttggaactgcaaactggtggtccaaggtaaatctggctgttttgaaggttgataagatcgcgacaagaggagccttgctcacaatgtggtggaatatttggttagaaagaaatagaaggatttttaatcataaaagcctctcggaaagggaagtggctcacttagtaaaacaggactttgacttgcgtagctgggcgtttaagcctccttaagctgtgtctttatattttgtaatcaaggatctgtttgcaatttgtttttcttcttaatcaaatttcaccagagctcccgacgtcgtcttcctaaaaaaaagaaaaagagcgatttgaatcgcttcggaagaatggtgcgaacttagtgctgaccttttgcggatacatttaatttgtatggttacgtatatttttaaattttaatgaagaaaaaacacttcattttaatttctctttttttctcaatgtaatggacacctctaaattatttttgacacatttatatttagactaattagaaaaacacttcatttatgacgaaacttagcatccagttttgatttttttagttattatattgcatccacacgtgcacacacctacaagtgtgctccttatcacacgctcaaagacagaaaatcatcggcaaatgtctgatctcactaaatttctggtaacgttgaaggcacatagatcaattggcatggcataacctatatatatgttacacgatatttttttaaattttccatgatagttcacatgtagttttgaatcttcatatttaggtgcttccacctatgcaaacaatgactagaaactacaaaagaaaaaaagaaaaaaaaaagagaaacgtaaggtgtaatgttatctatcaagcaacaaaatttcaacgcaaaatacttacataaaaagagagttattattagcaagcaaagtaagccattttcagtaatacaatattacaatgataatgtaagtgaacctaaaaaaatatagtttatcggatgagtgcatcgacaaacagttcaagggatcaaaatgcactcatttttttctttaaggaaataatagcttcactggtacgtagtttaaaacctaagatatttacttatcaatttgtttgaatatatataatttatattgtgaaaacctctattactgagagctatgactggtctgtacatatatatgctttccagctgtcgagaaattaggtgagacaaaattgtcacacattactgtccagagattgaccattttaaccaatagtgcgacataatccttgtggttgaaagtcttatctgatccatgcatgtgattttctgatctcaattgtagtaggtcagctgccggccaaggtacaaaagatgatcagtgcgtgagaagaagtgcaagctaccaataatccggcctggtattagtcaaacaactcatcatcaatatgtccatatcaatccagcaacaaccaagtaaaatgtgcttgaaaaaaaaatcaaatcttaggcactaggcagggcaaatctagggtgaaaattactccaccaaagcaacatttacttgcacgtacgatcgaaagtaatgattgaattataatcatactttaaatatggtaaattcgtagtactcggattaagtcgcgagtgatgttgaccggatataaagtagccaaggaataatatgtggatataacggtatataagcaattaaaagtaaactattgttgaccaattaaaagtaaaattttctccattgacgtacatacaggctgtgtgagcactgtgcagcttgtgcaggtagtggtgagacacattcagccaatggaattctagtggggctttcagtgtgtgtgattcatttttactccaacaaccttttgacttgttaaaaaagatcgagtcgtacgtgcatatgcctcattttcttttggaggggacatagagaggattaattaagggcttgttcgttttggaggaaaaacaaactatttggattcctaaggattaactcctacgagtgttattcagtttgtaggactgaagtataggaaattaaatttttttttaatacaagttgtatggagaaaatatataattttttctatcgtatcaactcaaacctcttgaaaaattccattcctataggttgatgtgtgcaaacattcttattcctctgcttttcctattcctatggattcaaattcctccaaactgaataacccctaattgcactagctagctagttgttgcataataccatttttccaataaattatgtcttgcacgattttaaaaatcatataaattattagatagaaaagtactttcgaggtaaatcatttagagatatattttcgacgctccaatccgaataataaaaatatatttgtatttacaatatttcaagtttagcttgaaacatgtacatgctcttttcagatgtcgatgcagtacttgaagcagttcaaccgctaaaaaaaatccctattacacccgtcaggcacgcgagatggttagtcgctatatggcctcgcagagttcgagctttgtacacctcagcagcccctcccaggcgagaaaatggacatttgacattggcctagtaccatacatgcatcaggtctagtatccacctagtactttggtgtacctaaccactacgaaaaccttagatctatgatgaaacatttttatcactgaaaaatatatttatttcatctagcgcctcacaattaatgtaaaaatattaaatgataaaatttagtctagcgatggtaggtattagacttgatatccatttggtagcgtaccgttccaacgagatcccgtacaatagcatcccctcatacaggggcggagctagaacaaaatgaagggggttccactcacttgctttactctgatttgaatcaaatttagcttgatacgggtgcctaagtttaaactgacggggtgtatatatatatatggtaaaaatagataaactataactaaaaattttttttgaaccaggttcctgggtaccccctagctatagatagctccgcgcctgccctcataaagttaatgtaaaaaaaatgataaaacttagtctagcgcgtctcactctaatcttgtgtgctacaatttttctctcatctacaaattaactatgctatatatatatatatatatatctatttaaagattggctaggattactcgattttgtaattattgctaaacttagtcaattaaccttattctcttcaaagagatgtccttgcctacctattatattgaatactattcaatatgatccctccatcgcgaaacataaggtgtaaattctaccttcctaactttgactaataataaattaacattttgttcagtgctacaccagttatatcactagattctgattgaaaggtattttcatactatgctaattttgtgcatgttgatatatatatgatgaaagaagctaatagtcatagttttgcgtcagaaatagtgtagaaaccggcgccgcgctttatattttgggacaagtggaaatactatacgtatgttatgatgaaaatttgtaagaatattctatgacgcatacaatgttatgtatagccaaggcaagttgttccttgtttttttgtctgcatattcaacatgaagtgggaaacaagataaagtcatggtcatatatatacactactcattgttgaaggagaaaacctactacaccatcactaaattaagcaattgtagacgaccattctctctgtgtcatccttaattagatcgatgaaaataaaacaaaaggagagacattccattgggactttgggagtggatgagaagacttggaaaattaattctgccctagccgattgatcatgcatacaaagacttttcaggataagcgcattcgtcgtcttttccaatgaatttctttaaaggcatgtcatgcgtagcttgaaatggagcaatcaaatggttaaattgttttgatcgcaatacatcttgagttgccttcaaagttacacagctgtgaacaatgaccattggataaattaaagtgtagttgctctctgacttttcacacaaacgacaaggtcgtcgtacggtgtaagtagcattgacagtttcattctgaaaagtatggtattagaatgatctctaatggtaaataaagcttatattacatagtataacagtagttacatgctttaacttgtttgtagaaatcaaagttcaaaggaaaattgtgataaaaatataggaaggaccagccatacatatatattactacctcaatataataacttttagctaaagtatgtccagatttgttgtaaaacgtactccctccgcccctaaaatataagcattttttactctaacacggtctccgagatgttactttgactaacaatatttataaaagtaagatgttttaaataaaaatagttgcatattttgataatttgtttaatactccctacattccaaattgatctacatatttcataggtataccaagaccaagaaaagctaataattctctcatgctatatttactctagcaacaaactcaatgcatgcaccatccccaatatttcctagccaatagcaaatcaagatattgcacatgggttataaatacttgtgtgcatggatgcatacatcaatgtccatttactccaatgcacaagtaacgaatagactctaataaataaacacatatatagatcatttaggaataaccttaaaaaaaactatatgtagatcaatttggaatggagtgagtaataattaaatctagcaacatcaattttatatgattgattttttttgctattaatagttaaaatttaaaatgtttgacttgtcactatgctaaaaacacttatattttggaacagatgtagtagttatattttgggacgaagatagcagttgggaaaactttcagatgcctccatatcaggagaccatgcctgcatgatgcctggcaaattatttgaacttctgcgctattaattagtttgcatcaatgcctaattaatggttgtttgtgaagtggatgtgatcctgtccatcgtggcaagagtgcatgtttccccttgcctacctgaagcctgcaggttaattaattagcgaatcatttggttttaactaatggttaattaaattatttgtgtgagttgattatatatataccacttttcttcagcgaaacatcgacaaatctaggtcgctttgcaatggtacaaattagtgatcgatcgacagcaatcatgcatgctttcagcagtggagcagtactcaagctcagtctaaagaacttattaattaattgggtttttttttttgaaaggaaggcaagaaatttgccttatatattgatagagaaggagattaattgggttgttaagggtgatgtatcttcaggccagcttgatcagtgcgtattttttttcctctgctgcctttgtgtgcttgtatcaatttcttttgttatccgccttttgccatatacatgtctcgctccctgttgcccatgtatcatgatcactgtcccacttggctaatttatgcattataatgtataaattaaattcgccatttgatcttgtgatatttttaaagataaagttatgtttgaaataaagatatatatagttttatttatctcagacaactatgttaagatgatacaatttatctaacaccaccgctgacctctaaatatttacgatgtacacagcctagctacaattattagaaaaacgaaaaaaagaacgacatgagacaaatgaagcagcaaactactccctccgtattttaatgtatgacgccgttgactttttgataaacgtttgaactatcgtcttattcaaaaaaaattatgtaattatcatttattttattgtgacttgatttatcatcaaatgttctttaagcatgatataagtatttttatattcgtataaaaaatttaaataagatgaatggtcaaacgttggttataaagtcaacggcgtcatacattaaaatatggagggagtacagccataagtgatcttcatccttatactccacggtagcaatactagcttgttccacaataaaagccctcgactccaaagcaacaccttcaaaaagaaaattatacttacactcccaccgttgccatgatcaaatcagcaaatgaaagactaaatttgtatgttttcattttagggagtaaatcctttgaacttaagacatatgtcattgtcagatacaactagctaagacaagacctagcgatttagagtggaagaaccggtaatcaatgcgcaccacctaactaatcgaagtccccagtgtactattctctcaatcctagctgatgtcaccgtatgctcccttcaggttgataatacttgtcgttttggataaggacacggttttaaaaaacaactttgaccattattttttattataatatgtataaaagtgttaacaaatatatgatcttattaaagtactttttaatactaatatatacatgtagtcatcatatttgaaagaaaaatattttaaaaataattcataataaaaaattctaaaatttaaccttacccttttctaaaacaacaagtattatcagtctagagggagtacctttcagtcatagcccaacttcaatcggaatgaacagcacaacttgcaactgtctttaaatgtgtaaccttatggtgacaaggtcgcgagaaagcaaatagacaagcgaatcgatagggcacatctaaggaatgatgagctattggcgcaagcggttccatgaatcgaaaccaagatgaccatgtctacaagccctgttggctagtagtaaaaacatgtcgcaaacggtcaaaatcaatgagactagtagttacttatcatcttggtgtagacatggtcatctttggtgtagacatgatcttgtaatatccactgctaaaaaagatattttcccaaatggtcaaaatcaatttttccatgtgattgagccagttgactgcactaaatgatatgtaaaaatagcgatttttccatacgggcaatgcacccgcatgcgaaaattgggtgcaaaaattggattttcgcacgtgggtgcttatgtggaccgcatgtaaaatataaaaagtcacgaaaaaaaattttcaaaaaaaaaccctagccctagcctcccgctgccacccactccttcgcgggcgctggccatcgccggtgcctgatccgccaccgcacctcccgcgccaaatctaccggtgtgcgtagggggcggagcggccgccggatctggccgccctcgccacccaccgtggcgaagactatagccacacccgagggtcagatcctttgccgtcgtcgtcagccgttgccgccctccctcattgttcgcccgccaccgcacccgagggccgcctccccgttggtgagggccacctcccgtttgtcggaggagaggagagagaggggagagaaggagaggagagaaatgagagaaaaatataaagtgagagagagagagaggagaatggtgaaaaaaattgaaatgggtgaggagggaaagagagaggagggaaaaaagaggggttatttttgcatgtggaccacttaaggggctgcatgcaaaaataggggcatttgcgaaaataaatttgctttttcatgcggtctcttaagagcttcatctataaaaaataaaattttgcgtgcgttcctctttacaagccgtgtgtgaaaggtgggtcgatttttatagacgctgatacttatgggccatctacaacctattgaggtgcttgttcaggaaaatcatttttatactggtgatctgttaacttaatttgaagaaaatgatatgatacatgtacaaaataaaagtattataacagtaaattgtatgactataagactagaacattacacgctcttggctggaatttaagaaaaccgtatgttacatatatatatccctcgacgtgacattaaccagaggcaacgaaccaaacacgcgtgaaaacgcactagctaggtagctctaactcgattgagatacgtactgccactagttgtagtggatttcaatttccaattcgatggaaatagctagctaaggacggagttatgccttttaaacaatacttttttagtagattttaaacaatactttaacttgatttagatctatactaattgctgtacaataccaaataagtgacgctaactttatgccggttcacttaaaactaacatactatatataaaagatatttttcagttaggacatgtacagtagtgtctaataacgagctctcttcgttatcatacaaataaatttggtggtgtggaagaaagagagggaaggaaggagaaacatcgttgctacgcatgaccacggctcagagtcgactcttagcatttgttaaccgaaaatttgttgcatgagggtagagaaaaggaaagaagtataaaaaaaatatttagtgcattaatggtttaaaaattttggagtatcgtctctaatgacattaattaacagagagagcttatattagactctttgtttgtacatgcctttaatccgagccatgcgaagattaaagttaaaaatcggcacgtatatatacaggtttttattagcaaccaccgtcacatataaattaatatgtgccgattttcacccggcatacatatatattaatacatacgtggagtaaacctaagttgttttgcctttaattaatttaactgccattattatgtactttcagagatggttggattgaacggtccagatgagtgatggagctagctatattccatcatataatattctccgaaacaaagtgcgtgaaaccggaccaatctacgtcactcacctactaccacaagataacaagtcatcattttggatagtctctttcgctagttcgttcgagtatacacttcgcaagcaacgaacaggttattatgcttcataaaaaagagaagaatttaataaattgtaactgatctagctgattatatatactccctccgtccctaaatattcgacgccgttga

SEQ ID NO: 73599 - DNA, 2895 bp, Oryza sativa
agtcaacggcatcgaataactagggacggagggagtatatactgatacacatacattattccataaaatccacttaattaattaactaaagatataagatatagtatagctcgagctagctagcctatatatacacatggcactggctcttgcatctccacacacacacacacattcaattcacatacaaaaactaagctagctaagctaagctaagcgagattatcacagtagctagctagctagctgaattaattagcatgggattcacggtgacgaggacgagcaggtcgctggtggcgccgtcgtcgccgacgccggcggagacgctgccgctgtcggtgatcgaccgcgtggcggggctgcgccacctggtgcggtcgctgcacgtcttcgaggccggcggccgcaacggcggcggcgagccggcgagggtggtgatcagggaggcgctggggaaggcgctggtggagtaccacccgttcgccgggaggttcgtggagggcgacggcggcggcgaggtggcggtggcgtgcaccggcgagggggcgtggttcgtggaggcgacggcggcgtgcagcctggaggaggtgaagctgctggaccacccgatggtgatccccaaggaggagctcctgccggagccggcgcccgacgtccagccgctcgacatcctctcatgatgcaggtatatatttatggattcaaattcaggatttttgaatttcctacaaagtttcgctagactttgtattcttataaggaataataacgtaactaatctggatcgatgatcatattgctaactccatcctacaatatacgagattttatccatacagttatatggagtaaaaaacatatatattaattattgcatatgtagtgcccaacattataaagatttatatatgtaccgtctttactttaaataaacgggtggacatctacttatactacatcatcacataatatgtatgattttgtcaatataattagtataaagtcacttatattataggatggaggtagcatatatatattcgtatattgataactagctaagtggtatcatcatctacggaccattatatgatttggcgggagatcaattatagtagatttactgtctaatattaaaaagatttatgtatagccatctttactctaaattctagctatgctacttagggtctgtttgggagagcttctagctgctagaatttctcccagaattagaagctcctcagacagttcagcttttggtttagattctgagaagttgtacttgtatgatctagaaaataaactagaagccagaagttataggaaacctagctttttttagattctcaaaagctagctaccgactaactatttcttagaattttaagcaccccaaactaacccctaaactggttacaaagacatggcatgctttagcgcgttggatgcatgggccatgcatgcatatgcgttcttatatatatatatatatatatatatatatatatatatatatatatatatatctcctttggttgtgctacacgtggtgtgtccccatatgtagatgagatcgtggcatgcatcgatatcaacatgtacaactaaactattctcgatgatcactgatcactcactatcggggtaggtaagtcgatcaatcggatggctctctccatcttgcaatcttcgattccctttattttatttaatagtatacaataaagaaatatatatccacgtataccatataatcatttatcatacatgtgctgtttatgtgtctactcgtaaaagtgtgttctttttaattatatgctcaaaagatttataaatgatgaagaccatatatatatatatatatatatatatatatatatatatatatatatatatatatatgcaagtcatcaacacactgtacaaaattctcacaaaaattttcccatatatatgttcataaatcaatatcaggatttgataactctggttgatagagtcatgcaccagtaattttacccataaactatatataaaataaaatcgtggacaaatcccccactaataaactgtgttggtacactctagtaaataataaagaaatctggtggcctcccacagccacatattattgtgttgaagtcggtcgtcgatcacatataaaccaacaacaaaagggggccacacaaaaggccgcatattaatttatttccagttgattaacaaaatgaccctatatactatcttttcttgcttggtggaaaagaaaagctagaggtcagttaattataagtaaaatataattaatcacaccatgtgtcttgctgtgaacactgtactggaagaagttaggtacacacattatgtagtgctacgcactacgtgttgaaattaaatgtgctctgtttgcttgcacaacatccatttgtcaggcatgcagacaggcaacttatatgcgtgtatgcagctcaggcatcctctcgagaatccattatcatccatctctttcgcaacttcgcgagaagtgtacatgtacgtacccacactacaaaattagatggatcacctaccgcattatattagttacctctgtttggtaatgcatcttacactctcccatctgtttggtataaaacttttaatacatatctcaacgattcagaagtaaatacagtaaaataaactatgatgaaaactcacaaaatcaacttcaaaataaagtttaataatttaaattttgacttataaacatatataggcagtacatgttcaagattaataggtaattaatgttctttttagattgtggaatatttcgttaattactgaaacatctttcagtaaagtttgtgacgtgttgttatttgttgcatcaaaattatatgtgta

SEQ ID NO: 73600 - DNA, 787 bp, Oryza sativa
cccccaagagccagggttttactgtacaaactctgaactctgaagatttgccaacttttgcaagtccgattctgatccagagtttacacggaaatctgcccatgttctcatttaaccactgaagttggtgagatttcctcgtcctgctcgggttggggagctataaattcagagcgatcaggtcacattggagtcttttcttcagaaatcattccaggatagcaagacatccaagagccaggttctttttaacaggcaatatgggctgtacaatctccaaagttttcccaagttttgcagagaaattcttgaaagaagccaaggcaggaaattcaccggagctgccgcaggatgtgctgatggagatctttgccctcctggaggtccctgacctcgttcgtgctggctcggtgtgctcctcatggcgcgcttcgtatatcagtctatgcaaacttggaggctacaggcaggctcagacgccatgcctgctctacacctctgaatctgctggtgagaatgtggcatgcctctacagcctcgcggagaagagggcatacaagttaaccatgccagatccacctatccgtagcaggtatataatcgggtcctctcatggttggatcatcacggcagacgagagatctgagctgcatctcgttaaccccatcacaggtgactagatcaacttgcctacggtcaccaccattaagccggtaaagcctgtctacgatgacgccggcgttgttcacaagtacgagtacccatgtcatgttggcggtcagcacaa

SEQ ID NO: 73601 - DNA, 14527 bp, Oryza sativa
ccataagaattggattgacgattatgtggatcagacggatggagatgttctacaatttgagttagacaagtacgaggatgatttggaacatgcatcagaacatgagaattggagggctggagatggtttgaagcctgagtcagatgaggatgaggatgaggatgatttggagcccgagccaaacactgattcacttgtggtaaataccaacatgattaaagtatttaaagtggatttttctgcaaaaatgcttgtggacataaacagcttaggtaacagtgtgttgtttcttgggtataatcaaactctttgtctaaatgctgatgtatatccacagttgaagccaaatcatatctactttacagaagatgatagcttatatctatttaggtgtaagaagaaccgccgcgatactggagtcctcgacttggaaaatgataccatcgagccgatagtatctccggagctttggtccaactggccagtccctatatggcttataccgaaccccaggaagatgatttcagcatcacacaattagggagaagatgttttccttcatccaacctcttatctgtggctctgattgttagttatgagaaagatatttagtagtaatgtgtaataaaaggatatatgggaaaaataatatttatgtatgtcttatgcgctactaatgataacattctaaactgaagttttttttagcaaattaccactaaactgaagtgtcatgtaacaaatacacatttctagattgttctatgctaaatgctaggaattcatgatgtaccatagcaagtttaaattgacattttttaattcctatatggaattaacttatatattgctaaggccacaacatggttatttcactgttaggattccttggtgtagccaatatgtgcttagtatgatcaatatgatattcgattggtcacgcgacttcatatatcacatatataatttagatgttatgatcatcttaagattatttatttatctcttaaaatatcatttattgataaaagatcaatatcaaattgtataggtaaatagctcttatatacatgcttagagaaaaataattaagtagatggaaagtcattagatgtttaacggaatataagtactgggcctaccagttttatgaaaatttaaggtgggatattttgaattttagtgagaaattttagaattttcttttatttagtggagtccttaatatggatgtgggtccagaatgtaaatttttgttagcaaaatatagtcaatatgtattaaattattgatctcacataaaaaatatggtaattcaaacaaatcataaggggcatagggatagctggctagacctaatatgtggaggttcaattgtgctcttttcttcaaggtaaaaaaaaatcatggccttttctttgtccataaagataattttaattttaattgttatagagatagaaaaagtagagaaaagtaatgccgcacaccgcacaggaatagggatggagggaaagttgggatgtcttttttaaaaaaattgatctatctaatgatctgaaataatgtgttgatgtttaagttaaaactaatggtaggatgttttattttttttccgatttattaggattttctgttatttaagcgagattagtcgcagcttagtaaagtatttatgtactttaatgtcctaattgtttgggatttttttaaaaaaataaatctaataacaaacgtaaaataatgtatccatcgatttaagtagaaacaatggttgaatgttttaagttaattttaagtttaattgtgattaggatgaaaaaaaaagagaaaggaacagaggtagcgtacaatacgtgtgtgctgcacggaggtgcggacgtttataggttttggtttttttaaagatacatctaacattctaaaataatcggttcaccgatttaaagaaaaatcgatgaccagatttctcaattttattagaataccacgtggcggcttgggagtatttttaggcggccacatgacggcttgggagcgtttgtaggaggtttaatggacttttagtatataatagaaatatataaagataaaattagggtgtgtagaaaacaattaggacatgattatttgattttaattattacaaacttgaaaaatgatggatctattcaactttttaaaacaacaggcaccttatataaattgttaaaatttttgtggcgttaggattgtgaatattttgaatctgtccattgatgaaaaatatgaattttaattgtaaatccaaattttatcattgagctacgtaggatatataatttactaacagcgtcttgtatgtaggagatataatttgctagtcccgtaggagtaactaatctagcttgcttttgctaagagatagatttgatatcttatacgaaagtatcaaactaatctacgtgagatggatgcatcgtgctgggctgaacatgtgggtcctcgctttctatacacacaaatacaccatgcatcgtacggggctgcaaatgtgggtcctgatttatcttgttgtgccatgtggcggcttgagaacgttttgaggatgccacatgtcagcttgagagcgtttatatgaagtttaatggacttttagtatataatagaagatagataatagatagatagatagatagatagatagatagatagatagatgtgtaataaaaggatatatgggaaaaataatatttatgtatgtcttatgcgctactaatgataacattcttgtttgtttgcatctaatgtgcaaagacatcttctaatattttatatttatgttatgacagagagcattgtggcagctccctatgaattttattcttctttgtggaagatgatttcgtttactacttgtgatgccatattttgtacatgatgttggcaattatattctccagtcccccacatgcaatatataagagttatagtttgtagggatatcaacaactccgtccatctggctttgatcacttacagaaaaagatggacaattcaaacttatcacaactattgaaagctggacactccatcaaactttttacatcacaatgatggaggacataatctttgtatgatcacactagagaatgttaagctttgcaaggggtaaaagattaagttaggaggtgatataacagttaaatagacaataacagttgttaacaattttttcacacattattacagcaaaataggagtaagatctttacctgtccccagatcatgaccatagccgttcgtgtttaccgatctcacctttggttctccccctcaccatgcatcctttttcttgatatttgatacttcttgacaatgtttttgaacctaaatcagtgggacgcgactcccgctcgggcgcccgatgggaggaggttaaaatcgggcgctacatgcaaaaactactttaaactgatttgtctcttaaattacttatccaaatcatgatccgattgtaccattaaattcgttgcaattaaatattcaaaacaagaccacacatggatatattccaatgaaaaaaattagcttattattgaattattattaaatgttgcgcgatgttccaccaggtatatcggaattgtttcactaagtagattaaaaatgtttcactcgtttaaatcgggtgttgtttcaccttatataaaaaccatgtttcagcaaatagcgaaaaaatatttcagttcactgcaacattagatttatacatagtgaaacattgtgagtacactaggtgaaacatttttcggtggaacaaaaaataaaccaaatttccttaatagggggtttccaaaatatgtggtttttttttgcaatggaatgtttcgttcactgcaacattagatctatacatagtgaaacattgtgagtacactaggtgaaacatttttggtgaaataaaaaataaaccaaattcccttaatagagagtttctaaaatatgtgggttttttgttgcaaaagaatattttaattcactgcaacattaaatctataaatagtgaaacattgtaggtacactgggtgaaacatcttttgtgaaaaaaggggagggagaagtgggttggcccaaacaggtgcgcacatgggggaggaggagcgaccgattttcccacctcccccggtcgaccgatgctgggcattatccaaataagggtggaaagtcaccctgctaatgaatcaaggaatagcaaatgacaacttcaaaccttggatttcttcatagtaatttttttttgagattacacagcagacacacgcatacaccactacacatgcaacactacactcacaaccctcgaatagtatttggtctccctgactttagaaaacatatcaaattttgttttctgaagcgtcgagtagaatgcagaagcttgggtttagacaccagtggctgtcccctcaaaagttagaatagtttctccctgtagcagcactgacttttaatgtgaccacgggcctcttctaggtaacattgtgctatccatcatggtagttttctctttctttttctttttcttttccagagcctgtttagatccaccccaaaattttacaccctatcacattgaacgtttgaacacctgcataaagtattaaatatagtctaaaaaataactaattgtacagtttgcgactattttgcgagacgaatcttttaagcctaattgctccatgatttgacaatatggtgctacagtaaacattgctaatgacggattaattaggcttaataaattcgtctcgtggtttacttgcgagttctgtaattagttttgtcactagtatccgaacaccccatgccacatcccatgaaacatccgatgtaacacgcaaaaactttacacccctgatctaaacaccccctcatttgcttagaacaggtttgaggcttttcttttgtcaagtacagcacattgctattcagttagtagaacattgtcaggtaactatctgcacaaatgcagtacagggacgtcaggtactaacattcataatttcaaactagctgcgccaatgcattacagggagaaaagggagaacctaaaacacattctgaagatgatggaatcaagtacatgaacatgagcaatttgtttacttaaaagccgtgggaatggctgaggattagggcgccacgtcatcatttttttttcagaaaaacccttgctctttccgctaatagcgtgtacatccccgttaacgtggcccgtcggatcacaagctaaggccgatttgaccgtccacgtgtcccagcatgactacccttccaccatcgtcagatcgttggattggaaacggatggtctggattcttcagccagtacaaaccctagccgcccgtcctctcctccccacgcacgccgccttgcccacctcctccaatcgcgccgcagcctcaccgtcctccttccctcgcgtgcgtcgtcgccgccgcagctccctcctcctccactccctcaacctactcgtcgtgccgccattgcagcctcccttctcctccactccctcaacctactcgccatgccaccattgccgctccctaccaacgagtcgccggatctccccgtgaggaggccggggccgccggatccagtgaccccgttctcctcgccggcggatccggcagcccaaagaaaggaatgagaaccgccggtaccagcggatccgatgccctaaagaggggtgagagccgccgctgcccagacggggtcagcaggccgccgccaccaccctgcgtaggctcggccacgactgcgacgaagacaaccacggctcggcgacgatggttgtctggtcattcttttttcctttgtctcacgttttcccctcccagaaatcctccgacgcctgctcatggtctcatggagcctgtggccagctgccgccttcccctcgagctcgcgaagccggagccgctgccttcctctcaagctcgttgagccagccgttgctgccgccgtgcggagccagtggttaccgtcatcgtcttcccagcgagctagcagcggctgctgccaccttcttgcaagttcgatgtccactgtcgccgccataccgtctctttctccatcccacgcgaacttggttctgcaagatctgtgccgcatcgagcgcctacaagcacgcggtaaccaacaggtgaaactcgacatgggtggcagcagccaaatctcctcctgctgatactactcctcaaattgatttctcagttctctttacagtcctgcatctcatgctttcttcatatcaggcttatatgactggtggaaactgttagactttgctctaggatcacctaggttagatgtagtcgggtggttctatttgggattgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcagcagcggtggtcgtgggcgatcccggcgaggtcatggcgcggcggtggcgtttcccgtcactggctgcgccccctctcgatcggattagggtttgtagggtggagttggcggcggcggtgaatctcgtcccttgtgccgtgctggcctccacctctcttttatatggcgcagtgtgacgggggcccaccagccattgggctggatgcccccgatcagggcgcggtcaaggtccgttatgccattgggcccgatgggtgggagatctatctaacattctcccccttgatctcactatttcttttagctttttctattccatcacagatttgtgaatagagcatgtttcatcgtcacagtcaatcaccgatggattcgacagccactatacacatctctattcagaaacatatactttacttttgggccctgtagtccaggattcataaggcttcccttaaacccatgccggctacatgttccttgaacacgttgggtggtaggcctttcgtgagtggatccgcgagcatcctttctgttctaatgtgctcgagactgattgtttgatcccggactttgtccttcacaacatagtactttatgtcaatgtgtttggcagcaccacttgactgattgctgtgagcgtacattactgcgggttcgttgtcgcagtataactttagtggtttctcaatactgtcaaccacctttaaactgagtatgaacttctttagccagttcacctgccccgttgcctcatagcatgctataaactcggcatacatagtagaccctgcagtgatagtctgttttgagcttttccatgaaatagctcctcctgccagggtgaacacatatcccgatgttgactttgtattatcttttgtaaaatcagaatctgaataccccataatctgaagcgattctgatcttctataagacagcatgaggccttttgttccttgaaaataatgcaagactttctttaccaatttccagtgctctgggcctagattactctgaaatctgccaagtaacccaataacaaatgccaagttaggtcgtgtgcacacttgcgcgtactctaggcttcctatagctgacgcatatggctttgttttcatttcattgagctcatactgatttctgggacattgcgatgccccatacttttcccctttgactataggagcaggtgtagcactgcatctgtacatattgaatttcttcaacaccttttctatatatgtcttttgagaaagtcccaatgcatactttgttctatctcggtgaatctctatgcccaaaacatatgaagcctcaccgaggtctttcatgtcaaagtttgaggacaaaaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaattcataaatggatctctttagacgacatcccatatttccgtttcctttcatgacaaaacctttcggttgcgccatgtatactttttcctccaaatctccatttagaaatgtcgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccacttacagcctactgttttgtctcctttaggaatttcttctaaatcccaaacattgtttagtttcattaatttcatttcatctttcatgacttccaaccattcagatgagcgagcgcttctcatggcctcttcatatgaggtgtgatcatcctccatatgcgactcttctatattataaactttatagtcatcacggataaccgatcttttgactctttcagaccttctaggggcctgcacatttggcacatcctgtacctgaggctcttgttgagtctcctgtactagcacattatctatttgaggctgttgcagctcctcctagtgtggcaaccatttctgttgaatcctgtataacaggtttatcattttcattcattgttgccacaggagaggtaacaacaggtgccagtacctcaatgacaggtattgcaggcacaacatcagcaggtagagagaagaaaggttcctgagtcgacggagcgggtacagacacccgcctctcctcaagatcaatttctcgaactaccgagctctccctaatcatttcgtcttccaagaagacggcgtgtctcgtttctacaaactttgtataactgtttggacagtagaaacgatagccttttgatctttcaggatagccaataaaatggcaactgactgttttgggatccaacttcccaatatttggattaaatactttagcctctgcaggactcccccacacacggaggtgagctatcgagggtacgcttcctgtccatagctcatacggtgttttgggcaccgatttgcttggaactctgttgagaatatgaatagcggtttttaacgcctccatccataaacccagtggtagtgtggagtagctcatcatgctgcgcaccatatccataagggtacggttacgcctttcagctaccccattctgttgaggttcgcccggtgctgaatactgggctactattctattctctagcaagaaccttgcaaaaggtccagggacttgcccataaggcgtatgtcaaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgtgcttcggttttgcaccctttttgatgctctttacaaattttcctttaatgcattgttctaagtctgagaactccaatggaggcagaatttaattcttaactagtctctcaattccccccctcgaaatatggcccaaacgacagtgccatagtttcgatgagacatcgggagttctctttcttttcttgttttcttttgtcaacgaggacacaacattcacattctcaaaaagagataacaaataaagctcgtctcacagcacagcaagaccaatacatgcattattataccatagttcacatttgccacttccaaagcggcaatcatatccatcaaaatccaactttgataaacttattaagtttctttgcaaagaaggaacataaaagacatctcgaagtaaaagtgtgaagccattcgcgagctctagaggaagatctccaacagcttcaacttttttttcaactccattggcaactctaatggagctttctcttctttgcgtagtcctcgtcgaacggaatgcctttaaacaattacaagcatgaataattgctccagaatcaatccaccatgtggatctagagtaaccaacataatgagattcatttacaaatgtaacaatgttctcacctttccttgccatgatcattttcaagaagtcaggacagtctttcttgtaatgtcccgtcttcttgcaatggagacactgatctttctcaacagcgaactgttgttgctgaggcagatgctgagactgtttagcttttgaggtgggagacttgtggttctttttcttgttatctttaacatagttaattgaaccaccatttgactctttaattctctcctcctcttgcacacaattagcaatgagtttttcaaagttccatttctctggacttatgttgtagttgacaataaaattgtcaaactgctttggcaatgaggcccataaccagatggaccagaaaagtcatctgttatgcccaaatccattggcttcaacttggaagccatgttgctcattctaagtatgtggtctctaacaccacctccatggtacctttcggtcacaagctgcttgatcagctgtgtagcataagtctttgaagagccagtaaactgcctctttattctttcaaggtactctgagacagcgtcacactctgggattgagcccaatatggtaggctcaatcgtgttctttaccatagccaaacatttcttgttggctaaggaccatttcttttgttcaatgtcatacgacatgacgagaggagcattgtccctctgtctcttttgccagtcaccatctgactcattttcacctctgataagttcagcaggttctataggacatggggtagtcaacacccagtccacctctcccaagatgaaagcaaggtcgagttttcttttctattctgcgtagttatctccttttagggtcggaatatctttaatgcaacccatcaagaagtagctacctaaaataatcatgtacggtgagaacaacattaacattaaaatattatgcattaagcctatatcaccgttgggcagaattagacataacatatataaccataactataacattgcaattatcaacgttggtcagaaaattacaatatcatagcacataattaatgttccaaaaattaaattctcccgttggttcgaaatttaattttagaaacactaattttcatcaattttatctatttgcagcggaaaaactatataaaaatcatatgaacagtagcaaaactctgtaatttactctctgtaaaaattctcccgttggttcaaatttaaacagaggtaaaacatgcaaaaatctattcaaaattctattgaaatttgcatgaaaaattgacaaaatttaaaaggaaaaatgctactattcctttcctttctttttcggccccccgagggacctaatttaaactttttcccggtggcccacggccttttggcgcgcgcgggaaaaaggttagatctagtcgggtggttctatttgggattgatgtttgaactatagagattgaaaacgggagaggatttagatagaccgaccggttgaggtgttggaggatgaagaagtgccggccatcgtcgtcgttggcactcggttgtcatggatgcggcgccggtgaggtcgacggcgatgacggctgcaacagcggtggtcgtgggcgatcccggcgaggtcgtggcgcggcggtggcatttcccgtcactggctacggcccctctcgatcggattagggtttgtagggtggagttggcggcggcggtgaatctcgtcccttgtgccgtgccggcctccacccctcttttatatggcgcagtgtgacgggggcccatgtcgcgaccgagaaaaatacattttcccgaacgctagtgtattaatccccgtccaaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctctaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtatccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgcttaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacagggttctttaggttataacaaacattaggagacttgaacggatcgattcagagctcgtatgaccaagatatgatcatccgaagtttaatgctgttacatggagatttgcggattattataattaggttttgcaactataaaacatgtgtaagcgctagcctggaaaagacaggaaggctgcgccgttgacatgcggaccccacatgtcaacctaaaggaccgcggtagaccgagtacacagagacagtccacgggtcgacggaagcagatcccgtgtgtcaaccgaggcgagtggccgacaaacggactccactagacaccacacgggctgcacacgtggaaaccacgcggctaccgagcgggcacactaacacggtcaccacacgcacaagcgaacaactaccgacaccggtacacgggtaccggggtcgacaaccgcacaacgggcacgggcgataccgaaaggacgaggacggggcagcgaaggagagatccttaccaccacgcgacgaggcgagggaacgacaacgatgaacgggcgcggcggagacggccgggaatgacggagacgaaaggcgaggggacgacttcggcggcgatccttggacgaaggcgagacgcggccggcgcaacgcttggcgacgcggaggcgaggacgaagacaacgacggggctgcagcggcacacttgacggacacggacgacggacgagaacggcttgacggagggacgaatgccacgacgaccgggaacgacgagaggacaccgacaggaaccggcgaggaggcgatgagggca

SEQ ID NO: 73602 - DNA, 2755 bp, Oryza sativa
acactccaactaatcttaagcaaaacagctagtagcataatgcacgaattttgtacttagataatccactgtcttctcaaagtctttcgatcaattactttcaccagcttgtgtagcaaaagattgatttgtgccgaacatactttagcacacgaaccggccacacttggatcaaattaaagggccttttctctagctagtgttggattatatcatgaaccatgattattttgcttcaattttcaatcgagagagacttggcaagtactaaagatttaaaaaaattatatagctagtggataatccatgccagtggaaatgcaaaactagctacagttgattatgaccaggtatcgatcggtccaggatttttcaggtgggcgccgctggtatacctgaaactgtagaacaattaatactccctccttccctaaatgtttgtcaccgttgacttttttaacatgttttaccgttcgttttattgaaaacttttgtgatatgtgtataactatatgtatacatcaaagtatatttaataataaatcaaatgatagaaaagaattaccaattacttaaattttttgaataagacgaacggtcaaacatttttaaaaaagtcagcggcgtcaaatattttaggatgaaggtagtatattctaactgagccttttatttattttaatttcactgcttgttctcaaataaaaaatggtatataattttcatgagattcatgaaaaggaaacaaagatcttctctcattgaatctagagttgccttgactaatagtagtacatgtggttcagtggatgtggaaagtttgttggtgaaaaggtaggctacacagtgggcaatagtaattttgacttagtgttcttttacgtccacagtcttcaacataggagtactaactttggtcatcattttgtagttacagtaaaatataagaataaaaatataatattatgaaaacatttttaacaacaaatttgtatagatcttttgttgagttaaagaaacatgggggaaaaggtagcgtggggtagcccttaatgtaggacgccgttgacttttcgaccaacgtttaaccattcgttttattcaaaatttttacgtaaatatgaaaatatttatgtcatgcttaaataatattgatgacgaatcaaatcacaataagataaatgataattgcataaattttttgaataagatgaatagtcaaacgttagataaaaaaatcaacggcgtcatacattaaaatatagaggtgtagtacattataggacccactagccactagagttaaaatcattccgtgcccgcaaatattactcgtgtactggtgcacttttaacgtaaggaatttagagaggatatatgggtggttctcgtctctttaaccttacatcaaacatgaccattcgcgtatgatatatgctttttttctctctctgtaatcgtggaaaaaagaaattcaaaaaacctgacggtcaagtggaaaagaattaatggagggcttcgttagtgcttaataagttgttgtgtcggtaaaagggacggtttaaccacccgcacgtaaggttgatgatcgatctacggactacgatccaacggttcacgatgcgtgatgcgatataccagtatgtgatgtgacaatgaacggtggttgctgcgtcgttactagatgatgctagaacactcacaatctcacttagctctcactaacaaagtgataagctctagtactatctacctaattagttagtgacaatcaccaacatttgattttaattacctaccaactcaattttcttcaaatccgttgaaaattgaatcgatatgtataaaattcagcaaaattacaatgaaatgaaattgagatgcccaggtagtgcagtgacagaagatatatggtttcaaaccctaaaattccgtgttcaatccaaaacatgcttaaattttctttttaaaaaatgtttggaggaagtctctcttttcaaatcctttttttacaaaaattacaatgacattgatcatgttaattatttttaaaaattgtttgtagggagtctctcccttcaaatcttgtttttttaaaaaataagaatgaaattgatcatgtgtgttttaaatttgcaggtgacggagttcacgtgtggcgggttcgtggtggggctcatctcggtgcacaccatcgccgacggcctcggcgccggccagttcatcaacgccgtcgcggactacgcgcgcggcctcgccaagccgcgggtgtcgccggtgtgggcgcgcgacgccatcccggacccgcccaggatgccggcgccgccaccgcggctggagctgctcgacctccgctacttcaccgtcgacctcagcccggaccacatcgccaaggtcaagtccgccttcttcgagtccaccggccaccgctgctccgccttcgacgtctgcgtcgccaagacatggcaggcccgcacccgcgccctcgtcgccgccgccgccgccgccggagacgacgaccaggagcgccgcaccgtgcgcgtctgcttcttcgccaacacgcgccacctgatgctcaagggggacggcgcggcggcggcggcgacggggttctacggcaactgcttctacccggtggcggcggtggcgagcggcggcgaggtggccggcgccgacatcgtcgacgtggtgcgcatcgtccgggacgcgaaggcgaggctcgccgccgacgtggcgcggtgggcggtgggcgggt

SEQ ID NO: 73603 - DNA, 18015 bp, Oryza sativa
ctgtgtgtttgtagatcttgttaactactatagtgctcaagtgccgagtggaataatggttgctgtaatttgtacaccgagttaattatgatggagctttttattttttttccaaaaaggcacctcctcttttgatctaaactactacctgatctgttccacgaaaacttactcactctttccaaaaaaaatatagcatccaaaatttatcccaaaatagatacggttataattatattagcatttcaattttaagtattccttattgaaattcttctccaccttaccctcaaccatcgatcctcttatttaatggaagcatatagattatttttcctctgccaatttatcctttgaatgctataattgcatttttttttcaaaaccaaatggagggcacgcacattagaattgtgctccagactaaatggaggatgtgttcgctattacctgttcccaaccagaaccctccgcacgaaaaacggagcggtttattagcgcgtgattaattaagtattagctatttttttcaaaaatgaattaatttgatttttttaagcaactttcgtatagaaacttttcgtaaaaaacgtaccgtttagcagtttgaaaagcgtacgcacgaaaaacgagaaagagtggttgggaaaaggggtgtccgaacacaccctaatacccacacggtatcatgccattcttaaacgagatcccacactcttacaaaaccccattattatgaactcggcttcaaagatcttccattatccaccagcattttagggcccctttgaatcgcagggtagaaaaaacggaggaataggaaaacacaggattctaacaggaattgaagtgtaaaacagatgattgtaaaacacaggaatggtcatttgattagagcgcaggaaaaacgcaggaatcggatgagagagatagactcaaaggaaatttttcaagaggttagagctcttgctaaattttcttcaaaatccacatgcaatgtactattttataggaatttcataagatttggaaagcttcaatcctttgaatcaaaggaacaaataggaaaattttctataggatttgaatcctatgaaattcctatataaatcctttgattcaaaggggcccttagaaggcccccacccacttcttgatccccacctaacttggagcctatgattactcatttgatccgctagctcaattacctgatggctgatcgatgcgctcctagatgacctgtctaatttgactcgaatcacctgttcattcaggggttcgcattaagattgctttgtccaccttaattaggatcacatcgtgtgattttagatcactgatcgaccacctgctcctgtgacattttggtcgtcattctattcctcatcatctatatctccgtactgaacaggacattcgttgatcgagacctgataggaattcgttcggttaatttgagttggtcagaaagttggtgaaggagatttgaacttactgtcgctttagctggccagtactccagtagtatccccccagctgtctgacgtagacacctacatcgatgagaatatatagcaagcaagcctaattaatctgtcatatatagcaaatatttactgtagcaccacattgttaaatcatgatgcaattaggcttaaaaaattcgtctcttaatttacatgcaaactatacaattagtttttttcatccatatttaatgctctatacatgtgtgtaagacattcgatgtgatgtaatttttggaagtttgaaggaaaataaacagtcctcgtttcgtttatgtttcagactgttgcaagcttacttcaggctgccgtcggcctgacgctaccttttctatccttttggaggggaccaagctactacatgtacatgttgggagatttgcatttcagatggaaacaaaagttcagatcattggatgaatgtctctcaaagttcttatacaaatatctataaataatcaacttttatatatatcgtgtttggatacagtggtacacagaaaattaattaatggttcaatttgccatttgaaataaacgaaaaaagtcccggccttcttttctgctaaatggatgaatggattaatatacacgtttcccaaacttttaaacggtacttaatcacgtgaaatgaaaaatcattagcgcctgattaattgagttataattatttcaaacttgaaaaatatattttcttatattttaaaacaactttatatagaaatttttcacaagaaacatattgtttagcaatttaaaatacgtgctaacagaaactgaagtaaaatatctatattaaattcttaatcccaaaaaaagtacctaataataccttaaaagtccaaattcttctgttgttataagattttgggccgtctgataaatttaccgtcattctttctcttcttatatcatccaacccatcttgcgatctttttttttttgagggggtaaagggcaggagctctgccaatttcatatcaggagaagggagaaaacagagtttgtgcaagctatggttgaggataggatttttaggtaatgcaaagcaactagtaagaggatatgagtgctactcatctaagttatgagctccatcataggtcttacacatggcgatgattgaatcaacaacttacatcactgtgctataggcgccgttgaaaatcctggtatttcattgaagccaaataccccaagctatatagtatatagatgaagaggtgatcaaagcttctttgttacttgaccatctcttttctacacgctgtccaccaacctagcatatccccatcaaagcttcttctttttttccttgacccatcttgcgatctagggccaataaaatcgaaaacgggctgaaagtaggtctggttttcttgattagggcccaattccagcccccaaggcttgttttgggccgtttacacaaaatcttgttttggctccatttctcaatgaaaaatggaattggaactgaaaaaaaaaaggaagacgaagatgacaaatttaaagtttaaacaggcaaaaagttggtgccattcctgctaaaaaactagcttccgtatatatccgaaaactgattttctgatgattgtaagattccggcttctgacgatgatcagaactgtctgatggaactcacggttggtaaaacaaaaactgaaaatttggttgaattgaaatattatctcatcacatgcttcttggtttcaaagaaactttaattttgttttgacagttggaatcgatttgattcggatcacatctagcttttgtaacaaatcaatcctgcaggaccaatatagctttgcatgaaaatgacctgaagaatgcatatgagaaaagataaaagcaagctcttgaaccatgcattttgctcttcagttttcactagatgtactacaggccaaggaattggaatcgatatatcgacttgatccagaatgatattgttgccgattcatcgcgagtcgccatccgtcaatttcattagttcactgatgatgacctacaaatcttaatgccgggctagcttgcttgctgctagctgatgatcagtagtattagtcagggttcacaattccgacgaaaactggccgaatttcatgaaattttgaggtttcgacgaggcttggaagtagaagccatctgagatttcgatgaacttcatccaaattcaactttgaattgataaaaaaaggaaaaaaaatcttataaatagtatgatattcatagaacctattgtgatataaattttcgaaaaaaaataatgtattccgtgtatttactgaaatttatagtaggaaagaaaagaataatgaattaaaaaaggaaaacaatttcagtttacttctttttctagttatcgattgaaatttcgatgattttgcttggaatttcgctaaaatcgaccggttttcacgagctaatcggtaaactcagggaatttgtattcaaattttggtttatgaaatttgttcagaatctaccgatttttttactagatttcgcgaaaaccgttattccgccagagctcaaaacgggaggccatctcgaaatcgtaaaccctggtattagtactacggcaagtgttgatgatcatggcctaattagtgcatgcacggttcaacttattgttaggagtactagctattttagctaacaatgtttgcgtctaattattggttggacttcgactctgatggcgatgaagatgactaagggggtatttaggccatgtttttttcagcttgggattattataatctagattattaagtcagattactataaactagattgttgtaatctgtagtagaataagcggttagttgtttctttcctagattattagagcctagattattgggtttgcaagtctaaagagagagtggggtggcatggtgggtaatttttcacccaataatctggaaaagctcacctaaatgagcttatcagattataataagctggactctagattataataagctactttaataagttgtttgtttctttcagtttactcccaataatctgaattataataattcaaagatgaaagaaacgggaccttagattcaggggtgtaaagttttggcgtatcatatcgggtattataaagggtgtcgcatggggtattcaggcactaataaaaagactaattacagtatccgtcagtaaaccgcgagacaaatttattaagcctaattaatccgtcattagtatatgtttactgtagcaccacattgtcaaatcatggaacaattaggcttaaaaaatttgtttcgcaaagtagtcgcaatctatataattagttatttattagcctatgtttaatactttatgcaggtgtttaaatattcgatgtgacagggtctaaattttttttacgggattaataaggccttaaactcagaagagaaaaagaactatatacagtagcataatccaagagacctgtctctgacacgacattacgtgtacatgtacttattccgtcccaaaataaattaacttctaccttctcattcactctcggttcgtaaatcgaaaatttttattctttcaatatcccttatctacctatccaccaatactaatttgctattaattaggagtattttagtcttttattctcttctttaatcatgcattaagaagttaggagttgtttcttggacagagagagtagtatgcatcaatcatgtacccgatgactgatgacgaagacaaagcaagtcagaaattagtcaaagggtgctcctttcaccgtcttggtcatgtactcatgttcctgctccctccgtcttaaaatataaacacattttcagtatagcgagaaattaaatatttttaatttaactattaatagtaaaaaaaattaaaaaatcaatcatataaaattgatattattagatttatcatcaaataaactatcataatatgtactttttatttaaaacatcttgattttatagatattattggttaaagtagtatttcgaataccgtgttaaagtttaaaaatatttatattttagaacgaaggagcatatggttacgtgcaggctgcttctacttatcaattcggtacaacatatgctttgcatgctgacgcagcaaaataaaagcgcctggctaagctcagctctcaactaatctgtcaagcttataaattctaatatgattatagactagttgtcagccataacacggaagtagtaagatggagttacgaagatagatatcgacagaatttacgggtacagaaacctagtttgatataatctagcataataaatctgaataatgttttttttatggagggattactcatcacatgcataaaatcacatatactctctcgtctctaaaatatcttattttttttacttctttatttgcccacaaatacttcattttaaagcactatagcttgaaaattgaaagtgaacaacaaatacattaaagtttaagaaaagcattaagcttaaaaattaaaagtgaaaaacaaatacattagaatttgaaaaaaaaaggtaaagagcaatatagtcttttcacttttgcattaattttgagggaaactacggcatgcgtttaccgtcggagtaaaccttatcaataacgcgataaaaacaatttacaatgtagaggtgggaggggagatgtagagctttaggagttttgtactacttccgttccaaattaattgttgctttgaattttttttcttataacgtttgactattagtcttatttaaaaaattagtataaatataaaaaaggataagtgatacttaaagtacttatgatagtgcaagtcacaaacaaaaataataataattctataattttttaaataagacgaatgattaaaccttagaaacaaaaactcaaaacaaccagtattttgggacagagatagtacagttgtacaagaagcagaagcgtcaacccaagagactaattaagagtggcttgaggcgaaggggggcatcgatgtgaccagaggagaaaatcattaatgcagcattgtctgagatggtgatcagtttcgtccatgttattgaaagctttgttgtttcggcacttccaaatgttgcaggttatcatggggagtatggtgctctagatccgccggggaaaggggcgggtctgcagtacaagtgtaaaaccaatagcaaaattgtttatccatatatatattataacaccatggtataaacataattagtatactatgacaccaatacacccgttatgatactaacgaatcgattttctggatccatcactggtcggagaaggtgtgttgagttgggggctggacaagccagaggtcctcaagcgatggtagtagccttgagatgctcacgctctgcgctatgtttagatccaaagtttttctttaaactttcaactttttcatcacatcaaaactttcctatacacacaaacttccaacttttacatcataaatttcaaccaaacacttctaattttggtgtgaactaatacactcctggttgcccggggacagcgtagaaagaggtgctcaacatctttaacaagggggcagctgaagtggcagttgggagatgaagcaatcgccctacgaaagcagtgatcgttggtgaaaattcgtctccggtgcagcgtccagagaaaagttgatgtgtgagataggtaaaattgatgtcttttctaggatggaggtagtagaatcgataggtggcatatatatgcgggaacgtatcacgtggaaaccagggaagctgtgcaaacttacaaactctcaatcaagaccacataatcaccatctgatggctaggaatagaggtgggctaattctgcacttaagcgcccaccattagccatactaatcttgcttttttcaaatcaccccctccccctaatccccagcgcgcacgccgcctgttcgtttctcccgtcctgtccacgagttgcccatgagtcgctgccgccgtcgtccgcgtgtcgcccgtgagtggctgccgccgtggtacgcgagtcgccgccgacctggccctcaagtcacagccgcacaccagcgagtcggcatggagtcctcgcccgcgacgccagcaagacgtttttcaatgtttcacagtttcagtgctgatcagtgcttggaaaaaacagcatgaatgtttcagtgttttagtgattgtaaacaccttgtaaaaattctggtagaagcaactgagatacaatttttcaatgtttcagtgtttcaatttcacacacattgctgaatcattaaaacacacaagttcattacataggaggcaccattgctgaatcactaaaaaattagcatgaattttcaatgatatgagtcttctggtacaaacaactgggatacaatttttcaataaatttcacacacaatgctccacacacaagttcattacacaggaggcacaattgccatcgcagaacctttggttcaggcattacagtcccagacgaggacgccctttgttcaggcacaattgccattactcagtttctgatccagtactgactgaagccgtggcaggactgcccttgggtgcctgctgcacatgtgtgacaatagcaaaccactgaccatgaaccttgaggtactcatcatgccacacatcgagcctgacctgtaggaagttgtcatgctgcctctcactgctgatggagtcctagtaatcgctggcagtgaagccccttctcattttttgccggtgatgcgcaggtgccggtgaagcgttgctgccgatgatgcgccacgctgctgcccgtggctccaattcgtgccctacagaactgggcaaaggtgccaccgtcgaggacatcctgaaccggaccaccaccgtcgaggacatctccctggcggccgccagaaaggccacctccgaccaccactgcgtggctggcgaagcccaacgcgggactcatgaggcgacgcggctggatctgagatggcgcggcggatcagaggcggcggctggatcgtgagtcgtggggagacgatactggcgtaggggctcgggtgtaaaagtgatgggaggcggatggcgcagggggtgttttgcaaaatagacagagcggctggcgggcggttatttgcaaatttagcccacctctatctctagccatcggatgctcatcctgtggatatgattgagagttttcaaggttgcacaggctccttggtttccacctgatatgctccctaatatttgcagtaggactacacatttgggacaagtgattagtagtggagcaagtaatggctaatataatcaaacgttcttgcttgattagttagtatatgcagggtgtagttatgcgtgccgctgatcgagctgatgaaacagttggagaggatcgagttggagtagtaacaaagtacaagtagtagatgggcgtggctgcaggtagcatctactggagtactctatcttgtttgcatgtaccacgtatctatctatcaatctatctactccctccgtccagattttgagtttttcatgcactgtttgatcacttgtcttattaaaaaaatttaaaattattatttatttgtttgtgatttactttattattcaaagtattttaagcacaactttttattttttatatttatataaatttttttaataagacaagtgataaataataaaaaaaacttaaaatttcttatattatgggacggatgtaatatctatcagctcatagaaagtaatcattatatgctccagccaataatgcatcacattttgcacggtcaccaagaaaagcacaatcataccacgtaccacgcccccacataaccacatgacgcgcacatacatatataaacagatcaaacatgtaaaaagattaagggtaattttttctaacgaagattaagggtaaattaattagtcaatgaggaattgcatgcctcagtttgttgtcgcatgattacaagtatgcaattgagctatcctacaaaggaattaggattatagggtcatctctctactaaggctatgttcggctataagggatgggaactaatccctttcacaaaaaaaacacagcggttcattagcgtgtgattaattaaatattagtttttttaaaaaataaattaatatgatttttaagcaacttttgtgcagggaatttttccaaaaaaacctttaacagtttgaaaagcgtatgcgcgaaaaatgtggggagtgggttcccaactctaggtgccggacgcagcctaaatacttttctatcacactatactaaatcgatcatctcgctccgatcatccaaaattccatccaaatatatacgcggatggaatttatacatgggaattggtagtttaatttgtgacagaaattgtaatgaatttcagtcatctccaatctagcactggaattagaagtgaggcggaaatgaggaggggatgatcagaggtgatagcaacttatcggtggcatcgcggcgacggcgaggccctcttcttcggcaaaaaagactaaggttttggggcggaggttggggtggaaagggagggttcccaagagcttagaggcagggatggtcttgagtggccatcggactggtggtgggcggtgaggcggcaagagcatcgttggagtcatgaggatgaagattggtggtgggtggggcgacagaggctgtgggtgttaggacacggtgatcgacggcaaatccgcccgcatgccatgggagaatggtgtggcctccaaatagttagtcaggtagacctcacgtgtggcgccattgataacttttggtcagcagacgaggctagggttagtgccgatgagtttgatatgctcaatcgagctcccatatgtatggttgtgcatgaggaggggaaaaggagatgagaggataaggttcaatatttatgcatgaatcacaaagttttttcgcgaacatgtaaaaggattacacgtcaatatattagaagaaaagagttatagttacacagcatgaatcacgaagtgatcctgaccgtccaaaagattaactgaaattattttcaggcagcttagaattagacaatctcttcctgatttctatgtgcacatcaatgctgcatatcatgccaaactaaactctaagagatcacttaaggaacacgtacgtacctctctgtatgtgtgttctacctgataatctatatccaacaaaaagtcatcaattatgagtgacccaattaaaacttgtttaatttcattcatcaattcagcatgcacgacacaaaccatataaatataatagtacatcatcgatcatacaaaattgttttttttttaatttgtactgcactgcatatggttggcattccttgcatgcaactactatctataaatctatctaggaaattattatgaaaggttagctaatcaatctctatagtagatttgatcccacatgaataatgaatagttgggggcagcttgcatcaatgcttggatggtccctgcagttcttgatcgagctggctcgaattattgcaggacagaaccctgccggccagatagctaaataaccagtatatatgtacacacatatgattcaactttcaaggagaaaagatcactgcactattattagtagagtactaaactacagccgaaagcaaaacctacaagttaagagtggttaagtactaacacacctcactctagctctctctagatctcttttcctccctcaaaagaagaggattgaaaatggaaaacaatgaaactatagctacttccctaatttaattatcaaatcaaagtgaagcaaaaaaagatgaaacctttgccgagtaaaacccggagatggctagtgcatcattgcatctatgtgaaagaaggggttttttttttccggttggtaccaaatatgtgctagcaaatcttttcactttatacatatatatcaaggataaataattatccttgtctgaacattgccaaacggctcatgattatgtactccatggaattaatagaagaggcagagatggtgcacacaaatgaaagctggtcctctgcaacatgtatatgatctttttgtagggcacacttcaaaggacacaagccatttcttccctaaaaagagatcgatgaacaggaccattcctgcataggccagatctttttgtttggcctcatcacagcaaagttctatccaagtgcttgcatccaaagggaaaggattagcaactatattatcactgcagaatgaagctgacctgtcaaatatttttttgtgcaacatcaataatatggattggcaataattaacatatattgtgtgaaatgagcataacacaactggttagatttctggtagtggaacaaatttaacacatgtggtcatatttacgactaattattttttcaatggtaggtgacgtacacgttgacagcgagccactcatggtaattttgtcaatcttaaactataccgatacaattaatctttcagatgtgctcatagggttaaggtgtgagcatttatacgagttagtgtatgcacattatgagcatatgtgtttatactatgtttttaaaagaataattaacgtatattctaggggataaagagtacaataaataccagtggtagctagctcggaggattgtagagggaaagcatgtagtagtagctagctccaaggacaaatgattgaaagcaatggccatgatgaacagggcacattcatccatccaaccataactgtggtgagaggtaagtgtatgaacaccaacgaagctgagcagggaagaacatccatgtccagagaaaactatttatatatctaattaatcgctggtgtacaatccaacatttcaacagggtctttactgcaatcacattactagccagtactcccttactaccaacctgtgttcaccaatcaattccaatactgttcacatgcttggaacagtacggtctgaggtggccttgccggtcgtcttcctcccctcatcttcttcctaattagcatgtttctgtcagaaaatagatagtggccctgattagttccaaaataattttttaaacttccaacttttccatcacgtcaaaactttcctacacacacaaacttccaacttttctgtcacatcgttccaattttaactaaactttcaattttggtatgaactaatcatagccaatgtcaacccgttaatggatgtgtagatgaaacattgatgtaggctaataagtagcctctcacatagtttacttgttagtttatcggtcgcaaccaaaatttaaattctaaaagttgaatttagaggggtttttttttatcataatccatttttcaatattaccttttaaactgctgctaacataaatatatttctggttgcttcattcttttcctagggctcattaacaagcaaccagtagtagtcataatcaaggtggttactgaatgattaatacaacagttaggaggaagacctggatgatgacctgatctactcctatctatctatccagtaatataactcgtggatgattagattaggagttaattctgatgtggctgcttgctgaatactactactagtagtacaactgcaagtgatgctttgactatgtgtggcgatggacagctgaagacagaggtcggtaggggtccacgggttcttgaccctgaccacaagcaaacaagagccggattttttatgttttggtcctttttaaaaaacatattttcaaactaggcctcataaaaaacttatggggcaattactgatatgcatccctagagatgttggtgctgataccagatctttgcgctaatcatagacgctgaacacctcctaagagcaactttttttttcttccaaatactattgatttactgtcaaattttgaaaaaaatgacaaatcaatgtatcctaatttatttatgctagtttatttatatttgagaggaggatatgagtccctagctcctccctatctgtaaatttatgcacggacacatgattttttttctcaataggggctgggaacgagaaagagggaggaacctacatcctcatcctagattaagaatttgtaaataaaaataaattagtcggaatgaattagaatatattgatctatcaattttctaaaattaatagtaaaccaataggagaaaacctaaataaagaggcaacaccaaactaatttgcgtcaaacctagacactcgatgctggagtatttggtacagagacattgcgcttcgatgccaacgtccttgacgtcgaggtagaggtccatatctgcaacaaacttttcaggggtctaattgtaaatatattttttaaaacgagcaaagtttgttaggggcctatttgcaaaatatatttttttaaaatagctaaaatgtaaacaaaattgaacaaatcaaagacccacgccgcagcaaaagcgagcccctcgatgccgtcaaacgtcgtcatctatatttcaacacctactctcacgtgaagattaacgtctgatgtctacgtaaaaaaagttactacaatttcctgatatcgttcatattaagttgcatgtggtggtaaagtatttttgttagatgaaagaaaggatatgaacgattgaaaggaaaaggtactgtttctatttgtaatttggcaaatagatactttcataaattttgcgtgcttttctggattatattatatttatttatttattcagcttaagtcgtttcatttgatttggtttgcatgcataagtcaggtaccaaaaggtttagactcgagaggaaacaacctaataagctaaagaaaaaagaaagaagcaaacaaaattattttttgtgaaacttttatatccttgttattagcggtttaaagtttaagtctcaaaaatagacgatgataaaaaaaaaaacctaaaatcaactgtaaaattaagtttcaaacgtagaaaatttggctccgacttaatataacaagcaaacaattaatgccgatcttactgaaaaaccacatttgtataaggagagtgattacaatgctagaggtatatccttgtatatatccataccattacacttgtccagtcgtccagataatgtgattcacatatttcagcaatacaattaattctagtacttgtaaattaaccagatctagtcgaccgacaatggtcatatataaaacaaaaattgtaaaatactaaaaagctttcataaacctgtacagcagcagacggcaagcaaccagagaaatgtgatggcagaggatgaaaaaccatgtgaaatgtcccggaattttccccacctttatttatctatttatttagatcaaacttttgtatttctccaattatattattatgatattaagcaagcaagaaattcggacagtgtcgggtagctgagcaaaggtgccagtgtgctttgctttttaactctgcacctttctctttagcttctcctcgcaaatcgcaatccccatctctccttcgtctttagctcatctcttgattgatccacctcgttgttctttgattgattggtgctttctttgagaggcattggtggtggagatcgatcaagaatcgtggtttgcttgtgcttttctgagttctttgcaatggatggtggattgtagtttggtgttgcgaatcttgggtttgcagagcatgtcggagtcgagcagggcgttcggagtgaatgcgtcgtcgtcgtcgtccggcggcggcggcggcggcgaggcggtggctggaacgacggggaagaatggtggcggggggagcgtggcgttccaccggctgttcgcgttcgcggacggcacggacgcggcgctgatgctgctcgggacgctgggcgcggtggcgaacggcgccgcgctgccgttcatgaccgtgctgttcggcggcctcatcgacgccttcggcggcgccgcgggcggcgacgtcgtggcgcgcgtctccgaggtgtcgctccagttcatctacctcgccgtcgcctcggccgccgcgtcgttcatccgtaagtgcgccgcgccgcgccaccacttgactcgcaatctcgctcgcagcgacaagctcaccgtgatcgatcgtgttcttcatcagaggtggcgtgctggatgatcaccggcgagcggcaggcggcgcggatacggagtctgtacctgaggacgatactccggcaggaggtcgccttcttcgacaagcacaccaacaccggcgaggtggtgggcaggatgtccggcgacacggtgctgatccaggacgccatgggggagaaggtgggcaagttcgtccagctcctcgtcacgttcctgggcggcttcggcgtggcgttcgcgcaggggtggctcctcaccctcgtcatgctcgccaccatcccgccgctcgtcctctccggcgccgtcatgtccaatgtcgtcgccaggatggcgtcgctcggccaggccgcctacgccgacgcctccgtcgtcgtcgagcagaccatcggctccatcagaacagtaaaaacattccgtcgaacacctcagctaccatccatttctccgcgccgccatggccctgaacacccggctcaacacaggttgcgtcgttcaccggcgagaagcaggcggtggcgaagtacagtaggtcactgaagagagcgtacagctccggcgtcagggaggggctcgccgccggcgtgggcatgggcacggtgatggtgctcctcttctgtggctactcattggggatttggtacggtgccaagctgattctggagaagggatacaccggagctcaggtcatgaatgtcatcttcgccgtgctcaccggctcgctgtaagtttcgccgccccgcgagcttcttgatcaattcttcagaaagaatactaagtttgtagcaaatttaagagcatgaaagtttttagtattgaaacaaaatgaatatcatgaaagaagtatgattgacaaatagtcttgtcaaggatattaagagtatggaagtttttaggattgaaaaaaaaatgaatatcatgacaagtatgattgacaaatagtcttgtcagaaggataataagagtatgaaactttttaggattgaaaaaaaatatatcattagagaaagattcaggtagttatttggtgattgataaagtggggtcttactacacattgggataatttggattttgtggtgatttagacatgttaggcaaagaagctaagttagctgctgtgttgacagtgataagcacttgtgtttcgtgagcaacctgctaaaccaactgtgcacgtatggtctgttcatttgtagcagcagcaagctaagtgtgaatatccactttgtctttttggtgtcaacattgtaccaattcactgtcataaaagttgaattatctcattcaaccaaagtaatatatgcttttggatttacgccgattgtattttcatagtcttcttttattaaaaaaagatgcttcttctcatctccttttccttcagaaagaacctcatcagataattttagtgtttgagtttgcaatggtcactgaattttctactacagtctcattatgccaatcaacttttaccatgattacatatggtattttttttcaattaaactaacaggcataaactatttattacttcctgaagctgaaactttactattacattcactagagctctaggtcaggcatcaccaagcatgaaagcattcgcgggagggcaggctgcggcatacaagatgtttgagacaatcaacagggagccagagatcgatgcgtacagcgccacaggtaggaagctagatgacattcagggggatatcgagttcagaaacgtttacttttcgtacccgacaaggcccgatgagcaaatattcagagggttctcgcttgccatacagagtggaacaactgttgcattggttggacagagtgggagtggaaaatcaacagtcatcagcttaatcgagcggttttacgaccctcagctcggtgaagttctaattgatggagtgaatctcaaggagttgcagctaaggtggatcagaagtaaaattggccttgtgagccaggagccaatcttgtttgctgctagcattatagataacatagcttatggcagggataatgctacaaatcaggaaattagagctgcagctgagcttgctaatgcctccaaattcattgataaaatgccccaggtcagtggactgcttaaccccttgaacttgtaaatagtacatcaataactgcataaattgtgttgaaaactagaaatggctacatatagaagaattttagctattaagagaagcttgaactatatattctgtatcatatattgagcatctgtaggtcacaacatgtcacagggttttgctactttggttggtgaacatggaacacaattatctggtgggcagaagcaaagaattgccattgcagagcaattctgaaagatccaagg

SEQ ID NO: 73604 - DNA, 42166 bp, Oryza sativa
ttttgaacaaatccaaatattttgagaatctgatctccaaaattaaataacccaaaacagatgtacttaaaacacaatgttaggttttgtcagacagttgctttgacattttatctattagagattaagtttaatgtgcatatctgtgtagtgttatttttaataaaataatagtttaaaggatgttgacaacacatcagtgtgaattttcacgattagtatttctttccgattctttgtacgtttgcatgttttcttttatttatttggttttatctgttttatttatcgtatatggtgtaggtatttaagttttatttttttaggatggagacgatcgtacgacgtacgcacattatgtttttttttccagatagagattagcagcatgggattttaaatatatctaaactaatatttaaaataacgggtcctccaatttaagtaaaaattaaaggatcatatgcttttttttttctctgaatttctaagatttctctaatttattatagcacggcgtgacggcgtaatagtttttgcaggatgtttaatgcacttttagtatataaataaatttctagaatttctctaatttattagagagacacgtagcagtgtaggagcattcgtcgtatgtttaacgtacttttagtatatatatagttgatagataatagatagatttataagatgttttaaagaacattgattggatatttataatagatcttaatttgactaaatatatttatatttgtgaagtaaatatattttatctttatactgtagaaaatcatattttaaataaataccgtaacattgggaaagttttattgttttattttcaatacgtacgtaacgttctgtatcgtatataaactctatggctgaacagtaccgtttctatgttatataatatatgaggaagttattattttttaataatagatctaatataatggtgaaaaataacgggtctaccaatttaagtaaaaatcgacggtgagattagatagtgccacgtggtggcttaagagtgtttgtaggagtgccacgtggcggcttaagagcgtttgtaggaagtttaatggacttttagtatataatagaagattagacttaaaagattcgatgtcatgttttcgaaaaaaaattttggggaactaaaccagacctaattcttctctgaaatctcttttactctgcttatctaccgtgatgtactcagaacacacaacacgcccggagaagaaattatggaaatatatatacatattttgttttcttttgaaccacaccacttaaaaaaacaatttttcggacataccctctgttttattgcaggcgggctaaaagaatgtccacatgtaaaataatttgaatgttgttctgtaaaggaccgtatgttaaaattgattttcgtaggccggtaacatttttaataactttgatggaaacaaccgttattataaaatgttgttttaaccccgcaaaaaaaaatgttgttctacaatcgtaactgcttgtgttatggaaagtaggcatggcttttctttttagaaaaagtacgaattaccccccgaactatcgcggtcgaccgattaccccctaaaccagaaaaccgacatcgttcaccctcaacttttaataccagacaaactacccctgcagagcggtttttgtcctacgtggtgtacacgtggcaatccagtcaacattttatttattcaaaaaatgtgggacccacctgtcatactcctcttcccctcttcccctctcttctctctctcgctctttctctctctctcagcatgacggcggcggacggcgtggtcggcgcgcaaggcggtgcggccgatggtgggcggggcggtcggcgcggatggcggcgaggcggagaggtgggtcgcggcggagagtcggccggaggagaggcgagatgcaaccgcctctgcgtcccgtgccaccactgctccctcccggaggagttcaccgctgcctgcgttccacgtcgccgctgctccctcccggagttcgccgccaccacctctgcgtcccgcgtgcgccaccacctccgcgtccctctcctccgccgcctgcctctccaccttgcccgcatctccgctaccgcccgcctgaccgcgccgaccgcccccgcccaccgttggctgcactgtcatgcacaccgactgcaccgttcgccaccatccccgcaccgccatgcgcatgccgagagagagaggaagagcaagagagagaggaagaggggaagaaatgtatgataggtgggtcctacattttttaataaataaaatcctgattggattgccacgcgtacgccatgtaggacaaaaccgctctagattgggtcgagggggggtaatttgtgcattattgaaagttgagggtgaacgatgtctggtttctgggatgaggggggtaattcggttgaccacgatagttccgaggggagggtaattcgtactttttcctttctttttcagatgtgcatatgcatatttccatgtacttgctgagtatttcatgtaatcaccacacaattgccccaactccagaaggaaggtttccgctattatctaaggagtttgctactgaaatcgaggactaggccatgtgccacagttgattatctgtgacatgttgaatggagcttccgtgcatttattttcttttccgttgtgctattttattcttgtgttgccctcaagataaataaatgtaagtgagccataagggttatcacaattatttttattaataaatgttagttttttttttttgatgttggctgttatattatcttcgtactgtgtgtgataggttgattctggactagcacgtatacacagtaggttctatttttggatggagttgccgtacgtgcgaactctcagcggtgtatcaattaaaggagcaactctgttctactcccctgttttatattataaatcatttgacttttttttcagtcaaactttgttatgtttgacgaaatttataaaaaaattagcaacatataaaatattaaattagttttgttaaatccaacattgaatatattttaataatatgtttattttgtgttgaaaatactgctatatttttctataagttatttaaaaagttcaactagaaaaaaaaagtcaaacaacttataatataaaatagatggagtattgattaagtagcccaagtttcacccgcaaattcataatctattcatttcacattgtgcaaaaaaaaaaagcatacgaaacaattacaagccataaacatcatcagggaataaatgtgagactcaaaattacagactccatcgaggattatgccagtctaactgcatgatggactttctaatgggacccattgccactagccagaccgagccaacactggtccaaccatccctatagacgatcatcaagaacctaacaacacccggttaaaccacaccacatctggtccgaccgggccttatcttttcgtttatacttataattgtcagctaaaatttaaatttttaaccttaaatttggagctgcctttgaagtttttcatcaaaatttgtttttcagccttcagttctagatcgctaagaacaaatatataaaagttttatttataaattattttttatttataaatataccgtttcgcttattccgcgatggcttcgtaggaggtaccaacaggtctgaccaatcatggaacactagtccaatcatacggctcccgatcgatttgaccgggatcgcaactccactccattcagaccatctattcatggctctttcacccatttaattaaaatgttttaattaaacatcacttcacaacaatatcttaggccctgttcagtttcagagataaaaagttttgacgtatcatatcggatatacggatacatatttgaagtattaaacatagtctaataacaaaataaattatagattagtctataaactgcgagatgaatttattaagcctaattaattcgtcattaacaaatgtttactgtcgcaccacattgtcaactcatgacacgattaggcttaaaagattcgtctagcaatttacacgcaatctgtgtaattagtttgtttctatatttaatactccatacatgtgtccaaatatttaatataacagagtgaaaagttttttttgcgtgggaactaaatcccttataatcattatcataatcaactgttcatcacaaactattattcttcaccatgattttacatattgttcacacaattgagcagtatgtggatcgacgatatgcagaaggcctatgcgtttgcatgtttatatatagtcacaagtacggtagaaaatgtgacataacaagggtacctaacggtgggggccagtagcccagtgaaaaaaaaaagagagaatccttatatgccactgaaaattggtctgattccttatatgtcattgaaaattggctactcccttatatgccattgatctaaattttcacaccctctcatgtcactcccgtcagttgaccgttaattctcaagaaaaaaagacatatttacccttctgattatagggcatgcctaacaactcagagagagcaaatatgtcttttttacttgagagttaacagtcaacacacggtcaattgacggtagtggcatgagagggtgcgcaaatttggaccaatggcatataagggaagagccaattttcagtggcatataagggatcaaaccaattttcagtggcatataagggattatctcaaaaaaaaaaatgcccaaggagctagctgtgggtatgtgttcgggaaccctcgctcccttccctagctcgtgaaacaaagtagtgtttagcgcgtgattaattaaatattagctaaaataaattagaaaatttggattaatatgattttttaaagtaacttttatataaaattttgtttttgcaaaaaaaacgtactatttagtattttgaaaagcgtacgtgtaaaaaacgatagagatgagttgagaaagcatagataaggactcaaggtccgatccctgccacataattgggccacgtggctaaggcctggtttagttactcaaatttttttttcctaaaaacattccatcaaatctttggacacatgcatggagcaataaatatagattaaaaaaactaattgcacagttagggggatatcgcgagacgaatcttttgagcctaattagtcaattagccataagtgctacagtcacccacatgtgctaatgacggattaattagactcaaaagattcgtcttgcggtttccagttatgaaattagttttttcattcgtgtctgaaaacccctttccgacattcggtcacatatccgatgtgacatctaaaaattttcttttctcgaactaaacatgggctaaataacctgaaaggaagtttacatatagtaataacgtgccacgtatccagcagagcaccgtcgttccatttccgtgctaatttggtgtgctgcacacctatatatcggccatccgccccttcccatcccgcactgccatcgactctctttctcaggcacatgcacgagtaatttttatcaggcacagccatgggctagctactgggagcgccaaatggtgcgtcaatatatatatattctagtgtgttgcactattgtctggtactctctgcacctatagcaagagtgtatagcagttgcatttctgacgaactgacgaaagtgtgataccaattaaactcatctatatatagctaagggcacccatgttgattggataatctgtatgctaactttctagtgtgttattttgggtccattgaacaagcagtcgaacactggacaagccaaatgtaataccctatagcccccatccatttttcttcgggaccatgcatccgcgctccctgctctaccaataaattccaagctaacctagctttgagtttatgagcatgtttgtgattgacctaaatcataaattagaaacaaaagtggggttactcattgattatatcgatcgatcggcagatacaagctagtattttggtacagatcatgaaaagagattcgcaccttccaacaatagtaaaaatgtattttgaccaaaaattaacttaaacaataatgcaatctactcgtagtataatactacaagtagaaagcaccagagcgtcccccttatagaaaatatagatgtcgttcgtgtgataggtatttgctaactagaataattccattctccccaaccacctagtgaaaactgtaacctcttgagtgccaggattcagcatgcattatacgatcaaggtgcacaccctaaactagcgcatcaaagatggttaaactcagctatggttaaaaaatgcaagcttgaacaaacctgccttaaaatcacattaatcacgctagttgaagccagttttctccgaggactgatagtgtcacaagcacatcattatgttccccatcaccaaccaacaatttttacatatggcgttgtggagaaggcatgagagctgcattggccatctcaccgcatgtccatcaaccgagttgacaaccagcccataccaagatcacacattagattcctcatgccactcattccaaaaagagtgtaaaatgctcaagtgcatgtacatcgatcttgcacttgttaaaatcgatcgaatgataactagaagtatatatgtgtaaatgtttttgacagtgtgtggttatgaattaaatgatcgatggcatgtataaataatgccttatttcaatttgcaagcaagctggtaaactgatgaccgctgacatgactcacttgaagcatactaaaccagaagaaaaagcaaggttataaatggactgttctgacaaacacgttggctaatgtatttgtactggtccacaaagaattcaaaacaatactatcacttcgatctccttgcaacaaaaataaaaataaaagaacaaagtccattttattcccttgaactattttgctagcgagtagcgagtaaaatggacttcttcagaataaaagaaaaggtgttatatattccagcaattaaccgtatcggaatatattttggtcaaattttctctctctctccatatgtaagcttaatatatctacactaacttttttaccaaattgtagaatgtattgtatcaaatggattacaaactcatttaattaattttaagtcccaatcgtcctccctgtatagacattacgatattattaggaaggtgaaggtagaaaacctaaacatccaagcgaatccttgctcgcacgtgcaacctgtttacaagctagtccttctcgttcccgaccagcaaagctccaatcataacctaaaatcaatttggtgctgccacaatctaaaacggcgttgctccaatcatgttataccagcactctagctaacaaccatcattatttaacttcgactgcggaccttcagctaacttgttttactgacaccgctcattccgatcaaatgttcatgccagtcatgcatatttctcgaacgagcttcagtgacgtggatatcgagtttgtctctgcccacagactgaaactagtgccaaatcaacctggcaatctggacttgagtggatcaaatcggtcgatcaagcaattacaatttgtctttgttttttcttacctagcaaacaaattaactggagcaacccaaaagataaagttgaggatatcatgagcacatgaggcaggtgaagggagtgagcattaagtaaaagcgccagaatgtgctacacctatatttatacaaacgcatatatgggttcaaatatttaatcatctcaagtgcatatggataaatcaactgtaactatggacctatcgtagcgcttagagtttgcgcctttcagtaagtggtaggtagtttggtatccaggacggtttagtataggctaaattgtacattttaggtctgcaacatttttagcacatctgccttatcaacaccaactactagaaaaaccatatccacaaacatcccgttttattttttgaaacgggcttaaaaaacccttgcctataaaaatatattggactcctccagttaagacctgcttgtgtaaattatttttttttcaggtggtcatcttaggtggtgtttgaatctcctaaagatgaagataaagataaagattaaatgtttcacacaaaatgaggtggtaataacgtgtgattaattgagttttaattattacaaacttgaaaaatggattagtctgatattttagagcaactttcatatagaaatttttcgcacgaaatacaccgtttagcagtttgaaaaatgtgccacgagtatccaaaattgaatcttgtgcttgcagaaggtctcttagggagatgcctgaaaaatcccttctatccatttggcccctactattgaacacctgaaaaaaatacccgtatgtgactctccaccatcttcaaaatattttactcgatggatactactgtcctgcattttctcctcctcccacatctttccgtctctcctcatcttgtccctctcctctccagcggatactgcaatagcagcagctaatcgaactacaatggtagcagcaaatcgaactggaacggcggcagcgggaaggggcggtggtggagacgccggatctgagggtggtgtttaaggggagagaaggggccgcggtagcagcagcagagaataagcggctgtggtggaggcaaaggaactagaccaaccggtgcacgcagcttgagcagaggattggtaagtgtcacataaagcctttcacaatgcaagctacacagattgaatggtcatgtgaaaaaaagttaattccacattgaataaaagtattagaagaaactcatcccaccgtgtatgaatccctagcaactacagaataatatcaaactaatacttttcgcttttcagtcatttcctctctcacctagctagtctctgcatcctttgtaaactatgataaggcccgaaggccgccttcgttttcttcatatggacacgaggtgtatcgcgagacgcggtatttgtgcgcatggagaagaacctcctacgtggatagttgaggctaaacgccatatacgtgcactgtgaaagacctaaccggctaaccccagtcacccactaatacatctgacatatggctctgtggcggaggcgtacgtgagcggtagctgcgccgtccatgactccaacccttcacggcctgtcatagactcatagcacgtcaatcaacaattcaacatggacgacaaccagcccataccaaggtcacgcattagtttcccattgccactcattccaacaggtgtaaactgctcaagtacaggtaaaccatgcacttgttagaacggttcgaataatgatatatagctagaaacaagtcaaattgcaagctgattggggagatacatatgcgagaagctggaatgggatctatatatgtgtggtgatggcgtctgtatgataagaagcatgcaggtataagagacaggagtttgtgaagttatgctgcatgtactggccatatatatgcacaaaattcacaattgcattgaaccctgtttgctgcttaaaattgaacatgaatgggtagtttcatatatagctgagtacagttgcacatggtcatcgtgtattagtttccacattaacataataacataatatcatctatcttctattacatattaaaagtccacaaacgctctaaagtcgtcacatgacacttctataaacgctcttaagccgtcatatggtactttttaatcttaccgttgattttcatttaaattggtggacccgttctaatctcactgttgatttattattttacactattagcttagatttattattaaaaaaaataataacttcctcctcctgtatatatgatacaaacacgactgctgttctgatccgtaggaacgtacgtacgtacgactgaaaacacgtaggtagtacgattgaaaacaaagcttaccttctgctggccaacggaaaaaatcgacggtcaatttattttttacaatatgaaaataaaatatattacttcacaactataaatatgtagttaaattaagatcgataataaaaatataaaatatcctatcaacgttctttataccaccttttattttttttaaaaaaaaattatatatccaatttattatcccgttgtattctttaaatcaaatcaaactataaaattgtaatattgaggtccttaatacatcagaacacatggggccgacatataatagtcagttatgtgataatttttcaaaaaattcacatgatatttaaatctacatatgtaaaaaatgaaaacaacacaatttagctgtgtttttcaagtatatctaagatttaattgtaatttatttgagattaagattcataaagttttttaatattttcagaactatttgattggtatttgagaagtgggcagcatacatggtatacagatatgaaaaaaaaagtcatcaataacatttccagccaatgatcttgctataattcttccaaatatttttgacacacatgaacaatgaagtaactggcacaataaactactcatattatattttcttatactacaagtgaactccaacggattagttattgtaaataagcttgaaaaaacaaatatattcttcaaattactaaaagtatctcatgtggttatgaacaataggtgttgaaaacaaactaggctttaaactatagatatctttcaaaatataaacaataatatggtgttctgaatattatcatggtgatatgtctctataactataatttttataactataatttttttaagtatcataatgattaacctcactcattttcaaaatagagtattctatctatatcatcaaaatttgagtagtaataattgacatcataaatgtcgacgtttgagatcgcgactagggtatttgcatagtatggggatcgttggtaccagggtatatgcaagattgaagtaaaagagacggaggcaaggatttttatacaggttcgagcccatcatctgataggtaatagtcctacatcctattggccgaagccgatgttgctcctttattcatctgaatcacacaagtacaataattaggataacccatctagctgtcgtcgacttggcggcatggataaccagctcgtagtcaacgatagggtagtcttcctcttcgaatacgcagtcggtgggatcagagatagtgctagatccctcttgccagcctccgtaggaaccggatgggtatgtctaggctaatctctgatgttgatatccagcggcatgtcttggcttgtattggtctatgttgatcctgtggcttgtcccctctcctcctaggggggcttgtatttatacccatagatgcccccttgtccaagtagaactaaggagaccaataagggtacaatccgggtagtccttgtcatttccatatagaactctactcatccttccttatccggaattccttctatacacgaggtttgtttccgtataatacatggtatatggtgggccctgccgagtttagtcaactactattaggtatgtggtatccataaccatggcagtagcccccaacttcaatgcaaaataacgagtccatgttctcgaccgaagacttttgaaaaactgttgtcgtgctcacttgactgttctcggtgagatcagagatagcgctagattccccttatcggccttcgcaggcactatattgggtttgtctaggtcccgatgtcgaccgagaaggtatggagcatgcgactaagtctcccgtcttgctgtaattgagaatttgaattgaagtcaagtaattccatctcgacgggtacaccatcgcttcattccatattccttgttgagctccatcaaccgttctcgagtaatcgagaaggagcaaagtctgtgacaaagcctcccaacttgactgttgtgatgcctgactttccttaaatcaatactcataactgaatactaaatagaaatagcccccaagtgaacgctcaagggtaacatgatataatatttatggaaaattgaaaataatttgaactgtgtatgacaataaaagagtactctccctagagttgccctcagcaaacgaagtttggtacccttcctagcccccagctgtttttatggaaaaactattttccaccaagacagcttgaatcttataacaaaccatgctgaagctgacaagtcctagcccctagccgtgaagttggaaaagtcaatttccgactacacggcttagttaatacgcatccattgagcactcttacatgaccatgtcttacatggtcgttcggctcttagaatctgataataccttatctgctctgggcgtcctcagccaaaattcccatgggtttcttggaggcttgtcggaacagcgtaaaggaatagtaggaccgacttcaagatgaaggcgatataagaaaagaggatcactagacaaatattgtacacataaacacttatagaagttgacatatagtgatgagacgacttccacactgggtgaagaccaagtgtatagttatacttaacaaatcgcagaggtagtgggagattcgctacattgctgatcaaagaccaattatagtcgtaactcgaccacttcagtttaaggtgcgagagatcgctacatcctactggcaaataaccagaagtgagcacctctcgaccgttttgaaatagaggtgcgaggaccgctacgttgctggtcgaagactagtcgtagtcgtacctcgacctttagaagtcgtggtacaaggaccgctacgttgctggtcaaagactagtcgtagtcatacctcaaccattagaagtcgtggtgcgaggatcgctatgttgctggttgaagatcagtcagtcgtacctcgaccacttgaagggaatccagagaaacaaatggacaacattctcgtgacctacgagaattgcctcctgatgacaacgaagacaatgaggaattatcgtagtcggaggttcggctcctagacctactacctcatcctcgggccctctaaaagtctggggatctcgagttttgtctttgtgtgatgtcgtgatgttgttaaccttgtccattgtcgctctgattctgttaatcctagacgttgtcgtcctggtgactacggcgatcctatcggttttggttgtcattgtcacgatcacattgattgttgtgttcgatgtcgagagattgctgtaaccgactggtcgaggaccaggagtaggcacatctcgattacctgaagatgaatttttaggtggtgagagatcgctacgatctactggtcgaggaccaggtgtatgcgtatctcgatcacctatatgcaattgataggcatacgaaaacaaaccgtattcgcgaaagcatctcttgttatccacgactccccttatcaatatttgccatacacacttggtcgatcccagtgtaagaccgtagagacatggagtctttgacacgatagattgagtccaacagtccacaagtgaatataaattgataggcgtcgagatgtcgctacagcagtctggtcgataaccaggagtaggcatctctcaatcacctataggggcgctagatttggttattacatgtgcatctcatgtggccagcatgactcacatacccaacttatagcatatccggatgtttgttcgcaatcatgtcgggtgatcaagccaacaacgtttgcagaggattatccgttaacaacctattcccaaatagtccagctgtagctgtcgctatacatgagataggtcgtcggttttcgttggtaggttgggtgcgacaactcagctttttttgagaatgttctcgataatggggtgtactcaaccacatcctactcgagtgctcaattgttcctgaaaaatattttcaagaagacaagatatatagcagaaaatatcgagcatgtactaaaaaactgcattaatcttctagtattattaggatataatgagcagattaagtatcaggcattatgtaaaccgtaaatgtcgtaggatctccggaccttccattataattgagagatgaaatgtataattcaagtcatcaaacaagtataatgaaatatccgacgcctcgagagaggaatattggagacattgccgggcctttagcctgccagtcaacttcagcctgagatgtacccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaaataagatgaaagcgattataaactaaatctactttagatacattggccgactggccaaaaaaaattatatagaacagcggaagcttgtctacccaatccacaagcacaccgactaggggtttaccccattaagttcaagtcctagaagaagcagtcgatcacccgcatcactcaaaggctaagtctaaaacctgcaagcaaaaggttaattccacagcaagagtcagtacattattagaaataatgttctggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtatttgacatattgggcatcaaggtaggcattaatcatgtataaatatgcacctcattgccttccatggcagcaaggagatcattctcaaatctcatcacaatttgaagttaaatttcagcatttagaagaattaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccaatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcaccatatgtgcaccacttgaggcccaaccctaaaatccatgttttccaccattttatttatcaaatacttcatttattcatatctgtccagaacttaataaaatcatttttcatgttaatatgagcccaagtgataagtaaaactattctaagcatggctaagcaatatagtgaactagtgacaatgtaactcatattccaagtagtactaggatatgattcctaaggttaggaatgagggagatggatatatatggggttaaggtgataatgcaaataataggagtttgtctaacaagtttaacaagattttaatgtattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcatgatttgtgcagagagaataggtactggtataaaatgaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatatttgttttctaagactaacacatttggtttcataatttttagagttaatatgaattatttatgtattttacaagttttaacgtgttctaggcatatattccctatgtgtacatggctttggagatttaggtccagaacttgctctaacttgctagtgttgtataaaatgagtattttagttaactaatataatcttagtttataaaattttagtgttcagattactttacttcacattttataagctaggggatgttctatgttagaaacttaacatatcaatctagagagtattatatgagttaaggatactaagttttggtggaaggggatggatctatgccttcactggttcaacaagttttatttggatttatttggagctaccatgcatatatatatactttttcatatgtattgttttaaccactactatgtgtttagtacctattctaccaaattaaggttcagagctatggtctctaaagagggtgctataattcactctactaggttgaagtatattacttgctagttctatagaaaatttggttcacttcattttgactatagatgaattttctacaaatgttacaatttaaggtatgctccatgttgcttattccttacttaaatacttaggggttttcgttatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggttgatctgtagaaactgagtttgctccaaaatgagttcaaatgaattttgtatgcattttataagtttgtgcatgctttatgtgtgatttaacttggataaattttagaggctaaatttgtactgtgagtgcaagtttttattccataacactaaagttcacaatttggtgagttcacagaaatttgtatcatcttaaaatgagctatatttaattttatatggattttacaagttttaggtacttttcttttataatttcagatttttgtttccaaggggtccactgtcagtgaaagatcaatatacaaaatgatccctgaggtttctaagaatcaacccgcagacctagcctcatatgtcagtgagttgaaaagttgcacattaaaccttatagttgtttaaattctcgaaacaaggtccctgacttcttttctcacgcacagaggcagaacagccatggctgagctcgatctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatggtagacatggctggggtagctaggtttatgacggtggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgtgacagcttggcccgacttggtccagataagcgggaacggcgatgatgtcactgcggcggtgcacagagcgcgctccagagctccggtgtgcacggcagcgtttccgtcgattggctgcaccagagaggatgaaatcaaaaggagaaatattcggcatggtgaggagagtatggaacgcaagagaagaggaaacgaccgcggctcatcaacgattgcggccatcgtcttcttcgcggccggcgatggagaaccagtggagaagagcagcgaggatgctctccctcggatggatcggcactggaatggtgggtgaagagtggcgacgcgtctgggagaggcagaaatggagctcgtcatttttagggtgtcgacacgtcgtggccacgcgtcgcgcggcgtccagagccggtcggcgctcgatctctccctctcagtgtttctcggtcagctagggaagttgcacagaggaagggcaagccagagggactgacaagggggcccaggtcgaagtaaactaggtggaagagagatgtgtaggcagaaacatgggtgagcttggtttttggacgaatttccggaattattttctcctctaattttgtagcttcaatacttaatgtgttgatcagattagctagtgttgattttactggaggtaggtgtatgtacctagtttccattttctttggttgcactcaaaaattatggatagattactcacagaaattagaggaatatgggttctttggaaactagttcgaatttttaggagacctaaacagagaagataaattctggaaaaattatttttattcatgataaatgacctagtatttgaataaattattttacttatacacttttatgcagttaaatgcacttttagacaaagtatggttttagccgattaagaactacagttaatctagtttttattagtttggctgatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttctctttcctaaatgcatgtaaatgtttataaaagttatatttggactctcattaacctgaggtgatgttgatatgttagaattacagtttaccttacacatgtcataagctcctttcctatttatgcatgagtttactttagtattaaattaagagaatgcttatagagatgattaagatagaatataccctatatgatataatttatttgttcactttcatgttcatgacatgtcttcagatggatgtcaaaattagttttgtgaggcttgacattagccatgttgatattttttttaaggtgtatggtttctatgtattattttccattagttaacactaggccctaatggtttagttgtttatctagatcttagttaatattcatgagacctattatgaaatgcaaatcgaaaatccaaatgcataagaaggactcaagtcaaaatatgatttatgcaagtatgcatgctttcacttgggttgcatccaagtcctaggttaaagatgaaaaagtttttaatttgttctcaaattttattcttgcaagagttggatcaactccacctaggtttaaaatagaaattcttggtttacaaaattgaagaacttccctttcaactagttttgatggaaattccttaatcctagaattcaggtatgttacagtaaaccagcatgatacaaaagaaaatagagcgagcccccagtatttaaccgttgtcggccaaatacagggaacactcacacaatagatgtataaaaaatatgctctaggtaaacatagtagattattgatctgataatattgtagtgatctgaataatgggtacggtaaattgtatattaatagattaatatcaaaaattagtctactaaataccttaatacgtccggccggttctgggaggaggttgagaggggagcgctcactagtacaaaaaccgtcataggtgccggttgggaatcggctataagtgccggttttcgaaccggcacctattggtcggcaccaatacaagaaaccgacaccgatgtagaaaatagaaccggcacctttagctttactcgagccaaaaaaacaaaggagagccggctcaaatcgagccgaactactccccagaaaaaatcgaatccaccgtcattcctctctctcgcccagatctactccccttcttcgccggctctcagatgcgagatcaacttcaacaacaaaccgtattcatcaagaactagcgaacagtacaaaccattaaccacaagtttggaacaaaaactcaacaagtttagaactagaactcaacaagaaatcaaaaagacaaactcaagaacctatgccgccggccgccacctcgccagcaccaccggcgtccctcaccacgctcgccgtcattgccgcatggagagggcgtcgcccaggtgcgccgcacctaccttcgttaggcagctgccggacgtggaagcccgccgcctcccctcccgctggatctggcggatgggagggtgcggccacctccgccaccgccgtctctccaggcaaccgccggtcatgggaacacgctgcctacgactgctcgccgcctccgccaggcagctgcgaccacgggagcccgtcggccgctgcctacgagtgcagccaccgcgagagagagaggagggaggcggagggcggaggggagcccgtcgccgcctacgagttctcgcccccgccgccggctgcagagcccaccgcctcgcctcccgccggatctagcggaggggagggcacagctgcctccaccaccgccgcctctccaggcagccgccggtcgtgggagcccgcctcctacgagtgctcgctggctccgccgggcggccaccgcgagagagaggagggaggcagagagacgcacgagagagagggacagagacgcgagagagagaggtggataaggcacagtcgttgtggccacgagtagagaacgacgcggtgcgctgcgctcgttgatgggcttggctcgtaggctcggctcaaagttataggtgtcggttttttaaaaaagaaccgatacgtataatatattataggtgccagttgttttaaaaaaccgacacctatagtataagtgtcggcttttttcactagaaccggcacctatagtgttttatataggtgccggttgttttaaaaactgacacctataatataaatgccggttttttcgctagaaccgacagatatagtgtttaaaggcgtcggttttttatttttccatcacagggtggtgggaaaagctctataggtgccggttttaagtgaaccggcacctatagatcgttccctttgagggtttttatagtagtggatctggaagggagggaggggagcgtcgccagctctcctcccactcgccacgtgcctccgcgctgccggtggcctctgccaccgccttcctagcatcctgatctgcgagggagggaggggaggggagagccagtggctagttgcacgctcaccgtcggccgtggccaccgccctccgcgccgctggttaccgccgccgcctccgcgctcagcaccgttggctgtggccgccgcctccgccctacgtgccgtagtgagggagtggatctaggaggaaggagtgaaggagtgaagggaggggaagagagtgcagctgggagggaggagtgaagggaggggaagggagtagatagagataaggggttggtggcggataatacgaggtcggatggtttttttttttttttcctttcaggcggaggatctaaaggttccatctcagacagatatcttaagaggtccgcattaaaaaataaaggtatttttgcaggtaaatctctttaggtctgccttcaaaacataaaggtattttgctgtgaaaatttttcgcaggtagacaataatcttgccccattgttattttcgtaggcgggccaattagatccgagaggcctatccatctaaaaaaaatatgccatcatgtgaaaagatggtttttctagccgtgactcacgaattgtgtatctctcgtgcggccatggttggttcgtcccaagcaatcggactaaacctgtaccaatatacacaggatgaatgacaaggcgggtgaagggtgtgtgcatccatttattcttcggtgttcatgatacaaattaaagagagaagcgaagggtgtgtgcatccattttgctattatgttcactaccaaatccggtgtgtatatcgaatccagcaaaatcagtgtgctaagaagtggatctcgtgttccacgaaattacaagcacaacttgatcaacctttgaatcgatgccaatcggcacaaatgcaagcataagtttttcaatcgataccaacacaagcttatcttttgaactgatacctctcagcataatacaagcacgttgtccaagactactccaggtccactaccctccctccccataaatagccagaaccagactcgccaccactcttgcgccgctccttcctcgccttgttccccgtggctccggccttccacgaggtatgcccgtctcctcctactcctactgtcgtcacgtcggtcgatagttctataagtgttgtaattgcgcttttgatcatattttaaagcctaactaccgtgactatctattatctatcttctattatatactaaaagtccattaaactttctacaaacgctctcatgccgccacatggcgctctaaaaacgctctcaagctgccacatggcgttctaataaaatagagaaaatcctagaaattctgaaaaaaaaatctagccctcaattttcatttaagttggtggacccattagtttacaccattagattagatccattataaatagtaatctatcctatagaggccaaaaggctcgaggcccgatggcccggcccatggcacggtattttggcccagcccaagtacggcacagcccaacggaggtcgtgcctgggaccctccaccggcacgttgggccagcagccaggcccgataaaaaaaataggggagtcaaaatagacatattatatgccatggacgaaagaatagggatgtaaaatagacttattttagctatacttatgtcagcccaaagaggagggatggaaaatagacttattctagctatacatatgtaacagcccaaagaggagggataaaaaatagacttattttgaaaaaggcccgatgggccacctgtgccttcgggccggcacggcatggctcgacagctgatgggccgtgcctgggcgggaggtgcagcccatggccggcacggcccggcatgaagtgccgatcgggccgtgccggcccgatggctggtgggccgagccgggcgggccttttggccatctataatctatccctcctaatttaggtgtaatacttacctaaacaatattggccggaataataagccaacaaggcttacgtacggacgagttaacaaccacaaacgagaaaggaataaatgatatacagcaaaaaaaaaaagaaaaacatactgcatatatactaagtactactggaaaaaaattgctttttaaactggattttcactttctttgtattattttatgacggccaatgttaaatatatagtgaaactaccgaaagaaaacaacgatttaaactagattttatattatactttctcttgatttttttattttatttatgatgatcaacgccaaatatttagtgaaggtggtagtttaagaaaaatatattacttcataaaacgcacacctaaaattagatctataatataatataaaatatcaaataaacatatcatttcacactacaattattgggtatagataacttttagttgcatcaatgggcctacattgatagtttaagatgaaataatgagtaattaaaatattactcgggacatattgtcagaaacacaaataaaaaatgtattgtttaaaaatatatcgtaatttttctcgtaaaacacagtcaggattttaaccgttaatgactcaatctacgcttttgatttgtacatatattttttaagtacataagtaataaatttaatgttgagttctaaagtacttattagattggctctccctcatttatcttgaggatgttctctaaactattaaactgtacatgttttgcaaatactttctatacatttttttttaaaaaaaaatctatttttatgtttgtaatatttaatacttaattaatcttgtgttgatgacctacatcgttttttatgccatgcataagctcaaccaatgagattgaatgtagcctaagtaggagatatattagattatttactataaaattaaaaattaaagaatcaagttaactacattattaaaaaaatcattactttggatcatatatttttaagaaaaaagcaaataagttttgttgtctcctcgctatttcttagctattaaactaaaacaaaaacaatcaacaatattggattttttgtttagaaacacagcacgcgcacctcctgcacctttgagttcctccaaaagactgagtcgacacattttgagattgccgatgtcaccacaggcgtctcgctgtcgattggtacgtcacctaccactgaaagaataattagccgtaaatgcgagcacccgtgtcaagtctaggacttgaaccaggtgggcaagttacaccacaagaaacctaaccaattgagttgcgctcacttcacaatagcgctggatattaaaataaccataatttttaagctatattattgggatacttctatgtcttttaaaccggtgaactattagttataaccgttagatctatcttatatcttatataaaagataagcatgtattcatggtacatgacatttccaaaatattactgcgcaattatatttcgtcattatcgtattcatgttaggttgcatgtagcctatcacccaccctacatgaaatgttcatacatggatcactcaaactacatcactcatattagcctatataaacccatacatttagtggagcttcatatcacattcaattcatcctttaatgaactattataataaatatgcaattaaaaataccttattttactttcattgacatgttttctaaagaaaaataagactaccttattttcgaatgataaagaagactataaataattacttgtagatattacttaaatatgatatactataaaactaataggttagaaacttattaagcaattaatgctgatgaaaataattgatggataaatcatggcagatgttctccatttaatatttcgcttttatacttatctcaaactcacaaatcgtggcagatgttctctatttaatatttcgctcttatacttatcttaaactcagcgtacgacacatgcccgcgcgaatgcgcggactaccttccttgtttttttaaagtttgcttatttgatctttttttttttcaaaattgaatttgatctgactctattacataaaagcagtataatagagctaacttatagaaaaatacaatttatgcccttctcattagaaagagggccgggagagcaaagaggtatagtggaacgaaaatctggactggtatattcaaccaaaattcagagagctttccaatagaatgtacaagaatcatctcttttcagatatcagtacaattgctaagttcaactagaaaatctcagaacatgaactaaatcctaaatccactagcttgaactgctctcttcaccaaaagaattctgaactagagagatagagatcagataaaagaaaactctgaagccggcggccaaaaaacatgtgggattccactggaatgtgagcagctggtcactgtccaaggagatccgggaccgggtgtcctaggagagcacgcttgacaccaacgaggcaggtcacctgcgcctacaacgtcgccgtcgcgtccacctgtcacttcgaccgcgccgggagcagatgacgatgagtggggctgcctcctgcgatgtgagccgcacgacgacgatgacgtccgcaagtggccgtacgatgcatcctgcggccatccacgcgccgccactcgtccccgtctcggcacaggtccgtgcgtggtgcgtggtggcattcttatcattttgacatagatgaaatgaagccctaacggtatggagaaaataaggtgtcccttcgattttgaaaaataaggtcaaaataaataaactaagaaaattaagattaaaatgatagtaaggttttgcaacaggttaaaatgagtaattatccttttatattaaggatttttacggtacaatatactgctagtatatactacaagtatatatgatctaacgttgtagattgatttaattttttatttaattagattgcagtataaagtttgaaagtgtaattttgtcttttcttcgttattctatcatcaaatcgtgctatcgtcacgtgctttgtcatcaaatggcgctcaggatgctcctcccctagtgcacgataagatccaggaccaggtactctcaattaaattcaatttgaaccaaaaattactaaagtgttgtattattttctatcaaattcctaatattcccttttatatactgccagtatatactggtagtatattgtaccgtaaaagttctcttttatcttactatggagctttcccgagttgggaaattcatctgaactggcaaacagcgtgtgtagttgtgtagtctggagatttcagttactcttgacagtttcttgatctccgaagtgatttgtatttgattgaggtcatcaatgattagtcagcgcagagtagtttgaagtattgcatcgcaatgaacaaacggccaggtttgaatcagatcaaaagaagttgtaaataagtgatcgaattgactaaagatatgggaatcttggctcccatcaaaaatcatgtggaatttttagattttttgcttctcaggagatcaatcagacattgggtactgtcagtaacttggttcaattattatcttggttttggtgtttttcaccactgccgcttccatcttatttttggctttgtttgtttctatccgttcatttttgcatattgtaaattttaaaatattgtcttctctttcgatcgcaggtttttcaaacatggccgactcaattcagaatggctctggtgatattacacgggttttattctgtggaccctattggcctgctgctactatctacaccaaggattatttggagagctatccatttattcaggctagttgcactttttacatagcttatgtttgatgagaagtgaattagctgaaacatcaaagttagattagtgtggactaaaaggcttttaactggtttagaacttttcaactcataatgaaaggctattatgatataggtttcttcttccttatattttttttccggcacacacatgcataagagttatatattattacatcctatcttactacaaaattacaacccactaaatcctaaagctcaacatgtaaagattgcacgtcatcatccactaacaattattaaatcttaaacatcatgccaacatattatattatctgtaattctattatttattaaactagaaaggtagcccgcgcacttgcacgagtaccttattgtataatgtgagtgaaattttattatgaatatttaagtgcgggtggatttttattaaaatatcttgtattttgttctaaactaaaattaaacttattttttgtgtgttgaaagctgattatatttttataattgcccttgcaacatataaattctaaagtaaaattacttgagatcatacagttttgaattatatgagaaaatattgtgttgaaacaatggaggtagttcctatgagaaaatttaggatactttaacttgccagaaggatatcttacaacctcaaaagaaatccaataatatcattttttgttgtattttaaaattatatatattttttcattataacagtccttgtaaaatgtttgaatttttctatcaagtattggttttaaatccagcaacatgtgttcaattttcaatttcatgtccatttttattttttttcttttggatagtttcattctctgaatcatctttgaaatgatttaatctttgcaattcgggacggaaatataagaacatgtaacctagcatgaggtaaaggcatacgttctaaattttctttcctgaaatattgaactaatggtcataatgtatttagcgacgaatcatcactaaagtgtattgtcttataacaaatacatgcttctacattgttctacgtcaagactttacaatgtattgtagcaagtttaataaaaaataaaggacatggtcattaattcctatctggaactgacttgatttattgctaaaggcattgcaaggttgttccactattaagatccttaggtacaactcacatgcttatcggtatgatgttttaccaaccacacctttattttcaccctattgtctatattgctagatgaatacctactatgattagtgacttgctagatcatatgtgtaattcggacgctatgatcatctttttaaaaaatatttacttatgtcctaaaaacatcattttaaaagtaccaaggtcaatttgtataggcatatcaagagaaattaattaagttggtagaaagtcgttaaatgtctaacgggatataagtaatagatggaggtacatatatgttttttttacctatatagataattttaattttaattgtcaatgagataaaaaaacagagaaaaaagaatggcacgcgatgtacatgggtagggagagggagagaggattgggatgtttttcaaaatgattaatctaacaacctaaaataatgggtcagatgtttatgttgaaaccgatggtaagatgttttgttttcttgtcagaattttattaggattttatttgatttaagagaacgacgtaacatcttaacaacatttataaaatgtgtaatggacttttaacaccgtatgccgcaaaggagggagggaagaaggtttagggtgttcttttaaaaaaagatataatgacctaaaataatgtgtcaattaattcatcgatttatgtcatatctaatgattgggtgtttttttttccaacatttctaagatttttctctaatttaagaatgtcatagaggtatttatcaaataattagtggattttaacaccgcacgaggatggggagggagggagagagtttgggttttttcttattaaaaaactaacaaattgatagccgaatgttttgttgtttttaagattttctagtattttctttaatttaatagcaccatgttgcagtttagaagtatttgtaggatattttaagatgcatagcgagagctgctagacctaataggtggaggtctctttgtggtttttttaatgtaaaaataattttgattttaatttctcatgaatatacctcgttggtacatacgtgacgggagattccgaatgtgtgctttttttataaaaaaatatctaacctcctaatataaaaataatggatccaccgattttaataaaaatcgatggttggattagaatgccacttggcaacttaggagtgtttgtaaggtaccacttggtggcttaagagtatttgtaggatgtttaatgaatatttagatataattgtctttttttttgaaatttctaagattttctttaatttaattatgttatatagtggattttaacgctgcatgggggtggggagggagggaaagaggtttgggattttttttattaaaaatatctaacaacctaaatccatcaatttaagtagaaatcgatggtctgttgctttgtattttttaagattttctagtaatttctctaatttaataataattggtctatttgtgatttttttacctgtaaaagaaattttgattttattttctcattaaatagaaaataacacataaatgaaaatatggaaggacaaaagggaagtacttacagtacatacgtacattggttccgtatgttggttccggatgttctattttctttacaaaatagatctaaccattcaaaacaatgggtccaccaatttaagtaaaaatagatggttagatttcttttatttattatggttccacttggcgacttgagagtatttatagggtgccacttggcggttcgggagcgtttgtaagaagtttaatggacttttagtatataactaggaaggtagcccgcgcattcgcgcgcgcatgcatgtatcataggctatgtttcaaacaatgtaaggacaaaatataaaatggaggatattttcagaatataaatcggaaagaaaacccgcacatatgcacgggcatcttatttgttgttcaagaaaaagaatgctaaaataaatcatatcttagtatatacattaatacatataccctgtaagggaatgtagattaccctaaataaaaaaacaaatatatttgccgtaaaatagaaggtatagattactaaatgtgatagaatgtctattagatttaagtaaaaatccctttgtcctggtcatatataaactcgtcttttatcaccactacttattatcattgtttttgaaagttaggtgcacttttaataaaagaaactgtatttgtaccactaaaataaatgatacattatttatacacaaaaaatatcatctacactgcataacccgatatgcataacttattttcacatctatgtataaattgtctaaaaatatcatatctactagataatacgataacaccgttaaaaatattcatgaatgattttctaacagatgaagtcgaccgtagcagccaacctaggctttcttacataatgccttgcaacacgggtctcgcatcgatgtaaccgtgcccctaaagaccatcttaaagtacaattttaacactcaattcaccattggcacacacaaatgattgcattggtaagtatgttattttagttacattgtttatggtggccttttaggacaccacttaactcaaccatttacatgtctctacaatatttatgatggcatagcaagtaatacacccaacattgaaggacagatatatacagaaaggaagaggtggcgaaaacagtattatttttaagttttgagtcgatttaaggtaatgaattgacaaaattgggttcagaggtgtataacattcgtacatcaattatactcagtatatagaatttatagttttatacgtgttttacggattgttcatgtttgccaatactacttggcaaagaaaaaacatacatggataatcataattctcatgatgaattaaggattgtattgtagcaaaataactgcctaattcttatttgtttatttgtttatttacatctatctatgatgtatgcttctctctcctcaaatagcaatcaaaaaaatttgaaaaatttcagattcttaaaatctcaatgtcacccaaaataaacataaaatgatccacttaaaaaccaaagctaaattgtagttttattatcgcaaaaccactgtctaaaatttaatttaatttttctcatctatctattatttgtgcttctcactcatcaaataagaataaaaaagttttgaacaaatccaaatattttgagaatctgatctccaaaattaaataacccaaaacagatgtacttaaaacacaatgttaggttttgtcagacagttgctttgacattttatctattagagattaagtttaatgtgcatatctgtgtagtgttatttttaataaaataatagtttaaaggatgttgacaacacatcagtgtgaattttcacgattagtatttctttccgattctatgtacgtttgcatgttttcttttatttatttggttttatctgttttatttatggtatatggtgtaggtatttaagttttatttttttaggatggagacgatcgtacgacgtacgcacattatgtttttttttccagatagagattagcagcatgtgatttttaatatatctaaactaatatttaaaataacgggtcctccaatttaagtaaaaattaaaggatcatatgcttttcttttttctctgaatttctaggatttctctactttattatagcacggcgtgacggcgtaatagtttttgcaggatgtttaatgcatttttagtatataaataaatttctagaatttctctaatttattagaaagacacgtagcagtgtaagagcattcgtcgtatgtttaacgtacttttagtatatatatagttgatagataatagatagatttataagatgttttaaagaacattgattggatatttataatagatcttaatttgactaaatatatttatatttgtgaagtaaatatattttatctttatactgtagaaaatcatattttaaataaataccgtaacattgggaaagttttattgttttattttcaatacgtacgtaacgttctgtatcgtatataaactctatggctgaacagtaccgtttctatgttatataatatatgaggaagttattactttttaataatagatctaatctaatggtgaaaaataacgggtctaccaatttaagtgaaaatcgacggtgagattagatagtgccacgtggtggctttagagtgtttgtaggagtgccacgtggcggcttaagagcgtttgtaggaagtttaatggacttttagtatataatagatagatagatagattttagagttttaaaatgcaagcatggtcaatcatcatcctacgtaattcaaataatatttaaatatatatttccaccattttttataatatgctatataccgatatagttcatcctcacttaattaatgttatatcacatcaattgtttttagctcatagatgattaatctaggtccaaattatctttctcgctttcttctctcgttaagccataccacctcaattgttttttgcccttagataattcatctatggtccaaattatcttcctcatcttcttctcttataaaaacacatcaccttacttttacatttggatcatcattctatatactatttaaattaccataaaccatatcaacttatgtaagcttatatcttctaactatcttatacattatttctacttattgctgtcacactaaaactcccacggcaacgcgcgggttttcacctaattaatagaagaagagagacgtccgagatgcaattacgaagaaacaacaattgaacaaagcatacaaaacagaacaaaagatagcaaacaagtcactccatcaagatcctcacaacatcctaactcttaagccttcttagccccactggtagcgagttaggggtgtagcaacttactccatttccattttccttagcatgcttctcaaactgataaatggtgcggattttacaaaatctttttacatagaagttttttttttcaaaaatcaaattaacatatttgctaaatttataataattagtactccattaatcacttgcttacagcttatctcgtttcgagagccacggaaaatcccactccaaaatcactttcaaattcagccttagctaggatcaaaatcagcggtagccccttatctcaagaatgatcagactatttaagcctttcctgatgacccattgcactaaactattagcccgactccaccaatcatcaaagatctcctacgttggtcaaaccggtagacggatccgctgcctccaccattgggagcgacagcgaaaacgtggatccgccacctttgccctcaggagccgtggcaacaggatcaggtggtgggggcaggtggccggtgggcggatctgccgcccccttccgcgagaacggtaatggcaggctcagtcggcgggggcggttggccggctggtggatccgctacccccgccctcaggagcaacggatcggcggtggtgaggcgatgatggtgacggtggcggttgcaacgttgacacaacggtggtgacagtgacggcaacgacggcggcggtggcggctgctctagcgacgacagcggtaatggctagggcttcgggagaatcaagatgctcgcgtttcgggccattttttcgctgaaactattttcacgtgcggtcagcatatgtgactgcatgcaaaaatcccgttttcacatgcggttgcgctatctgcatggaaaaatggtgatttttgtagacacctggcctgggtgcagacgagacggccaaccgcatacgaaattctgtttcaatcggctggaagaaaacatttttttagtactgttcagctccacttttataatttacatgcggatgattacattcaactgcggaagcaaactgatgaaataattattggggctctaaaattccaacttttttccttaccattacaacattcaaaatctccagtttttgacattcttagtaccaaaacttttgtctattgtgcagtgtatctacaaagacatgttttttacttatccaataaatttgtacgagctcaatatattactcaaaattctggtatatatgttgttcactcaattagcaggttcgtgttacaacttccatttgaattattgtgaacaaaatttagatactgatatgctaagttgtttgatgacaattagtttgtacatattttcttaggcatatgaactcaatcgaagtcacatgcatgtgacaatgtgcatctatgggtttatatctcatcacattggaatgcacttttcaggttgatgaagtaggtctagaggaggtacctgatgttattcaaaattaccacttatgtatagtgaaaaatcgacttatagactcagatatcattgccaaggcaagtcagatgaaggtcattatgcaatatggtgttggaatagaaggtgattatgagtctaggtttatcttgccattttgaaaatgtagtggcataactagctactcttatactgagcatacaatggtttgcaggtgtcgatgtaaatgctgctacagaacacaaaattaaagttgcacggataaatggcagtacaacaggaaatgcggtgtcttgtgcagaaatggctatctatcttactctgggtatcctacggaagcaagtatgttttaataaatagatcaacttttgaccatttggaagtgatctttatgttttatcttttttctaaagcatgtgtactagtttgtacaaacacaatatttagacatctcaaactaggaagcatggttatctatatatcttgatttctttatgaacgatggacgatccagtggcatccatcgtacaccaacgatgactcttttaaaccttgctttcttgtttatcagttcgtatgtatgcaggacatttattttgttctttatgatataggtcaccttcctatctttaaccatttggcagctaacttgcttgttttagttgtatatatataatctatggctgtcatttttaatgagctgcacatattttggatgtgttatacaaagcagaagatgatggatactgctgtgaaacgtaaggacctgggcagtccagttggagatacaatatttggaaaaagagtatgccttttgtgtatgagttacttgtttctttcactttacatggagagcatttcatttgtattgtaatttgtatttattgtactataaaggtccttatcttgggatttggagctattggagtagaaattgccaagaggataagaccgtttggagtaaaaattcttgccaccaaacgaaattggtcagctgaaacattgccatgtggtgagctgcagtatttgagttacttttcccagttttttttcttattttcctcctcttccaacgtattgcctgcgcagatatagatgaattggtcgataagaaaggtggaccagaagatatgtatgaatttactggagaagctgacatagttataacatgcttgctattgtcaaacgaaacagttagttcttctattggtgtatttctttatttctgttagaaagcctctacttcaatttcattactaaataatgaaatttataggttgggattgtggaccataagttcctctccacaatgaaaaaggtgtatgcattttgttcatgtcatttttgtgcatgtaacaatacttttaggttttatctcgttctccataatgagtaattgatcctacaaaagtagtgttattgttctataatttattctagcgtaaatttgctctatcatatatatattgttcttacaagataatctgcaacagtatactacgacgatgttggataataatgttataatatattcgatcaaaaagataatgttatattattgtagggatcatatctggtcaatattgcaagaggacacatactggactacgatgctgtgtttgatcacctgaaatcgggccatttaggtgggttaggcattgatgttgcttggacagaaccatatgatccagaggatccaattctgaagttctcaaatgttattataacaccacataccgctggagtcacagaatattcttttagggcggcagctaaggtttgcactaattcttcgaaatgcccatagccacttgactcatgtaattctctacttctatggttaagattgttttgacctacagctaagaatatattaacattgttttgacttagttaagaatatcacaacacgatttgcactaatatcaactttccattcttctgcaaagtatatatccctaaaagcgctgcctccatagtttaagctttgtaatatcctggtccaattagaatttggcctgtgtgacccatgagagttgtgtgtgcatgtttagtaacacattgagagctagtttagtaatagtggaaccaacttataagtgtttgtccctccaaccttatcactcacgggcaaaaccttttatacgaagcgaggatgaaagtattagtgggatgatatgtgtaagtgggcctgtccgtaggatgggttggctacatggttttggagggagggagcatggcacatgtgaactttgtgtgaggcacatggcatggcatatggcgatggcactaaacacacggatgtgtactaagaaggagtgtgttcctagacatttgcctatatgcatgtgtggctatgtgcgtaagttggatcgacggagacgtcaggtcctttgaggaggggtgacatcctggcctaattagaatttagcatgtatgacccatgagagctgtgtgcacatgtttaataacacaatgctagtttagtaagagtgggaccaacttataagtgcttgtccctccaatcatatcattcctgagttaacccttttacacgaagcgagaaacgaaagtgtaagtggggtgatatatgtaagtgggtccatcagtcggatagactggttacgcacactacatcaaatatactttggagagacattctcctaatactatagagatatttttaaaatgcctttacagtgttatagagacattttgaagagtgtctcgtaagtgccttttggtgcattgtctctacaaactaagaggcattttataatatgtctctatgcaaataggggcactttgtagaggcattaatatgttgcggcaactatagcaaatcactatgaaaaaaaaacaaaaaataaattattccttaccaatccttgaactcatgacctcttgagttgaccatctttatttatcccttagcaatccttgaactcatgacatcttgagttgaccatctttatcttcaatgcactaaccatctcaacctcatataattgcatgtaaatatgtaatttgtgttacttatatctaattacttgatgtatattaatatttggaaaaatgtctttacatcattttaaatgcctttacatttgaggcaagtttttaagtgccgaaaagatgtctctacaagataaatttaacaaagtatgataaaaatgtctctaaagtgtgtctagagtaaaaatattttaggcgattttgaaagtgtctctaaactatagagcttcaaaacttagaggcattttgaaaattgtctctacaaaagagcctctatataaggtttttgttatagtggtggttttagaggaagggttgttacaagcttgagaaaattccttatatacccctgaaaatttactcaatcccttcaatacccctgaatttgacatcatcccttatatacccctgagttttcattttgatctcctctatacccatctccgttagttgaccattagttgaccgttaaatattttaaaatgactatattacccatcctatacatatgtggtacctacccaataaattttcatatgaaaaaattaacttatacaaaatacaggcaatataatcatttaattcccaacttaaaaaataaaacttactatttttttattttttaaaaattattattaaatccatacattagtttcaccggaaaattaagagcaaaaactaaatgttatttaggtttaaatttttgggaagatatatgaaattcatcaaatttgatctaaaacttatttaaaaattttaaatttgttttctaatttgtgataaactagttacatccctttattttttcacaacgaatcttttttcactaaatatttgttgaaaagtaattttcaaattttatgcagaactttttttacaataaatcttttttattttaatgaaataatgttttatttttaaaaattcataacaaatatttagtaatttatttcttattggttttcacaattcaaataatttacacaaaacatttctagcttttaaaaatataccaaggacaataaagtaatttctacaataactaactatcaaactaatggtcaactaatggaatgggtatgtaagggatcaaaataaaaactcaggggtatataagagatcaaacaaatttcaggggcgtagaagtgattgggtgaaattacatgggcatgtagggaattggccctacaagcttatacctttgtaatcctattggtagtaccttgagccaaaggtggagcgcccgcgacgcgacggcagagttggtcacttgccctagctcgacccactcttccagccagagcaacccaatgccttccaaaaagacctttaaattttatgattatgttaaaattaaatgctttcttaacatgttttgagatattttttccatttctaaaagtttttatatttctccttcacttattcaactagaacgagtttgtgtttcttggctataataagcgttcaatgataattataaccacctcaaataattggtatccagaatgattagttattttaagggggtggaatgtttgacgcgatatggataatagaccaaaccgagtgagaaaaacgacaatcagagactataaatccataatagatgtttaactgtttcattttttatgaaaaaaaacaatatttcttactaccttgccagttttgttaggacaactccaggtcgcacatacagtgatacagaagaaatatcttgaccttaagtggcacttttagcctccagagcagtttgttaatagcagaacgtacgactgacatgttatactttctcattagaccttaatttgtccgcagccagagttctctctttggatcagattattggctttctatttggatcaaattatttgctttgaccaatggcatctttggaaccatccctgagtaagaattctctgctaataaattcatcacactgaaaaaagggaacgtggacataagagaagcagaatactaatgcggcacaaatacattcatctttcagatgatagaacagcaacgaacaactgtccatgtcttaaatactatctctatttggtagcaggtaattggattcaaaacaagattagaaattgaaagttaatggccggggtatatgagatgaaatgttaggtaggcaaacattattgtgtttttttttgcggggagacatctatctattatctatctatctatctatctattatatactaaaagtccattaatctccctacaaacgctcctaagctgccatgtggcgttcctacaaacgctcctaaatcgccacatggcaattttcaatctaactgttgagtttcacttaaattgatgggcccattattttacaccattagattagatctacttgaaaagttattgctacacccataacatataagctttatacatgagaaagttttacgagaaaaattaaagtatattccgatcggatataaacccatacgtactgctcgcttaaaaaaaacaaacaaacataagtgcagctataaagccaaaaaaaagttctacattgtacattgaagccgtatataccggaaaatcatgtccatacgagtgaaaccgcttataccgaaaaatctacgtacgtacacacaattgaaaaaaaacagaaactttaggtactgtttatttaaaaaaaaacgaacgtacatatgcgaagacaaaaccaagaaaaaaatgtacttatgcgtagacaaaaaaacagatggttttttaaaatagtattttctatagtagaaaaacaaaacttattacttcacaaatatggtaaaaaaacgtacaataaaaaatatatgatttgaaaatatatgttttcagctacgcgggcattctttaaaaagttgatctaacaatatatacagtgactgactttatttatacatgcaagtgaaatggtaccggaagaaataatatatagtcacttttcttttataatttttcatatacgtttgaatgacatgcataggatagtaaatggaacatggaagaatatacatgcataggatagtaaatagaacatggaagaatatacattttatgagtgaagtagataacttacgtatgaattctaattgtttttttatcataaataacacaatggtccaaatagataaaaaaatgaaggtatgatttaaaagttaaaaattataatgagttaaaatatatttttacaaataaatatataattcagaaggttctggttatttaaaaattattgttgcaaatattttcataaagagaaaaagggagaaaatgtaatcaagaggataaacttcctacaaacgcttctaatccggacatagtaccctataaatgctcatagaccaccatgtggcactctaataaatcataaaaattgtataaaataagaaaaaatcccgaccaatcggttttcatttaatttggtggacccattattttcaactattagatctatcttaaaactacaaaataaatttatttgtaaaaaggcccatgtcgtattggcacgaccggcaaaaatacatgcatgtaggtatgtaggtattccttcttaagaaaagtacgtacctacgtagagtatgtacacaactatttctatgaacagtgcgtatacacaccgcgtcccacatccttatttttttttcttctcatcatttggattagatggaaaactaaactaataatttaaactaatatcaactatgctttgagttgtaaaaatatatgctatttcgagttgtattcaaattaggtgcatgtcatcaaaacacccataaaaaatataaataaattgaaagtatagattatgtgatagttaaattagacttacattttccaaaataaaaacaacttcaagtgtgtgtagaatttcaaaaattactcactctctcttgtaaaaaatactgatatggaaaaatgatgttataaatttatcagaaatattttttatgtattatgtgtttactctattcatatattattagaaaattgaacatcaaatatattcatttcacaccacgtcaatatcttttttctcctacttagccttcgttcgatctagctcattgact

SEQ ID NO: 73605 - DNA, 756 bp, Oryza sativa
ccggcctcgccggacgcccatgctccggcctcgccggagccgatgaacgccgcggcgagcgtggcggcgccggctagcgcctcgccgtggccagcgcgccgcagaggacggccacgccggacgcccacactccggcctcgccggagccgatgaacgccgcgcatctcctcctccagctcttgggtccagcagttcccggccatggcagtggctcgctggcccgcgcgctactactactgcttcttcttggtcggctgccaccatcgggcgggctcgacgaccttggggaacttgtcgagcatggcggggaggagaggcagcgggtaggcggcatcgagcgcgagcacccggtccatggcgtccagggagatgaggacggagcgggagcgacaaggtctagggagaaggagaagaagaagagggcgacgacgccgccgccgccgccgtccgccggccgccgtcgcggcgccgccgctcagcaccgctcgccgcccagccgtctcggtctgctccctacccatcggcccggcctgcgcgagagagagagagagtagagagggaaggaagagagagaagaggggaaagagagatgacgtgtacacctggcatgtggggcccacgtgggtcccacgctgattcagctgccacgtagactaaaaccggggtcaaaaccaccaagggaccttgggtgaccggttttatatagttggaggaccccgagtgtctgtggtattacggttcaaggacgttttttat

SEQ ID NO: 73606 - DNA, 25520 bp, Oryza sativa
cctgttgcaacgtggggtagcgttggacagtgtttggttaacattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgggttcatgaaaaatgttctatgcataaaaatcatcatgttcggttatttatttgagtcatttgttgctttgtttaagttggatttgagcatgaattgattcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagaaagattagtttctgagccctctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcgcaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttctgtcgggtcttgatgatgaattgaccaaccagttgatctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatgggacatcagggtggaccttccaccatgattatccggcagcaccgtccctaccacccgggtaatttcaacaagaacaacaacagtggcagtcacagcagcctcaacccgactccaagtccattaatgattccagctcagtcagatcagtcagatcagctagctcagccagctctgccagaacagcccaagaggttgggagaaaagcccgaactctgcttcaattgtaacaaacccggacacacggttggaaagtgcccgaagccaagacgtgctggacccaagtttgttcaggcccgtgtcaatcatgcgtctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggttgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgacctgtttgatcaattgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaatgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatctcagacagcgaagatggttggagctaatcaaagattatgatatgggaatacactatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaagggacaatctggatgggagaaagattgtgtgtacccgaaaacaaggaattaaaagacctgatactaaccgaggctcatcaaactcagtattccattcatcccggtagtactaaaatgtaccaagacctcaaagaaaagttctggtgggtcagcatgagaagggaaatagctgaattcgtagcactatgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccgtctaaacttcagcactgcttaccatccacaaacagatggccagaccgagcgagtcaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagtcaccactcagaggaagaggccacttgggaaagagaagatgagttgaaggccacccacccgcacctcttcgccagctcttccgaatctcggggtcgagattccgtttaaggggggtaggtttgtcacaccctgaagtttccccctctccttgctttaaaaattggctaaataaatcgtccgaagaaattatcttatttaacctagagctaattccctaattaataaatgcaattaataattgaattcggcgtggtggaatttttcttgagttccccatgctccaatgcattaacaagatttttagtggaattttcagagccttggaaataattttaaccaattaaaaatcaccaaagtgcaattttaatcccaggaaaatccttcccctctttttcttttcttttccttcctttttctctagatgggccgtcggcccatctctctccccgcgctcggcgcccctttcctggggccggcccgttccttctcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgcccctcttcgcgccccactccgcgcccgcgtcgccgcccaccttccccacatctcccggcccgtgcgcgcgctcgagagggcgggattcgatttcgaatcccacccctctctctctctccccccacctttccacgtcgccggcgcaatagggtgggttcccggccacgtccgcctccccctccgcctataaatcgttccccgcgtccttctctcgttttttcctcttttcaccgcactctcccgtgccgtctaccgccctcgcgccgcgcacccgagctccgccgcccgccgcccatctccggccgcgcgccgccgccgctagagccaccgccgcgccgcgtagtcgccaccgtcacgctcaccgagcccgcttgcacctcggccaccattcggttgccgccaatcgtcgccggagcgccgtttctctcgcacgccggtgagctctccatttccacctaactccggtcggccgctctagccgccgtggtcgctctccctacccctaaccccctctctgttttctcctagcgtgccgccgccgcccgtccgcacctcagcatcgccgggtcaccgccgcctttcatcctccgctttggtcgccgtgctcgccggtgaggctcccctccgctcccttttttttccctctctcccgtgtgcgccgccgtccttcgcgcgtgcgccgtcgccttcagccgctgccgccgcttttcgccccgtcctccgtcgcttcccacgccgccgattgccgtcgccggcgaccgtgcgcgtcgccgccggttgccatggccggccggccggttttgaagccgagccgagccgtgcctagccgccgccgtgccgtccgatcggcccctcggccgatccggaccatcggtcccgtggaccggcggtggaccacccgcgtggtcctggtccacggtagaccggccgctttgagccgctgacccgtgggccccgcctgtcggtgccgccccctcccctcgctgacgtcagccctgggacttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgccttgtttgtcgcgtaggtttcggccgtttcgtcgatccgaagtttctcgaagacgttgctgaggtcccatcagttcgagagcaaggcaagtcatgcaatacgtttgatcatattgtacccaatttacaagtatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggggtagcgttggacagtgtttggttaacattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacacacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcaatttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgctgaaagtgtgtagtcatgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctatccctcctaccatgcgccctaatgtgcccctgggagtacgtgagtcggtccgggggtatggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtacccaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcttggctgcgaacgcgctcgaaggcaaacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaagtcctgcgaggatggaacatcaagttacgacggggtgatgttttcgtacaaaaacagaaacaaaacttaagaaacctcttggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccctgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgtgcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacactagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtatgcctcaagggagcgtcggaccgagtaatcatcagcgtcagggtgcagaaggtccgcctacaattaagagtgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggactaactggtgctcccgccagcggtagcccgagcaggtacgacaagtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgtaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaagaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccaaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgaatgtccagatggactagcatctgcgccgcttggaacttctgcattcttcgggcatttcttgtaagtatggccgcacagatcacacttgctgcagcgtaaagtcctcccacctgcttctgactcatccatatcatttctgatgcgtctagtttggcgtcgaccctttttcacccttaacttagatggatctggaacataaaaaacttgggcactcagcgttgtgtaagatcctaagatcccgaacccatatatctcctcactccatgtatgaaagattgcttctttcctgaaataatttgagacgtacacattgggagatatgccacaatcaccggcaacagcaagaatgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatatactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctttttctcattgttggtgggtcatcatgtaatgcaccaagaggtatgggaggctcgtcaccttcaacttgtggtctgcgagattgctcatctgtttgcttcattgtcaactcatccaacttgtcccacaactcattaaatttcttctcttggttctgtgcacagagcctcttaaagagctccataagatgcttgttcttgaattgcttgtagaaatttgcacccatgtgacgcatggaccaccgactccgaacatcaggccatttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatacaaaagccataggtagaacctggttgttcccatcacacccaattgctgtcaatatctgacctcggtatttacttgtcataaaagttccatctatgcatagaacaggtcgacaatgcacaaaagcattgatgcaagcacccaatgagaaaaaggctatttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttataagtagcacttgtgctcggtcacaatgctaactttccaataatcattccatttacccttatatgcatggacacgccacggacaatcttccttcatgcaccttacttcatacacataatttgttgacttgatcaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacaaggggccatgaccgttcaaaagtcatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaagggggactgggctttataggggggaggcaaaaatcgccctcccccagggcggcaagggggccgcctgcaaaattccatgccccctcgccgcccatttgcaggcggccccccacacagtacaaaatcgccctagcggagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatgaaaaattatttttgtaaaacttttaataaaaaaaattaaaaataaaaaaaattcgaggggaagtggggaacgagacgagggggaggcggagcgatgcgatgcggagttcacggcgtaatatgggccggcccatttcggcccaatatgggctgcgatgcggatgtaactgtatgccgtccgatgggatgatttttttttgaaaaagtacctcgtcttgttaccgaattacaaaatcgtctctcaccaaaaaaaaccagatatattagggctgttttcggcacccttttccgacccctcttccttgttttccacgcgcaggcttttcaaactgctaaacagtgtattttttttacaaaaattttcaaagtttctatacgaaagttacttaaaattcaaatataatccatttttttaaataaatagctaatacttaattaatcacacgctaatggaccgctccgttttccacgcgtactgttccggttgggaacatacaatggcgaacacagcctagttcccttaacatacaaaaccggtcatcataggttcttgggcggttttatccctgattttatccgacgtggtagctgagtcagcgtggaacccacgtgggtcccacatgtcagcgactactccctttcgtctctcttggcaaccggcggcggatgaggaacggggctgggctaacgatgggcggggagaggagcggaggtggagatggacgtggcggcggcggcgccaccgacaacggcttctctcttgccctcgtctcgctctccgtcgactccagcgcccgtgcatcctcctctcccgccgcagtgattggctgaggggtgctccaccctccgctgctaccagccctcgcaaggctgcttcagcgaggctatgacaccatcattgtgttggcggcgtggtcgatttggaaagaacacaacaacatagtgttcaaccagaaggtcaggagctggacagctagggaaatggccgaggaaacaatgctttggcgtttggccaaccccgcagtgataggctcccttagagcaacttcaatagaatggtcaaatggctggccaagctaaattttagcaaatatgaggaaaaaatatcctccaatagcctctccatccggttagctaagccatccgaatggccaaattgtacctctcactggtcaaacttagagagtctctctgcctagctattcgtgggccccaccactccccccaccccatctctctctcccggctagagcaagaaggcgtcgatggcgccgctcgtgaacggtgacggcacgaaggagagaggcactggagccagccgcgaccgcagtcgtcgtccgcgccgtccccagccgcgaccaccgtcgccgtccgcaccgtctcctgagccggccgcaacagccgtcgccgtccacaccagtcgctgagccagctgcgaccgccgacgtcgtctgcgccatccctagccgccgccatccgcttccatccccgcgtggatttgaccgggcggcgtggattcgggagaggaggagtgagagaaagaggaagaagaatgggtacagaggctgacgcataggtcccgctgtcatagactcaaagtagagaggatggatggatggagaggctattggagtaaacaacgaatttgatttgacaaatgaaatggagagttggccaaatatatatttggagagtcgaatttagagagagcgttggagatgctattagattgcaggtttcgtggctagattaggctttagctcctttcttccggttctcctatcccctgttgctctttgtttttcgatgtaaagaactgtttttctccggttaataaaaaatacgcatctaccgtattcccccaaaaaagcattacgcaacactgcgatagcgcgacgttgattcggttttacatataaacccctaatttttttacaaattggccctaccttagatggcgatgcgtttcccgtcagccctgtcacgccgccgccggtcgccgaacggcagccgcagctgcgcgggcagcggcggaggcggaggcgaaattttctctactgctcgcttacaatctcagtagtgtcagtagtgtgatagagcaagaggaaatcgacgcaaaaatcagatggaagtgtgatagatcgtcggtggtgtggggaggagaagatggccggagaggaaggtggttggtggtgtgagcttgctgctgcggcggaggccactcgcttcaaggttcgctcctttctctctcatatacaaatttgtgcttgtgtttatttgcgcaagcactaggaggagtgcgatctgttagtgcctaatttaatttcagtccctttcatcagttccatcgttgttgattgctcgtaaaatattctccgttccattcttactaattaaattgaccggacaaaatatggtgttttaggtgactggcataaatttgacctgctaaaattttattgtctgaagattattgtgataattttgactgcatactggagcgtgtaccagctagccccccaagtcaaatcagtctcaagcttcattccactcgtatctggactgctgcccaaaatccattggtgcatctacttttgagttcacatgaaaatccattggtgcatctactttgagttcacatggttcacatggtgattacaagttcatgtctgataatcttatgtgctttctgatgttgactaatcggctttggctctgtagaaagtaatgaaggtagaaacacataaacgtgggaatccttcgtcttactttttgagaagaaaattctggtttagaaagagttacctcatgtagacgtctttctctctgctcatgtaaattcatgtaaatcgctttcaatactagatcagaaaattcatgtaaattgctttcaatacctgcacaaatttcttgtagacgtgtttctctctgcttcgttccttctttatcatctctagaatcctggctcactatgcaaaatcccatcttgaccacttgctcctgagtcctgatagagcttggcttggtatggagattctgatttctgctgtggcaggtgaacttatcagccggttcatctcttcgctacaacaatattacagcaaccacacaagcgaggaagatgatcgtacaaggttgcagcggatcttgctcaggatgcactctgttgttgaggaggcagaaggacgccacatcacaaaccaggggatgctcctacagctaaagggacttatcgagggattctaccatggttaccacattctcgacaaggtcaccttccaacccccagaagaagagagcatcaaagatgaggtgattcacgagataaattcatctgccttgattacttcgaattcggccaagcggtttcgttttgctgatgctctaaggaaacacacaccaatttcctttgctagcaggagcacaacaaacctgaaaggtgttgttgaagatttagaaactaagatcgcggatatgagagagtttgtcatgctcctaggcagctaccctcgcctacctcgccagccttacagtacatatctgttcatggataagtgtatgtttggtcgccgtgttgagaaagagaaagtcatcgacttcttgctttgcagtgatcttcctgatacatatgtcagcattcttccaattattggtccacacagaattggaaagaaaactcttgtgcagcatgcttgccaggatgacagggtgaagagctgcttctcccatatatttttctttaaagaagatgatctgaagatgggagagctgttgcttaactccaaggcttctccagggaagtatttgtttgttattgagttcatttgtgatgtgaatgaggcagcatggaccaaattccaatcatatttgcagaatatgcccagtactgaaattaaggttgtaatcattggtagaacagatgatgttactaagtttgggacaacccaacccatcaggatgaagaggctgtctgaagaagagtactggtactacttcaaggcactttcttttggaagcatgaatcctgatgagcatccaaagctagcatctctgggcatgcagttagctactgagatgaatggatcatttcttggtgcaaatatactaggtgaactcttaagagctaatcctaacactcaattctggcagagtatcttattaagcttaagagggtttgtacaaaagaacttgtgttggtttggtgtacaccctgaagatcttcttgaaagaaatacccctgttgatttcaccaggatggcctttcttggtgctcaagttcatggttgcctggtttatgatcttagggtcgctggccctgcacaaaatcagctaccaaaactaacgtcaagagaagtgttattgggaggtaatattcccgtcgaacagaagtttgatgtgctggtatggaaatctggcattccaccatactgtgattacatagctacttttgagaaacagaaaccacggcgtgtggttgggaagaggaataccatctaccactgagaaaacacaagctcaaatcttaatttgggggagaactctacaaattaagaaattatatcgtcggtaatgtaatttaaaaggcttgctctgactactattggaataatttgtacagttcagatcaatgtagcacttgtgtctctactgtaggttaaaatgtgtatatttttattaagaaaaactctgttgtatctgttcctattagtttggatatgtgaaattcagtcagttacagttgttaccctgacttgtatttgcatgtatgacggaaaccttttgtaaagaaactacttcatgtttctgactatgtgacctatgtatgaacaatttaatttacacaatatctgtttgggcatagttagtttcagtccctttcatcaattccatcatggtcagagcctgccttgcttgactttctaaattccaattaccctaatggtgcatttctttatagacctctgtttagataatttcttcctgattttctcttgcaaatcacaaaggatatgttcatctctgcagttgcaagtgatctttcagccatttcatctccttttggatccagaaatttgagaagcggcacacaacagtggaggggaaggaatcttgataggctgaacagcatccttctaaagatccacaccatcgttgaggtctcatggcagatcacaacctgaggaatgatcctccagttttggcgcctatggtaggtacgttatttgattagtatttttttggcacgtcaagttgcagactgttggtgaggaggtagtacttgaagatcattctcaaaacgcctctgtttatggtcagaacaataagctatgaagaaaaaaaattttgttttaggtgtaaaaaaagatagggaagcaaattagtgctgatagctttcctaggttatataggctgtatgtacctttcaccaattatccacctttactgtagttattcagacagttcagggcatagaggcatgagtagctactgtagctaacagatgtttctttttttaaaaaaaaagaagaagagaaaataatgatgtatatgctcttactagtctgaacatgtaaatgcagtcagtcactattgctattagtactatgaacattacgtataccttttgaaaagaaactactccctccgtttcacaatgtaagactttctagcattacccacattcatttagatgttaatgaatctagacatgtatgtgtttagattcattaacatatatatatatatatgtatgtgagcaatgctacaaagtcttacatcgtgaaaaagaggaagtactttatgcttctgactgttgtgtcctcatatgaccaattcaatgcaccaatatatctgttatatattttgccgggttggccgaaagattcggtcaaccaatttcatgaagaaaggaagggtacattacaattaaagagcttacaacgactgttaaatagtgcctaactaatttcaatcactttcatcgtagtcccagcagctgccttgcttgactttccaacttcctaacaccttaatagtagtatttcgtaacaaacttctgcttacacaatttcctccagggttaggctcacaatggacatgctcatctctgcagttgcaagtgatcttgtgagccggttcatctcctacctggtccataaatctgagaagcagcacacgacaacagagcaggacctggagaggctgaagagtgttctcctaaggatctacaccatagttgaggaggcggaggcacgacaaatcaggaacagaggaatgatccttcaactcaagggtctcatggaaggtatgtttcttgggtattatgttcttgactccttccagttccagtgtgttgaagaggagggtgtagatgaagatcaccaggtcagttgcaagcgccttcggttcagtacctgcacaaggagcacttcattgttatcactcggtacagagaacacacctgtgcttaagaatgttattgaaagtttggagaccaaaatttgtgatgtgagggagcttgttgtgctgctagccagttgccctcgtcttcctcagcaaccctattgcacatatctgttcatggaaaagagtttgtttggtcgccatgtcgagaaagagcaagtaatcgactttatactacatgatgatcagaacctggctgtccttcctatcattgggcctcacagaattgggaagagaacccttgtccatcatgcttgtcaagatgaacgggttcgtggtcgcttcctgaatattgttttcttccatggtgatgatcttggaaacatttcattaatgccttcaacgaaatacttgtgcatagttgagttcagttgggatgttgatgcggaagcatggaagatctttcgatcatctatgaagaaggcagctataagtggcagtaaagtcattatcataggaagaacagatgagattgccaagtggggaacaacaccagcaatcaggttgaacagattgtcaccagaaatgtactggtactacttcaaggcactttcttttggaagcatgaaccctgacgaccatccaaagctggcttctctaggaatgcaactggcaacagaactacagggatcatttcttggtgcaaacatacttggccacatactaaggggtaatccaagtgctgaaatctggagtgggttcttgatgagcttgaggatgtcacgaaagcgcttatccatcttcgaggagcatcctcctgagaagaaccacccttctcatacagctgaagtagcgttcatgaattatcgaggttgtatgttgtatgatcttagggaggctggccatttccagagtgatattcccagattaacaccagcaggagtagagctagaaggcaaaattccttgtgatttggggtttgatgtgctggtatggagatctcaaatcccgccattctgcaactacatagctacatttttgcagccaaagccccggcgcattgtcagaaggaacaagaatcccctggcagttagtattacttatcaatcatgatcttgtatgaaggacatatgccctccaatttctggtcgatctgatcagaattcggatggtcaagatcgattgggatggtaaagaatctatatgcataacaatcacagtaacctgtaacttgttccagatactagtgtacctgtacatccgcttcttcttcttttttcttttcttttttttcttttttttttgctggtttggatgtgtgtagtttaaggtagtaaggaattgatgtgggttttaaaaaataacaattatttcctcgtttcttttgccccatgttctatcatttaattacttcttgtgaaagggcatgtagcctagtgattgcagtgatctgagtagcacctaagatcctaagtatgttgggtccaatttctctttcttgttaacttcttagccttattttcttacatggaggaaattggaatgacctgcatggctgcatgtttagcttgcgggttgctgttggatttgtgaaaattttgaatgagaattcgccgtcgtcttgctcagaacggagcatataatattatagagtaatttagtgagtaagcgtcatgcatattattacagttagcatatattcattggtgtcgtgtttcatattgttgtgaactcgaatacgatgctaattctgcgaaatttgagggccgtgaaatagattaatatgcttgtagctgacctgtaaacctgctacttaatctgttgtacttgtaaaatgctctacatatgggatcatcttaaaaattcttaatcgactaaccacattactgcaccctacataggtgttcacatcgctgtagttttgataatggctgtcgattggctatctcgatgtgtaaaaaaggaaagccacagaagtgtacaacacacaagatgttgattattattattattattattattattattattattattattattattattattattattattattattattatctttttaaacataataatagagatgttcttaccaacctggttgcaagcactagcagcctgtgccctcttctcagcttcctagggagcatcattgacaaatcacacccttctgatgacttcgcgctacaaaataaacaaacctaatatagaacataacatatatcttagtattacaaatctacaaatctggatagaacatattttttttatagtaacacagtacaaatgcagacgctcacaacacgtgcactctcatccctataaacacacgcacaccctacttctatgagcacctccgaaagactggaccaacgtatattgaggttaacaaagtcaccacggacacctcattgttctaacattgaaagaataattagccataaatgctagttccaccaataagaatctaacttgttgagttacggtcacttcgctggatatatcatatatcaaatgttacctcacatattacaccacatattagatttgtttaatttagaagagagggagtaagaaacaatgacaaaaggtatccaacttgttaagcttcatctttgtttgtactccatatataaaaatagccgcagaaatcacctgagatgtgtaggcctcgtgttctccacgcgcttctcgacttggcgcctcgacgagcacgagcatggctaccaccaacggcgatgccgagctcaccgtggcggaggaggcaaaggaggaggaggaagccaccgacgacggcgacggcggagtgagctcccagtgg

SEQ ID NO: 73607 - DNA, 1552 bp, Oryza sativa
tatgtctatgcgacgaccttgttcaagtagtagctttggattctgaccatacaaggagattttttttttcagtcagtgtaatgcacatttttaatctgccaagccagaaattgacatccaaattccctctcaatgcatctgcagtagcatttgctgcggcaagtgtccctatgaactgcatctgcatggcaattttcttcagatatttgtactaatcgtggatggtccttagggttcgcacttccaaatgcgagcattttgaagaggtagctcaattcttcatctgaatggttgttaagaaacattggctttacagttccaagtttctctgattttctaagtctgcttatggttaccaccttgcttccctcattcatttgtgccacggatttatagaattcctcccaattcatctcattcacatctgaaacaaactccacaaccatcaaaatgttccctgccaagagagtatgattgtgtgctattcccaaaagatcaccttcattcaaatgcaaaatggaagaaaactgtgattgaaccctctcgtcggcgcatacatgcgcaaccagagttttcttcccaactccaagagcaccaatgattggaagaacagcaggctgcacaccaggagggttgtattccaataggaaattcaggagcctctgcttttcagaatgacggccaaacatgaagttatctatgtaaagataggtatcatatggtctccttgacatccgatcgcatccacccaaaagaacaacaaattctgccatgtgatcaacagcagtttctaatatttccaaagttctgtgcaactcaaggtgcctggccttgtcctttccagaagcatcaacaattttgcaaaaacgtttgaggggaggaaatgggttgctaacctccttgatgggatcctcctgaattagggtcctgcacctgaacatgtccaggacatggtggcctctgtacatggcatcagcaagtgccttcagctgcatcagcatcccggagttggtgatgtatcgcccatctgcctcctcgacaaccatggaaactcgtaggagaagctgctgcagtcttttcagctgcttctcctctgagatttcatgtcttcttgagtacttgctcatgaggtaggagatgaaccgggtgaccagttcaccggttactgctgatacgacatgctccatatccaaacctcgaaatttaacagagagatgagagatcaaatttagctgttgtgtgtgactgaaatttcagggaagattgtttgcttaaattggtagtcatctttgtcaggtccgtcaaaattgttggcttctatttgtgatattttggccctcggagcaactatttagaagaatcttaaaaaaaaacatctggatgtcctgacaaactagcctggcagagcaagtgattttcctaggcagacataggatatctcatgattggcatactgtttaacttaaatatttagtagtacattactattttctatttttttgtcacaatgccacacatagttgatattttatagaacttcatctatcaactg

SEQ ID NO: 73608 - DNA, 19947 bp, Oryza sativa
cctgaaacatgtcgctaatgttgcaggaaactaatacttttatcaataaaattgcagttttcttaaatttactctatatctaaattacttttagattttattaaattacttcttagtcataaaagtaatttaataaagcttgaaagtaatttacctatattatagaaggaacttaaaacaaaaggtaacttgttacggcattaaaagaaatctatacattcatgttgtgagttgtttattttataatcatttttagtcaatgacgtaatttgtgctgattaaatttaatttctatatagactcatgtttttacctctataacgaatttacttttaatgtcgtgataaagttactttctttttttttctaagttacttctataatatatgaaattacttttaggctttattgaatttacttttatgagtctaaaaagtaatttagtgaaatctaaaagtaatttagatatattataaaagtaatttataatttttcatcaaaatataatcatgtgagattttgttataaagattcaattcttacgaacacaatagtgtaatcggatcgtagatcggatgattagtttaagacaaaattatttttgacgccggcgtagcatagagcatcacatggcttccaatttggattcctcttgatgatgccatgtccgtaaatcaccaggccatgtacggaggcaccagcgcttgtgggatcggacggccgatgaacatgtcgcatgatagggcaaaacagagagcgcgcgcgaattagattttgccttaaaaattggtgaaatttaggatttgctgcagtctcttggaatttgtaaccttcatagaactgttggtttcagttggttgtgaactaatattaccacatattttttattaaggtagctaagcttagttttaccatacttttgtggcaaacaaaataacaaactaagtttaggcaaagttagacaagaaaatagagtgtatgacatgtggcctaggtggctaagagttaggcaaagtagacttgtgtcatgaaccaatcactacatgttaaagtatggtttacctaaggttagatgtgacaaatttagttgccgaccaaacatgccgtctcttggagttttgctttcccctgcttgtcacctaaattattagggtgtggtcattttcactgtaatgtgtgagcttcatttgtaaagttgtaaccctagcaaacatggctttctataaattggtcctcgtggctcgtgaccttttatctaaaaaattaccgtattcgagaaatggtattactaaagttgacatagaatatgtgctattaatacttctctaaattttagccataccaataccattaatatttatgtcaacttccatctctcctctgttatttcttctctagcttcaacgtggatgccatcactcattcaatctagcttcgacgttgatggaatacgacgccaggggtggggaagacaatggatgtggaggagaagagtagcggtgtgtcaatcaccagtaattgagggggcaccttgcaaggcaacgattcctgagctcaagcagccaagggtgatggtggtgcggcttagggagatgacgcagcttggcagtggcgaggaaaagcgatggtggttgctagggcgttggagatgggcagaaaaggggcctgctagtggatcccgtcacgctttgcctccttcggccaccattgtatcctctccaaccacatttcctcatgctgccgctgaatcttctccagtcactgtccccgaaggaaatgtgactgaaatattttggccagagcaattttgtaatggtatggataaaattaacactaaaatttattaatttccttgtttttcatccttcttggccaaaataggtagctgggttatctgacaccatagaaccaaattatctatgatgtgtattagcataggggatcatagttggttatctaaaaatagccattctttagtcaggtttattatgtggatataggttcaccttttattctatttccatctctatatagcctgtgctcctcactcgtaacatatgtcgttgtaaatgtaaatgttgcgagtgtgtggatttctgtctctggttttttaatatatggtgccgttaacttttgaatatgtattttgaccattcatttgattcaaaatttttatgcaaacatagaaaaatataagtcacgcttaacgaaactttagtgataaatcaaataaaaaacaaataatgattatatgattttttaataaaataaacagtgaagcgcgtataagaaaaaaatcaacaacgtgagatgttaaaaattaaagggagtagtgcagtagagaaaacgtccttgctaaatattttccttcttttatacagaccacatgcttgatcggaccatattatactcctttaatatattggtgaccggagtgatctagctttaaaaaatgatcacgcatagtcacatataaaatcaaattaaggggaatattccctatacaaaaataataggtaacacattgcatgaaatatatagatattattataatatattttcgtttatctgcatcaatgcacatgtattcagctagtataataaaacattaattatatgtatttttttatgaaatttaactccatttgattgagaggaatggttcattacacagtagaacatgcagctcatcttaacaaaatgaaatcaaaagttatcttgcacttggatcagtaattaatggtcacatcattgatagtactacatgttcctacagtggatgattcatcattttttgtcacccttacatggaaatatgctggatgcttaggctcatcaaggaccatactctcactacttagcattgcaacaacatttgacatggtcggtcgatcaactgcattctcttgtacacacaacaacgcaatgttaatgcacctcaacatacacgatgactgccaatttgtaaccaatgatgcatcaagaagttcaagccatctttcctctgaccacaacttccatgcctatttcaatatttcaacagacagtataggtaagataccaaataaacaaaacaatctacacactttacatgtgtccaagaactcacatatccaaggagattgatgaagtcttcacattgatctaaactggcatttctttttccgctaatgatctcgagaattataacgccaaagctgaatacatcagattttggagagaagaggccctcggaagaatactctggagccatgtaaccactaaaaatgatatacaatatttgtcaaattttgttcgtgcttgaattataatgaaaaatatgttcaaatttctatgatacttactaggtcccaaccactcttcttgtagttccttcattgctatttgagccaaatatttttgctagcccgaaatctgaaattttggggttcatttcgctgtccaagagaatgttacttggcttaaggtctcgatgaatcacacgcaatcgggagtgcttatgtagataaagcagtccttgtgctattccttcgattatcactagacgtttgttccaatctagtaaatcttttttcctttcatctgcacaaaaattatatattagtacaacaggaaaaggagatagacacctcaacaaaatactgatgggaaaattttccaaattttcctcaataaataaacctaagttcaggaatctagatatataccgaaaatatagaagtccaaacttttgtttggcaagtattcatagaccaatattttctcctctccttgagagcagcatcccaagagcctaactaaattcctgtgctggagtttggcaattagttggacttcatttttgaactctaggaaaccttgtcctgaatgtgaagcaagtctcttaactgctatctccaatccctcagaaaacaggccctgaaacaaatattcagaaatttttcattgtgattatcatgggatctatggtagtatgcagttttttttatacgaatctatataatgagaatttgcatatcattcttttgtattattaatcagacaatgaaagattatactccacatgtgtcttatttaccttatatacagggccaaatccaccttctccaagtttgttttcttcagaaaagttatctgtagccttgataacctcacgaaactcgaaaaccgaaaactctgaaatctctccctccatttcgcaaattagttcatctcctcggaacctgcgactacgcttttctcgcaatctcactctatctggataattgagaattagtgcagattcattactcttagttaacaatataacgaacataacaatttgagatgaacatttcagcggcaataaacacaccttttctgaaccttcttgaccaacgacagtagtaacagacgatcaagcagagaactactgccgctacaggagctgcaatagcagcaattacccatgatttgctcttctttcctaaattaaagaacccacgatcaaatttaacatgtcaattaacggcatatttgcaaataaaaaataatttgtgaataaaaaatgtatatacgtgttcttagcaatctaaaaacaaaggctgaaaaataaacttcgataaaaaaaactctaaaatcaattctaaatttacggttgaaaatttaaattttggctggtaagcatagcataagtattcagagtgaaaatcatatatttacagaggaaaaaaaagcagaattttcagatactgaaaaagagggggagtttttacgcactgtttttggtcggagcgatggaatccggcgccggagttgagcccggcgggctgacacgccgcgtgggctcgccggcgtagaagacaaaggcctcgaacctgagattgcaccggagcaagaggacgcgtcctcccaagcgcacggaggtggtggagttcaccatggcgatgaggcgctggaggcaagccaggcagtcgccggcggccaagtccggcgtgcactgcgccagcgagtagagcgtctgcttcgactcgctgcttccgtccatgaagcctgtggcgaaccgcctcgccgccgccgccgccgtccgggccgtcaccgtcagcagctcgcggacgttggcggcggcgacggcggcgtcgccggtgatgttctgctggttccatgcctggaagagcgtggcgttctccgtgatgttgggcgcggcgaggaagtcgtcgccggcgaagcggaggaggcagtcgtcgtagtagatggtcgccgacttgtcgctcgggcacgtccgccgcgcgtcctggaacgaggccgcgacgcagtcgccgcaggcggtggcgttggcgacgtcgccgcggcagagcgcgagcgcgtacgccgcgtcgggggcctggccggcggtggccgtggcgaagtggtccggggaggaggaggcgttgctcgggagggcggcggcgaggcgcgcgaggttggactggtaggtgccgttggccgtgtagttgccgccgttgccgcagagctgcgccagtagttcgccggcggcgagcggcatgatgctaaggaggagcaggacgccgaccatggcgaacgacggtttacctgtagttgcatgcttggtgttttatccggaatcaacctgtagagattttttttttcaaaaaagaaataaataaaatggtaatgaaacaatactcccagtctaagatccgcgggtgaaaatgattaagtccctcaattcaaaagtctaagatccactggtaaaaatgattaaggtgaaccaaacaatactttaaaaatttatagaaaattcatttcaagtccgattaaggtgaaccaaagtttctccacgatccttacaatattctctttaatatgactggttcatatttacttaaaacaaccattttcagtatgattgtttacttatatatatcttacgtagtctccatgtaagttgatattagtaagtgaccatactaaaaattactgaaattgccatattataggaaatactataagaaatctcatagaactttggtttacctcaatcatgtttaatatgttttttttctatttttcttaagtttggactttctagaggtaaaaatatagaccaacaaatttaacgcatatttaaacccccccctaatgatctcaaatgaacgacctttcaactattaagttgtagatcttattcgaaggttacaaattttttttagaacataccttcgtctgaagacttttgcaaatacatataaaaagaacaaattcaaaaatagatcttagattggaaaaaaatatttgaacccctaaaagatatcaaataatgaataaacattcaactacaaagttgtatatctcgttgagggcaacatattttatgcacataagcttcccgtgcacaccaactagcaaatgccacagaaaattctagaaaaaaaattagatacatacttccaatagtattacaccaacgtgtgaaatattttcttcaaattcattatattttagccacaacaaaaaagacaaaattctaacagatttttacccaaaaactgttagatttttcatttttttttgttacggctaaaatatattgaatttgaatatgagactttacaaatatgtgtaatgctattaggagtatgtgtcttatttttccatcaaagatgataaataaactttttttccatcaagacgatgcagagtaagccagagcagtcgtgttgagacgctccccaaaaaccttattgcccgcctacctgtgcaggcactcaagcggataggattccggaggctccgctcgtcccgtacacctgtgcgtgtaggtgaacggaaccgggaaaggatcttgcagcgcaagaacagagggaggtacaggaggaagaacgaagtgcaagagtcgggtagaactgaagaaccttccgtacttctgttcgttcctatggcggtgtatatgcgagcgcgggagtaatgttaatcaatcaccgtgtttaataccgtccgttacaaaaagagagagagagagagagagaagcagccgccgtctgcctcgccacgcccacggcctggcctggcgcacgcacgcgtgtggctgttcgcccaccatctcaaccggtcaacaaagactctccactagctctatcgaagattacaattttttatagaacatatctccatgtgaagtcttttgcaaatataagaaaaacaaattcaaaaatagatctgagattggaaaaaatatttgaacccctaaatgatatcaaatgaacaaacattcaactacaattcggttaactgagacccatgaccgaccgaattaatttaggtctttcgctgtttgagactgaactactgatcgaatatcttttctgttcagtcttactctacccactcctatttagtggtgctcttatttttaacggtgattttcttacgtataaccacatgtgaaattcagtttttacatgctaatgtcgtagggaataattattttcgcagtggatttgttagagatccaaaaaaaaaaggttttcttagttagtctatgacctgagacaaccttaactatttttgcaagtgctatttgttttagccgcccgtgacgttgagacatttttacccatttgtgcgagaattatatagcagtgccaccgttcttttctattgttcaagtacttctactacctgatcagccaagggggagaaatatcttgatcctgcagtttttccttattgttgtggacgtactccctccgtactcgtaaaggaagtcgtttaggataatatttaagtcaaaccttgcgaatatgaatcatgaataactctcaagttattgagtttgaaaatataaaaattatataaatagatttgtcttgaaaagtcataaaagtatacatatatcacttttcaataaatatttttataaaaacaagaagtcaaagttgtgttttgaagaccgtatcgttgtccaaaatgacttcctttacgagtacggagggagtacactcgtacaggacgaaggtatggatctatgttagtctgacctatataaccaacacgtctaacaaagtattaaaattttaatatttataatatagtaataatagtctatgcaacattcgagttaacgactagttaatataatggcccattaatacataattagctagatgctactccctccattctatattataaattgttttattttttcttaatttaactaagtttataaaataatttagtaatatttactttcattaaaactaaattttaataaatttaaaaaatatatttattttgtgttgagaatattttaatatttttttataaacttagtcaatttttgaaaaaagttaaagcactaataatataaaaacagaaagactaattaagacttttgggtgtgccggtctccagccggcaccctgtccatgtctgcctctccttatcaatcaccatttgttcatttcacctgtcattttgagagataaaaaaatttctcgattcatttatatttatcgtacgttagttgctttcaacattacttcctaaattaattttaggccttcacacacgctttctagtatgaaatgttaacaattaacttgactaaatactctctctgtgtccacaaatataaatattttcttaaagacattaaggataaaacaaaaaaggctataaaatagagtttaggattagttgaaaattaaatgagatatggttaagtgagggaagtagtaccaagtaatcgcgtgtatttatatatggaaaaaattcaaatgctataatttcttatatttgtgatgaaatgagtattagacaataatgcacttcctttcttttccctgaaatcctatggactgacgtgaagggcacgagaccagcaaaaaactcaccgttaataaaatgaaatacttgtaaaccatcactctcgatggtctttgaattattcaatggacgcgccttcttgaatttaaagacaatgtgtactatatgggatagctcgataggtcctgaagtttgacaaattcttcatttagcttgttgctatcaatcaataaacggtccctctttaatttagatatatatatagagacaggataacaggaagaaaggaagtgtcttattgtccacaaatactccctccgtccttaaatatttaacgctgttgacttttttttaaacatgtttgaccgttcatcttattcaaatttttttgtgaaatatgtaaaactatatgtaaacataaaaatatatttaacaatgaatcaaatgatagaaaaaaaattaagaattacttaaatttttttgaataatatgaacggtcaaacatatttaaaaaaatcaacgatgtcaaaatgtttagagacggagggagtataaaagagtgaagtgtataaaaagttctagcacaagggactaaaaaataattttcatatatacttgaggtatcaaaagttgtgatagctctcgtcgtacctatcgaaggacgtaaaatcgctcaagatttttagaccttggtttgagatgtgtgtagtcaagtatgagatcaatttcctgggtctgccaacctgagtagaaacaaaaataagcagaagatgaccggccagcccggcacatcaatcaaatttaattaaacttatatttatattttgtgtgcataaagatttttttttaccttctctcttgagatatttgtagccacatatatgaaaaaaaatcactcgatccgcaaccatagattgatactctcttcgttcatattataaatttattttaactttttttaattattatgttttaagttctgaacaaatttatagataaattagcaacatctgcaatattaacttagttccattaagactaccatttaatatattttgataatatatttattatgtgttagaaatattgctatattttttataaaaaatcaaatctacttataatatgaaaccggaaatgccagcgatcgggcgctcgatcagctgcagaaaaatcatgcgcccaccgcttcccgcgcctatgcacgcgcgctcccgcgcctccgtgccgtccccaccacgcgtcctaccatacgcgccgttgcaacaaatcacccacatattacggaaacgctctgttaagggaatccgtttcattttttgttccaccaacaatgtttcaccaattgtacttgtaatgttttactatatatgaatcaaatgttgcagtgaattgaaacatcctttcgctatttgctgaaacattgtttttatgtagggtgaaacaacactcgatttttttggaaaatgttgtttcgtacgttgtagcaaaatgtttcacgaggtgatttaatttggttgtgtttcagctttttaaaatattgaaacaatttcgatctgcttggtgaaacaatttcgatatacttggtgaaacaatgtctgatttttttttaaaaaaattggacgtccgatttataggtggccccatatgaaacggtaacggaggggtagtataacaaaggggtgtagctatatttatggcgccatatttttcatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacatatgtaagtgaggtgtaaatgatatgtaactactgtgtaagtggctgaaaaaaatcaactagcatatagcgccatatttctagcaactccgtaacaaagagggtactgatcgggaataaaaaggggaagcagctgactggccggccggctgcgaggcagttagctagcttagacgccatggacatcgtcgtcggcgtcctgctcatactgggcctcatgccgatgccgttcgaggtcatcatggccgccgccgacgatggtggcggcgtgttctgcgacaacctcaagttcgtgtccgcaaccctccccaacaaaacctcctcctccccgcaccactacgccaccgccgccgccggccaagcccccgacgtggtctacgtcctcgcgctctgccgcggcgacctcaacgacacagcttgcggcgaatccgtcgcctacacgttcgcgagactgatcaacgagtcgtgcgtcgccaactacacggccggggcttactacggcgactgcaccggcgtctactccttccagaactttctcgatccttccgacgccacagaagacgaggagcccttcgagaggtggaacgtcaacaacatcaccggcgacggcgagaacgtgcggttcatcgccggcctcatccaacagcttctgtcggaaacggtggagagggcggccggcgccgcggggcggtttgcgacgggcgtcgtggacaccggcaggacgttcccgctggtgtactcgctggcgcaatgcacgccggacctgtccgccggcgactgcctggcgtgcctccgccgcctcaccggcatgatcaactccaccatggccgtgcgcatgggtgcgcagatacatgtcacacggtgctacttcaggtatgaggcgtacgtgttctacgacagcaagcctatgctgcatctcaccggcgcgccggctccggccatccccaaaagtaagactattcttggattctcaattagacctcgttcggttattccctacaactgtggaattaatcctctgggtgggcttgttcggttattctccacgactatagatggccaaaataggcgccacggccgggcccgggccgagatcacttgcccatgtccacttgctgcaccatcggtctaggcacggctcaataaaacttgggccttaccaagccagcccaaaggcatgaaagccatcatgctaaaagtttatttgaagtccctaatctctttcggcagtctcttaatggctgggataagtctatttgcatccctcgtttctttgggccatatcctatatatagatggccatatggcttgaggcccatggcccggcctaagacacgccattttggcccgcccaagcacggcacagcccgactcggggtcatgccggtgccggcctggcccgatagccgggccgtgcctcggccgcaccctcggcacggtgggccggcccggcacccaaccaaataaaaaaagtcgtgggatgcaaaatatacttgatgaaccatatcagacaggacccaaagagaagaggaatacataatagacttattttccagccatatagacctagcccacagagttgagggaccaaaaacagatttattatgtgaaaatcacaataagtcgtgccttcaagccggcccggcacaacccgagtcgtgttgggccatgcctgggccatgtgtgcggcccgtgggctggcacggcatggcccggagtgtaggtcgggccgtgccggcccaattaacctcggtccaggcatggccaggcctgggccgtgccgcccgtttggccatctatagtcctatatggctagaataagtctatttaactccctgatcatttgaccgggccatgctgggtcggcccatcgtgccgagggtgaggcccaagcacggcccaaaaatcgggcaatgccatactttaatttggtcaggccaaaaccccgtgccatgggccaagccgtcgggcctctggccttttggccaactatatccacgacggaggcaatggaggggattgagagggaatatataatccctatgtaaatctctctcaactctcttgtgggtgggattaaccactaaataagtccttaatcacgtccaatttctttctcataaagatcaaccgaacaagctttagagattacaaattccgtaaaattaatttaatcatatatatactcttcagatcccacatgtcagtcaccttagatgacgtcacatgacactagtatagcagagtaaatctttattgttcgattaaaaggaaggacatatggtcaaacctcacaccaaatgttttgaatttgtttgagtttagttaaaataaattaacttcagcaaaatcagattcaacctttttctttctgaaatttggaattcaccaaaattattatgtattcagattttcaacctcctgacccacatgtcagttactttagatgaccccacatgtcattgggaacatgagagtaaattcttaaattttgatctaaaggaacagtatatgatcaaatcgcctgctatgatttaaattcctttcttgttagttttgaagtgaaaaatgttcattgccttgaacaatttcgaatttgtttgactttaggtaaagttatttcaaattcagcaaaatctgttcaaattattttttttgaatttcctgaaatttgtaattcaccaaattatttcatattcacgttgtgaacctgtcccaatgcactatagttatgaatgatttgcaaaataatatccaatgtgtactattaatatattttccatgtatacaaattagcttctatctacttttgtttagacaaaagattgttatgtcatgttttagggcataagagcaagctctgggtaattcccattgtcataattcctgtggtggcatttttctgcttcattgtttactgcggctggcggagggggcacagaaaaggtaggttactaatttataaaatatttcatattgtttaaattacttaccgatgtcatggtcagttttttactgaggtacagatactaggagattctacattactaattaattaaaatcagagaaaatgacactagctagttaacattaggtggtctcagaccataaaaggtacctagtatagtgttgtgttcattagatataactgaacattgaagattgatattcttgattattcaggtataatgggattacaagcaaggagaactgataacttgcagggagaggaagaattagtttgggacctagaaggaaaaaatccagagttttcagtatttgagtttgatcaggtactggaggctacaagtaatttttctgaagtaaacaagcttggagaaggtggctttggcgccgtgtacaaggtaaaaatccaaaacacatagttccttcgttaacttttaaacatatatttgatcgtttgtctaattaaaagaactagtacaaatatgtaaaaatataggccatgtttaaggtactagtaatgataaaacaaattacaagaaataaataataattacataatatattttgtataagatgaatggacgaacatgttcataaaagtcaacagcgtcaaaggagtatgtgattataagtaatgggaaacctttctagtttaacctcagtagacaatatacaataaacatgcaactattatttaaaacgggttcaattttggcttgatgataattatcaggaattgaactttcggtctaaagttttatgagacctaaaccacaccaccctcatctccaaatatgcatccaaattagctactggtttcctggggacttttcatggatcaactagattttgcaccacaaaaaccactgaaggacttctatttttttgcagggccattttcctgatggaatagagatagcagtcaagagacttgcttcacattcaggacaaggtttcatagagttcaaaaatgaagtccagctcatagccaaactacagcacaggaatttggttaggctcttggggtgttgctctcatgaagaggagaaaattttggtctatgaattcttgccaaacaaaagcttggacttatttatctttggtatataatttgtattatatttctcagtataggttacatattttgataaaaaaaataattgttatgttctttttcctatcatactgatactttactgatgtgcagatgaaaataaaagagctttgctggattggtacaaacgtctagaaataattgaaggaatagcacatggacttctttacctacataagcactcccgattgagtgtcatacatcgagatcttaaaccgagtaacattctcttggatagcgaaatgaaccctaaaatttcagactttgggttagcaagaatatttagctcaaataacacagaaggaaacacaacaagaagagtggttggtacatagtaagtttcatgtaaattagtccacttatgaaatttatgttataactcaactgcacatacaatatataatttttacttgcatgtatcattttagcggctacatggctccggagtatgcttctgtgggcctcttctctatcaaatccgacgtattcagctttggtgttctatttcttgagattatcagtggaaaaaagaattctggttcccatcatagtggagactttatcaatctccttggatttgtgagtttacaaacacatatacaatattttaaaattgtcttttctgtctaagtggtgtttttcctacattaacctacctatattgttctcgaaatttcatacaggcatggtcactatggggagagggaagatggcttgaactcatcgatgaatcattagtttccaaatatcctcctgcagaaaatgaaatcatgaggtgcattaacatagcattgctgtgtgtacaagagaatgcagctgatcgaccaaccatgtcagatgttgttgcaatgctaagcagcaagacgatggtcctggctgaacctaagcacccgggatatttcaatgtgagagtggcaaatgaagagcaatctgttcttactgagccatgtagtgttaatgatatgaccatatctgccataagtgctagatagtttattcttcatgtgtcatgtggctttcgttgatccaatgtacgtagtatttgaagatatcataacagaattataatgctgtggtatttcaggtgtcggagtatgtactccccaaagagtgatcctagatttttgtatacaaacaaatggcttttgtatttatttggtgggtagcaaatcaataccataactatcgttggtgccaattttgaaaacaaagtgaaaatattgggtatggcctagtaaaaaatgaagaacattggttacaagactctgttcgtgatgggttttaggctgagcttatggtttgcacgacaaaacgagacaattgattagggatatgattaattaagtattaatctctactattataaatattgaagatgtttgtgccggtattttggtatgttatccgtgtttgagtcagtttttaaagtttattcgcttttgaaaatacagatccgtgtttaagtcagattttaaatttgtttgcttttagaaataaaaaatagtcgtataagaaatctctttaaaaaactcgcatgcagacttctaattgtagctcctgattttctaaaaaaaatatccaagcaaattcccacaatcaattttaccttagctaaaccgtataacaataataagattaaaatagttttcactcgttgtaatgcatggatatttttttaagctatattataaacttgaaaaatgggtttaaccaaagaaatgaaacgcagctgacattggcatttgccccagttgctgcctgtctctgatgagtaaacgcaggcgcatatgtgtatccctatccagccactatggctgccacctcacgggactagagtggcaagccacactgttcgccgtcgtgggtactagtcattgtacaaaccggcagcaatcgatgtactccctccagcccataaaaactaacataatactggatgtgacatatcttaatactataaatctggatggagggagtataaaataatgcacttcagaatttcaacctcccgactcacatattagtgactttagatgaccccacatgtcattgggtacatgagaggtgtagaatcgaatcacagtaactaaaccaaccagaggaggggtgaatggttggtatacccaaaaatcaaaaacttttagcggaaataaaagttaccctcgaattcaatgagatcggtctgaccggagtagattagccggtctgaccgaagcgtagccgttagtctgaccggtgtagatcgatcggtccgaccgccaaaacttgttgccgcctcctatcgccgaagccggtctgaccgcaggtcacccgccggtctgaccgccgcgatgccgccggttagaccgccgaaacccggtgaaacacaaatcgaagaactcttaaagtagatgacgactttattgattctctctgtgtttacaaagtgcaccaacagcactccttataaaaatttcgactaaactcgaaaccttaactcaaaacttaactcaattgctctcaaaagcgataccgggaagcctcacgctccccctctatttatacgcgaggtaggcagcctaaagccatgaaccaaactcatactaggagtcctaaacaccttaggaaaccctctagtacaagaaacaaactttacataaccaatcataccaaatttggactccttccaaattcaactccgcatcccatacgcacacaataactccatcgtatgccatatggaatctccatcaaccacgtgcatcaactgtagcctaagtatcccgcatgatctttgaccaccacggacgttgtcttatccccaagccgactcccagtccattaccgcaaatactctcccgaggcatcgagtcacctacacatgaaataaacaaagaaactatcttccgagaccaagctatctccaacttgactcatcagtagcaaacaacagtattacatatatatagtatccatctagaagccataatcatgaaataatcacggatatccaaacaaacaacccgaaacagaaaccgacacagcgtcggccggtcagaccgtgagctgcgccggtctgaccgcgcaatacacgccggtctaaccggcatccacggcccggtttgaccggtcacatgaaataacagcagtatcctatagattcacctatgaaatccaatcatctccaaaaccacttcgtgaataaattccaaatatcaaaaccaataatttccgatgccaattgttcatcacaaaataataataaaaaacctttgattttacaatctcccccttgatgaacacattggcaaacccatcagaaatgttttggtatttggaaaaataaaaacataagtggtaaaaaaagtatacttcgtacaaacgtacacatcgtgctcgaaaatctaaaagaaaacttctctcacttttgaaaagaaagatattccctcatgaaccaaaaacaacatgctcttctcttcaactcatttgtttctccaaaaattttcatcttgcttctcccaaaaaaatccaaaaattttacttgcttctcccccttttgacaatgatttcatcaagcataggaattacgtttattaatgtataagagcttagcatacatattgcatatcaagtcatgtgttgcaataaaaagaagatgaacccatctataacataacaagcatgcattaagtataaccatgaaccaaagattttacaattaagcttgaatcaacaatcaaaattcataattttatacgatttataatgcaacaacttaacaagcacataggttgaagaataaacactaaacacatatacctattgtatttatcactctttctcaaataacctttagcacaaaataacaaagagatttttttgactttttcttttcttgagcctttttgctcatatttttctcttttattctgggtacgtccctgtcgtcaagactgttttcagggattcggcacccattattttgctcacatcgaatacgtccttgtcgtcaagactgtttccaaggattcggtattcattttttttcatattttttattctcttttcacaatgagcaattaaagctatttgaggaataacaattcaataaagcatatatatagagcatttataaatcaaaccatatgctagcatcaacattgcatatttgcttaattcaagtagaatttaaatgtcatgcatcatcgcccttaaaagcaaaatctaaatctcatgaaaagactataatacatacaagctatgctagagacaaataaaccttcaaagtattgctaacatgcacaagaaaataccatatgtataaacaaagctctcttttctcaatttttctcattgtcatatttttgcttgataaaaccataaggtacaaactccccctcaaaccatgccaaaaggatgaattatgcccaattcactacgaagaaaagcaaaacgattataatctaaaggtttagtgaaaatgtcagcaagttgcaactttgtgtccaaaaactgcaattcgacatctcccttctcaacatgatccctcaaaaagtaaaaacaaattatcacaaaagattcttagcaatgttaatagcactaatattatcacaaaagagaggtactttctcaaaagtaagaccataatctttcaaagtagataaaagccaaaaaatatgtgaacaacaactagcagcagcaacatattcagattcagcagttgattgagcaacactagattgtttcctagaagaccatacaatcaatgatgtaccaagaaaatgacatgttccactagtatttttcctatcaattctacaaccaccaaaatcagcatcgaaatatccacttaagcatatagaagatgaagtagaataccaaattccaaactcaagtgtatgattcaaatacctcattatttgcttgaccggttgacgatgtgaagcacgaggagaagcttgaaagcgcgcacacaaacatacaacaaattgtatgtctggcctagaagcagttagatacaacaaagttccaatcatacttctatactccttttgatcaacagcttcaccatcttcatcaggatccaacacagctgtagaaccaattggtgttgaaattggcttgcatttctccatcttgaaccgtctcaagagatccttcgtatacttcgtttgatgcacaaaagtaccttgaggtgtttgcttaatgtgcaatccccaaaaa

SEQ ID NO: 73609 - DNA, 53883 bp, Oryza sativa
ccatatacgataaataaaacagataaagccaaataaataaaagaaaacatgcacacgtacctagaatcggaaagaaatactaatcgtgaaaaatcacactgatgtgttgtcaacatcctttaaactattattttattaaaaataacactacacagatatgcacattaaacttaatctctgatagataaaatgtcaaatcaaacgttttgttgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaaatttttttattgctatttgaggagagagaagcatacatcatagatatatgtaaataaacaaataaacaaataagaattaggcagttattttgctacaatacaatccttaattcatcatgagaattatgattatccatgtatgttttttctttgccaagtagtattggcaaacaatcatgtaaaacacgtataaaactataaattctatatactgagtataattgatgtacgaatgttatacacctctgaacccaattttgtcaattcattactttaaatcgactcaaaacttaaaaataatactgttttcgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttactaatgcaatcatttgtagtgtgccaatggtgaattgagtgttaaaattgtaatttaagatggtatttaggggcacggttacatcgatgcgagacccgtgtttcaaggcattatgtaagaaagcctaggttggctgctacggtcgacttcatctgttagaaaatcattcatgaatatttttaacagtgttatcgtattatctagtagatatgatatttttagacaatttatacatagaagtgaaaataagttatgcataccgggttatgcagtgtagatgatattttttgtgtataaataatgtatcatttattttagtggtacaaatacagtttcttttattaaaagtgtacctaactttcaaaaacaatgataataagtagtggtgataaaagacgagtttatatatgaccaggacaaagggatttttacttaaatctaatagacattctatcacatttagtaatctataccgtctattttacggcaaatatatttgtttttttatttagggtaatctacattcccttacagggtatatgtattaatgtatatactaagatatgatttattttagcattctttttcttgaacaacaaataagatgcccgtgcatatgtgcgggtttcctttccgatttatattatgaaaatatcctccattttatattttgtccttacattgtttgaaacatagcctatgatacatgcatgcgcgcgcgaatgcgcgggctaccttcctagttagttcataattagtgatacagtaacccatatgtgctaataacggattaattaggctcaaaagattcatctcgcggtttctaggctaagctagttataaaattagtttatttactcatatccgaaaatctcttccaatatccggtcaaacatcagatgtgacacctaattaataattttcttttggctagctaaacgggcccttgcatacttggacatcgtatctgttcttttgaatatcacacagccttcctcacagaccagacgacagagcgtatggctagagggcacgaaccgagagttactaccattaccatgaagcatctacctttcctcgtacacctgttcttcctcctctgccttggcctgagcctcaccacgaggtgcgccggcgatgtccagttcatctactctggcttcaccggcgccaacctcaccctcgacggcgtggcagcggtgacggcaggaggcatgctcgagctgaccaacggcacgctgcagcgcaaaggccacgccttctacccggcgccggtgcccctccgtggagccgccggccccaacgcgacgacgacgacggcggaggagtccttctctccacttccttcgtgttcggcgtcatgtccgaccatgtcggcctgagcgcccatggcatggcgttcgtcgtggccgccagccgggacttctccagcgcgctgcccagcgggtacctgggcctcctcaacgtcaccagcgacggcgacacgggcaatcgcctgctcgccgtcgagctcgacaccatgcagaacgacgagttccgcgacattaacgacagccatgttggaatcgacatcaacagcctccagtctctgcgctcctactctgccggatactacaacgacgacgacaacaacaatggcttccgcaacttgaccttgatcagtggaaaggccatgcaggtgtgggtggactacgacagagagacaacgcggatcgacgtgaccatggcccccctcgccgtcgccaaacccaagaggccattggtctcagcgaggtacaacctctcaaagctgctcaaggatgtcgcgtacatcggtttctctgccgcgacaggaggcacgctgagatcacggcactatgtgctcggctggagcttcgggttgggccgtcccgctcccgccattgacatcaccaagcttccgaagctgccgcgaactgtcagcaaggaccggtctaggattttgcagatcaccctaccgttatcaactgctgctttcctactccctgtgggtgcagccgttttcatgctcgtccggaggcatcggaggtactccgagttgctggaagattgggagattgagtttggcccgcacagggtcttgtacaaggatttgtttcatgccacggaaggattcaaaaacagctgcatactaggcataggggggttcggaagggtatacagaggggtacttcccacgtctaaatcggaaattgctgtgaagagggtgtcacacggatcaaggcagggtatgaagcaatttatcaccgagatagtcagccttggttgcctccaacaccgcaacctagcttgtgcaactacttggctattgtcgacgcagtggtgaacttctcctggtgtacgattacatgtccaatggaagcctcgacaggtatttgcatgatgaagaggggcaatgcagtttggattgggttaaaaggatccacatcatcaaaggtgttgcatcaggcttactttaccttcatgaggagtgggaaaaagtggtcatccaccgagatattaaggcgagcaatgtccttcttgacagtgaaatgaatggacgttttggagactttggcctcgcaagactatacgaccacggatctgatccaaaaactacccacgtggtcggtacaataggttatatagctccagagctcggccggtctggtaaggcaacacctcttactgatatatttgcctttggtatattcattctagaagtcatttgtggccaaagacccatcaagcaaagcagagaaggtcatcaaatcctacttgttgactgggttattcaccattggaaaaatggaacgctcatcgaaacggtggacaaaagactcgagggaaaccatgacactgatgaagcaatcctagtgctgaagctaggactgttgtgtgcacatccatttagcaatgcaaggccaagcatgcgtcaaatcgtacaatacctcgacggtgacatggcattacctgagcagatgccaacagaccaaatctccaatcagacggagggcttagaccagtatattcaaacagggcctcaatcaacaattccagtcaatgcaagctatggcacaatgtctaacctttcaggtggaagataatttaacaagtgggcattaacacctttaagtgttgcaagacgatgcatatgttattgcaagcagatgatcttgtgataggggaggtgatttgtggttagctgcttcaactaattaaatcgttaagctttaaaatggtgaattgtattcaataaaaatcaggtgatagaaaaagacagtcatgtgtactcctatttctgtgctagctagtgctaccatattttcattagttcaagattttacatgttgtggacttggcaatcccatccctcaagaatggcatttaatttgcatcgcactaatgatgtacgtatgtacatatatcatcctagtttgcaagaaaggtacgttttggtcttgaatgaatcatggtcatcattttgtaaatgttgaaagagatgggtcgagactttttctgcaagtttcttgtactaattagcatcacttttgacggacatgtatcatatcaagcgccccggtcatcacggcatgagatttacgagtacatacctgctctgtgacgcatgatcgctacagtagccgtactatacctcggtgcgtgggatcagcttgttgatctgttgatctggtaacccgttcctacatgcatttgctaagtctccgagcatatagaaataggctatttccaaaggtgtatgtgcaaaacaatttaaagaacctcctgtgtaaatagctaggatttctacgggcggagtttttcaccggttgctctttaagtaatggtaaaaattacttttacacatgccatctactacatcattacccgtctgattcaagtcatatatgataggcgggtgacaatatttcagcaaatagcgaaataatgtttcaattcactgtaatatttgatccataatagcaaaagattatgagtatacactaggtgaaacatttttttggaaaaaaaatgaaatggattcgcttaatagagggtttctataatatttaggtgatttgttgcgaaagaatatttcaattcactgcaacatttcatctattcataatgaagcatcataagtacactaggtgaaacattgttggtggaacaaaaaattgaaacggattctcttaatagggtttttccgtaatatgtggggatttgttgcaacagggtgagagtgactagtggggacgcatgggagacaggcggagatgccggggggggggggggggttgggggtgcccgatttttctaacgagcgttgggcgcctgatccaggcgttttcccaatggcggccaagcaacgcactcgtagctgtatggatagctagatttttcacattttggtccttttaaaaaacttatttcgtaaatagacctctagaaaaacttattctagaaatggtcctttttggggcgccaaagtggctagcgccgtcctcctgccaccgtggcggggcaaaatatgtgacttgtaaaattttctaaagctctaccgaaatggacaaaatatgtcatctatctattacatactaaaagtccattaaacttcctacaaacgctcttaagccgccacgtggcactcctacaaacgctcttaagccaccacgtggcactatctaatcttaccgtcgattttcacttaaattggtagacccgttattttataccattaaattagatctattattaaaaaataataacttcctcatatattatataacatagaaacggtactgttcagccatagagtttatatacgatacagaacattaggtacgtattgaaaataaaataataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctactatctatcaactatatatatactaaagtatgttaaacatacgacgaatgcttttacgccgctacgtgtctctctaataaattagagaaatcctagaaatttatttatatactaaaaatgcattaaacatcctgcaaaaactattacgccgtcacgccgtgctataataaattagagaaatcctagaaattcagagaaaaaagaaaagcatatgatcctttaatttttacttaaattggaggacccgttattttaaatattagtttagatctattaaaaatcccatgctgctaatctctatctggaaaaaaaaaacataatgtgcgtacgtcgtacgatcgtctccatcctaaaaaaataaaacttaaatacctacaccatatacgataaataaaacagataaagccaaataaataaaagaaaacatgcacacgtacctagaatcggaaagaaatactaatcgtgaaaaatcacactgatgtgttgtcaacatcctttaaactattattttattaaaaataacactacacagatatgcacattaaacttaatctctgatagataaaatgtcaaatcaaacgttttgttgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaaatttttttattgctatttgaggagagagaagcatacatcatagatatatgtaaataaacaaataaacaaataagaattaggcagttattttgctacaatacaatccttaattcatcatgagaattatgattatccatgtatgttttttctttgccaagtagtattggcaaacaatcatgtaaaacacgtataaaactataaattctatatactgagtataattgatggacgaatgttatacacctctgaacccaattttgtcaattctttacctcaaatcgactcaaaacataaaaataatactgttttcgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatacaatcatttgtgagtgtgccaatagtgaattgagtgttaaaattgtactttaagatggtctttaggggcacggttacatcgatgcgagacccgtgtttcaaggcattatgtaagaaagccttggttggctgctacggtcgacttcatctgttagaaaatcattcatgaatatttttaacggtgttatcgtattatctggtagatatgatatttttagacaatttatacatagatgtgaaaataagttatgcacactgggttatgcagtgtacatgatatttttagtgtataaataatgtatgatttattttagtggtacaaatacagtttcttttattaaaagtgcacctaactttcaaaaacaatgataataaatagtggtgacaaaagacgagtttatatatgaccaggacaaagggatttttacttaaatctaatagatattctatcacatttagtaatctataccatctattttacggcaaatatatttgtttttttatttagggtaatctacattcccttacaagatatatgtattaatgtatatactaagatatgatttattttagcattctttttcttgaacaacaaataagatgcccatgtatatgtgggggtttcctttccgatttatattctgaaaatatccttcattttatattttgtccttacattgtttgaaacatagcctatgatacatgcatgcgtgcgcgaatgcgcgggctaccttcctggtttattaaaataggcgtaactttctcatacggactcggaatcaggcaaataatatattcacggatatctacagaaaaagttacatccgattctcggcatcgccccaccacgtcggcagggggacggcgccagagaggctggcgccgtcccattggacaacggcgccaacctctttgacgcccaaaaagaaccatttctaggataagttttttcaggggtctatttacgaaataagtttaaaagaaccaaaatgcgaaaaatccaggtgcggatagtgttacccgagttccattttcttgcccgatgaccaatgccaacggcagtaataattaacattgacattaattggcctggtctggtgtacaccttttctgcagcatcaaaatatcttctgcaattattgtacggtttctactattacatgatggggatgttatgcttgacaaaggaaaacaagaggaacctccttacactagtaaaacaaaaaacattttttcaaatggttaaaaaaaatttcgtgtgtgattaagtcgcccgtctagtgtgaaaatcactatttttctacacggttagcaaacacgcacgcaaaattacatatcccactatagtactccctccgtcacataatataacgaaattttgaatggatgcgacacatcatatctagattcgtagtactattatgtgtcacatccacccaaaatatcttatattatgggacggagggagtatcatactcaaactacatagcgctcgcgatctgacgacccacctatatatactttcttttttcaaactgcaaaagctagctttaaacatccgttatactccctcggtcccaaaataagcgcagccatgagtttccatgtccaactttaatcgtccatcttatttaatttttttttagaaaaagctaaaaaacttaagtcacatataaagtattattcatgttttaaatctaatagcaataaaaataataattataaataaaattcaaataacacggacgatcaaagttggatacagaaactcatggctaatctcattttgggagggaggaagtatgtcttaatacaaatgtgacccgccaagcgaaaatctgtcaaacaaagagcacaatgatggaaatatattatattaaaccctgagggtttctttcttcaataattcaaggcgtggttaggctgaacttcacgagtctacgagctttcacatacctatcaagctatctcctattacaaaaaccatttgatttaatacaggaccccagaaaatatcttgttggcacatgttacctgaaatattaactcatgttttgtattttgaaacatataatgctttggagtcgtttaattatttgaaatatatgattatttttcagatagattatttgaaaaagttttctgcttcccatgagtgatttattggaaacttctaattccacaaaaatatttaaatctctaaaacgtctgaagtcatgtcttgagtatcaaatttgttggagcggtgcatccatatacaaaatttatattgatttactgatcatgtcaattgtttctaataaacaacgatacagtaagcttattctgaatttcacaagctagatgcacatttgcaatgtgaacataattataagtaaattatgctacactaaaacacaataatgtatttctcggaagttgttcttatagtagaactataaatgatatttttagaataaggatgtgttccttccggttcaataattctgtgacattttgaactcttataactttaactatcaataactctaaaattattttgcttaaaacgtactagaacaacatattagatttgtcttactaaatattatattaaaagtaaaaaaatatttatttattatatatattataatagaaaacatagtgaatgatacatttaggaaaccatgttattgttcaaaacatcaagatctatggaacaggacgcagtacaatcatgttttttgcactgcatatattctggagtggtccagtctattcatataatcatggaaactaagtgtaaactcaccccttatttattttgcatttgacagacatatatgcacttgcagtaataactagctaattaacaccatttcttatactacctccatcccaaaatgtttgacgccgttgacttttttaaatatgtttgaccgttcgtcttattcaaaaaaaatttaagtaattgttaattctttttctatcatttgatttattgttaaatatacttttatgtatacatatagttttacacatatcacaaaagtttttgaataaaacgaacggtcaaacatgttacaaaaggtcaacggtgtcaaatatttagggaaggagggagtagttaccttccacctaagaggaaggatacggtgccaatggttgctgcagacgatggatatgacattggatatgagtcgaacccttcattctgcattagagccattgtgctaaagctcatatttgttgatgttaagtctgggagtggagtgtcaccatcaaggtattgcatgacttgtctcatgcccggtctcaagttggcagatgggtgtgaacacagcagtcctagctttagcacccggcatgcctcatctgtattacagtcaccttgcaacctcaggtccactgtctcattaagagagccttttttgaaatggtcaagaacccagtcaactaacatttcttggttgtatcgtccactatcgtcgttgaccggtctttgcccacaagttatttcaagaagaaacgcaccaaatgtgaaaacatctgttagtttggatgccttaccggtccatattagttctggggccaagtatcccattgtacccaccacatgtgtggtttggggatcggtgccatggtcatacaaccttgagagtccaaaatcacctaagcacccattcatttgatggtcaagaagcacattgcttgcttttatgtcacggtggatgacaactttctcccacttctcatggatatagagcaagccagacgcaacacccctaatgatatgaaacctttggctccaatcccgtaaaggcttatcctcctaacaatacagatatttatcaagactaccatttggcatatattcatacactagaaggagttcaccttttcttctacaatagccatgtaattgcacgaggttgcggttccgtaagcggccaatggtgacaaattcagagatgaactccttcataccctgccttgactcgtgagaaaccttcttcacggctacctccaatctagacttccgaaaaactcctttatacacctggccgtaaagtcctgtacccaggagatgtttgctcttaaatccattagtagcatgatatagatccttatatgagaatcgatgggggccaaattcaagctcccaatcttcaagcaactgagcatacctcagatgccttaacacgagtagggtggcaatggtaccaagactgagcatgactgttgctgtagctattggtaggacgattactaagaccttggatggaggcttgggtccgaaacacggcagcttaggaagattggcaatgttaatcggcggagcagggccattcatggcaaagctctagccgagcaggtagtgccgataattgatctcgctagtcacagatgagaaaccgatgtatgcccactccgtgagtacagttgagaggtcatacttagcggaaacaagcggcttccttggtttagccactttgattggtgccaaagccacatcaatctgtcctgtgttgccatcatagtccacccacacctgcatcgcttctcggctaaagagggttaggttcttgaagacgccattgttgccgtcatcgtagtagctagttggggaggattgcaaagagtgaagattgttgacgttgatgccaacgtggttggcgttgacgtcttgaaaatcggtgttctggacggtgtcgagctcaaccgcgaagaggtggttggtcgtgttgccgttgttctggacgttgaggagggccaggtacccaaccggcagtgcggtggtgaagttcttggtcggggacacgatgaaggccataccgtgggcacagaaatcggtgtagtcggagatgatggcgaacacgaaggcggccgagaaggaccgagctgtgccatcaggcgatgtgcggaactgcagaggcgcggggaagaacgcatggccttttaggttggtcttgcggctggtcagcacaaggatcccatctggcatgacggtggcgttgccgtcgagcgtgaggttggtgccggtgaagccatgataggcgaactggaagtctccgctgccggaacacaaggcaagtgctaggtgaagaaggctgatgaggcgcaagaggaagaacgcaggcttcatggtcgtatgtggtgggggattgtgcgagagggcatatcgttggccacactctctaataaagcacctttcactagtcaatccttaattaagaggtgggatatgatagtcttggcagccaaacgtacgtgtcgagatgtctatgtggatatatagctgtagtgatagtgtattacagtatcacaagaaggagaatgccaattctaatctcttgtcatggcatatagtatttttctgttacataaaaaaatggttttcatttaacgcccttaaaatatttgttggctgtgaagtgtgcatagcttaattgattaggcttgctctggtggaacctacccactcaggtttaagttctagatttgatttggttctcgcatttaggtctaatattcttttagtgatgtacctttcaatagtgttcatgtgggtgtcgtgtgcgtttataaatatagtgagtgtttccatttgtactatatttttttaaaaaaataatcgttggctccctgcaccagtttagtccatgaattactgagatgagtcactttacccctaataatatttcttttttttccctctctttgaactttaaaatacaattaggaagatagtccgcgcattcgcacggacatgtatcataggctgtgtttaaaaactataaatacataatataaattggagaatatttccggcatataaaggaaacccgcacatatgtacgggcatcttatttattgttcaaggaaaagaatgttaaagaaatcatacatcactatatatacattgtaaggaaatgtagattattctaggataaaaatagacacatatttgccgtaaaattgacagtagattctaatataccactaaatctaataagaatgtccctcagatttaaataaaaatcccttcgttctaggcatatataaattcgcattttgtcaccactacttattatcattgttctgaaaattaggtgtacttttaataaatgaaactgtattagtaccacaaaataaatgatacattattaatacactaaaagaattcatctacatcgcataacccggtgctcgtcacttaatttcatatctgtatataaatagtctaaaaataccatatgtaccggataatacaataacactgttaaaaataaacatgaatggctctctaacggatgaagtcaactttagctgccaaccaaggctttcttatgtaatgccttgaaacataggtcccgcattgatgtagctatgcccctaaagaccatcttagagtgtaattttaacacttagttcactttaggttaatttcgaactcagtgacaatggagagacctaaagtgaacttattcgctaggagctagcctccgtatcaaccgccacgcactctgggctttgcctgggccagaaagaaatgtgtaaccagcattgctagctatttgagctaacggtacttgtaagcagtaattggcttgcaactcctgtacgtgctcataactggcttacatgaagagaatttggagcagaattactatccctgcgatgatgtatgtgttgatccatgttcagcaaatactctcgaatgcacaatgacacgaatgttatatatcttgatctgattggcatagctctaactcctaacttcaacttacctttaactaaagttatgccaaacggtcaaaatcctatgtttttttggagtggggtttgtagagttactcctagaaaatgaactaagagggtggagccgggtttttactgttccatagccccactccacccaaaaaacccactgctctttaattattagcaaatttttctaccggacatcacaattttgtggttttaaccgtaggacaccacacaaaatcatttttgggaaacacactctgaaaatatggttatttgctaggggacactctatccattaaattaatgttttcgtgttgactagacgagagtgggctcacatttttacgtgtcttgaccaaattacccattctttctttctcttccttatctgaaatctctccctctctcttttttatctcttctcccggcggatggcgtggttggcagcgtcgacatcgacgtcagcacccggagcgcgtgtggcctattcagcggcggcggtggcggcagcctgctcggcggtggtggcctgttcagcggcggcagcacgcacggcggtggcctgctcactggcggtagtctgctcgacagcagcagcagcctgctcggtggcagtgcccggagcgcgcgcggcctgctcggcggcggtggcggagcccgaagcacatgcggcctgttccgtggacggtggcgcgcgcggcctgctcggcagcggcggtggccacggaccacgccagtgcgtggatctctgccaccagtccaccacggctcgctcggtgtggacaacggcgacaatgacgacttcaagtgcccactgtacagggaagtgacggagggaggtgtcggacgtatgtgcctgccacagtacggttcggcaacggcctcgccattgcgagagcggcagcggcaccggcggatgaccacgacacatcatgggcacgtggtgctcatcgtggtgatgttgctgctgttggtttggtggtgttgctctccatggttatgctgctactagctgctggttggtgatggggaagaagaagacgcactccaggcagtagatgtccaaccactcctcattcgccgatagacagagaagagagatgggagaactaacatgtgggtccagggatatttttgatattttatacaatttttctctcctctctatctgaaaattattattttaatgggtgcagtgtccgctggcgacttaccacgtatatggagtgtctttccccaaaagtcatttcgtgtggtgttctacaactaaaacagtaaagtcacgatgtagtgtagcaaaattttctttaattatttgacgtatttacgcgaaaatgccactgacctaccccaacctcctcacctccctacccgacgaccgggcgagcagaaggccacggcattccggcggcggctcggcgatgcgcgtgcgggcagcagggtgacgacggtgctccggcagcggtgcgcggacgggcagcagggcgacggcggcacttcggcagcggctctgagcgcacaggcagtaggccagcgacggcgcagcttggcgacgcgtgggcgggcagcagccgcagcgctccggcggcgtcgcgcggccgggtagcagggcgacggcggtgctccaacggcggttcggtgcgcgcggccagcaggctgacggcggcgcggctctgagctaatcccctagaccctttttccttttttttttcaatttcaaatctgcacaaaaagaacaatagggtgattttgcatgtatgttgtgggggatttcttttttatatgaactatatagatgtgaaaaattatcatgtgtttatacaaattgaagtgagaacaaaatggtagactatacaaatttcaaatctaaaccaagaaaacactaggatgctttcactaattatgtcaattattttggtgattaagttttaaccttataattatgttgctgaaattctaaataaaaataaacatttatcagtcatacatcacggaaatagaaaaaaaccacaagggtactattgtcaacctccccctatgctctgtttctgaagttctgaagcagagtaagcttgtcaaacacttttcacatgacatccaactcccacaggagcgagtgagagttaggagctaggagttggaatttggagccctcccaaacaggccttcctgcataactagctttgtcctgtttttgtacgttgctagcacattgtgatttaaactatacaagacaaaggtgagaaaaataagtgaaaattcctttataataattaataggacgttcccgtcattaacttaaccctacaaacattgcttcattgcttgaaacatctaactaaataattttaaattctatcaaaattttatataataaatcatacgaacatcttatataaacagtaccgtggacgtgttctcagccatacttaaaatgtgttcttgctggctttcccaaactcaccctccttgttttttgcaaaaatattctatacacaagttgttttagaaaatcatattaatcaattttttttaaaaaaataatgcttaattaatcatatcactactagaaaaacgattttttatggcgttggcctaatattttctctggcgataaaatgtgaaaaccgccaacaaggttgtaacgaggggtgggaggcaacgaccgccagcaaaaaaagattttcgttggcggccgagtaatacaggccgccagcgaagatttttttattttcgctggcggtaccttctaagtgccgccagcgaaaataggttcatcttcgctagcggtatgatgatatggaccgccattgaagatgaacctattttctctggtggctctctttagccaccgccacctctatcattttatatggcggtgcattaagtagtccaccagtgaaaattggttctcctatataaggccgtgcccaagctaccatgccatttgagcacgattttctctctcttatgaactcaaacatagggggagaagtttttgaactcgaatggtttgatagatattttgtaccaaaaggttagttatactttatagttctccatttctcaattttttttttcatttttatccgttctatgttgagattttgcaaggtcaagtttccaaggcatgttcgttttgatttgttttgtggtgttgaaaacggtcaaaattgttatgatatattgtacatgatcaatgtatatagatttcacaatgttttgatatgtttatttatagaagatctatatggcacggttgttttgtgcactttaaatctatatatctggttatgaaagagaattgagagaaagaaagagggtagtttggtaattttatctagttttttctagttgtatgtctagttgtcatgtattgggaatatatgagtggtagtttttttttaaaaaatgaagtcataatatagttttaatttttccgtgtttatactaattgtaatatttttcacaatgtttaatttatttgtttacatattagcataattattttaatgtgacatattattaaaactatttaaactaagttagtttttttttctcaatgcatagacgatggcagacagatcatgaatgttcatgaatgtatagagagatatcgtgcgtcatatattgtaggagtcaatatatttatgaaagctgcgaagaaaaatgctgtagctaagaagacaaaggaaattaaatgtccatgcaaacactgcaaaaatcagaaattttggaatgattcatctgtaatcgagcaacacttggtgacacatggatttgttgaaggctacacaaactggtcacaccatggagaaatccctgcaagcttccaagttcccaaccaagagatagtacaggatgaagtgttcaatgattggaatttcatggtagtagaagaagaatcggttgatgatgatggttatgacacagctaatgatgttgatgatggtcatgtcacagtagatgatgctaatggtagtgatggaactgcttttgatttggaggagatgttgcgccatgctgaacctgagacaattttcactggcggctcccttgagaaagccgctagcgaaaatagatcttctctagtggttggactccgccagagaaaactctacatcttcactggcctttactctctggcggcgcctagtaccgccagcgaaaacctgttttagctgccaaaaaaacgtatttcgtagtagtgtatggtaacgagttgtttcgttttgcgtcgaagggattagttctcaacgaacgcaccctgtatgggcagtgatatataggcaagtacgcatgcagccttatatgggtagtcaaatgtagtcacgaattaaactctcccttaggtacaacatatgcatatgccactttcttcatgagcaaacatcgctatggatgctagcaatgttgcgccgattgatcgaaatataggtggcactaggaagcatgccaaatggatttgcagccaaactattactggtgtaagcatgcaatagcctccatctacacactcccagaacaccactcaactcacactacttgaaaaacgatttttcatgacgttatcctattttttcgctgtcggttatataagaaatccgcttgtaaaattctgatgagggatagtgtgtttagaaccgccattttcgctggcggtgagtttagaaccaccagtgaaaatccgttttcgctggtggtaggttaagaagtccgcttgcaaaaatatcccaatttttgctgacggacctcagcgaaaatcctagtggaggaccgcgccgctctggccctttaaaaaatcgcggcattaaaagtcgctccacctacccatccttatctcctccttccactccctctctccctccaactatctctccctccatccacaggcatgagcggtgagctcgggcacggccagcggtgtgcttcggcgcgggtagaggagagggctggcgcgggcggcagcgagctcgattgtgggcaacagggagggcggcggcggagcttgggcgaaagggagggcggaggagagggctggcgcggtcggcggtgagctcggttgcgggcggcggttgtgaaaagaccttaatgtcgcttagagggggtgtgaataggcgttcctaaaaattatcacaacttcatagcatattagaattatgagaactttcggttcaaacaggaacttccgatatgagattggaagttccggtctcaaccgaaaagttcggcggataatggaataaaacactagctatgaacttgtagctcaaataaacaaaatgtatatgaatcaaaaagtgacaaataaggtatctaaacaagatataaggtcaccaactaaatcaattaagcatgcaagtagatcgggtaaaaacaagctcaagcactatgagagaatacacaaatggacaaaccaagagaggagacgcatgatttgtttcccaaagttcggatccacggatcctatgtctccgttgagtagacacaagggccgggcctatttcaaccctttcctcacgaggttgcacaaatgcactcctcggtttcactcttgatttcttcccttgcggaggcgaaatcgaagttttcacaaactttccgtggcacaccacaaccttgggtgctcaccggcgacgcctagccgtctaggagaccttagtccccaagagtaacaaacataatcgaagatttgcttgctatgaactcgagtgctcaaagtatggagtgaagctcattagctctcaacttctcaatcactcaatccaactctttcctcttctcaaatccctctcacaaagaggcaccacaaaggatggagtgaaactcactagctctcaactcctcactctctcaatccaactttctctctccccttctcaaatcctcctcacaaagaggcaccacaaaggtagggaaatggggatggctatttggctttggatgtgtctaatactccccaagagcagcagccactcaaaggtggggtggaggagtttatatacccgagcctcttaaaaactagccgttggaggccaagactgtaatttttggatttttcgaaaagcattttcggacaattccgaaaatctacagaagcaaatcttggattctgtagatttatccgaaaacttttcagagttttcgataatttttcggactttccgaaaagcacagagtaaaacaactataacttttcgctcgggagtccgtttttgatgatcttggactctatggaaagctcactcagaggactacccaactcaaccaaaaacaaggtctaaaaccactcaaaggataggttaaagcttaggtttctctcaagatagcactatgataggtcactttgagcaccgagacatacacaaacacctcgaagttgcatccctcttaatagtatggcattcctaaactcaaatgtaaataagaagataattataccattaggaatacctttttttcatctttcttttattgtcttaagggatgccaatgccgataccgtttcaccatatattcttcaaatgattgatgcggttacttgtagcttcaaatggtctcgcacggtccattatgacaaagccatcactcgacctttaccaccggatttggttcttcggcgccaagccccttgcttgcccttcaccgccgcatggtccatcgcgatcgagcatcgcttgcccttcaccgtcttgccataatagctacttcgtatcacacatcttcaatatcttcactttgtcattcttggtattgttaggtgtaattgtatcacttgaacatcaacatctttgtaatccttgggacctatttctttcattcaactcaataaaattattagtcccaatgatccggttgtcaacctccactgttgaccaaccgatcgcatgtataaaaggatatgaataaatgatgagtattaatcaacaccacaagtgtcatatactcaaacatatgttcaaatgtaaagatcccaattaaatgaaggtgaataacttggatcgattacatgcataactaaagtataggatttgctccccctaaatgtatgcatacaaaatatttgtgtgaagtaagagtatgcataacaagatattaaacattgagagcttatcctatacaagaatagaaggcatttatcaaatatagacaataaaataaaaacataccttcatcatctccatgttctcaatgtaaagagactaaacaagatatggctcaaacaaaacattagtctcacatgctgtagcgcccgttccgtcgtggcgcctagcgggaaaaattaaattctaaaaaccctaattgcgaaatctgtttcgttgcttgttgtcagtctccatgccaatccctgatctcgaatccccaatctatcgtcaaattcaaatcccgaatccaaatctctccaaattcaaatccctctgtaaaagtctagtttgccttcctcaggttcggtgggccgatttccctctcggcccatatctctctctctctccgtcagctctcccctcgctctgctcgtgcgccgcaagcgcgtgcgcgtgagccgacgccgagccgagctctttctctctctctctctctctctttctcgttctcttgctctcgctctccccggtccatccccggcaagctcacggcgcgccattgcgtcgcgcgcgcgcccccgcgcggtcgccgccgtcgtcagctgcttgttgcccgtgcctgtgccgtccggccccgcgccctgccgcgctgcgccgcctgcgctgcgccctgccccacgagccagcacgcctgcccgaggcacgccgcccgcatccgtccaaaacctgaggcagcgcctcccgctcccatctctctccctccccaaattggcatagcgcgagctccctttccccccctccgtttctccctttcccctttcggcctggcccctgcttcccccattctgttcccgcgccatggacgcagaggagcagccgcgccagccgtcgcccatgccgtttgaccccacgcccgtgagcccatcccttctcctcgaagctccctcgccccagcactgctccgaggtcggtttccgaaccgacattgccaccccttaaaagccgcccctcccctctctctctcgatccccctgtttcgctcgccgttcgttgtcgcgcgtgtcggaggagccggcacgagcgaggacacgtgacgtggactccgggcacaccctctccttcctcttccccggcccgaggctggagcgatcacgccccgcgccgtcggccatcgtcaccgcgccccttcaccccgtcacggtagtgctttcctccgttctgcctcctcgctccatctcctccccttagactcgggtagtagcacgagtagaccccccgtagctatctggcgccgccccaagccttgccgccgcctattgtgtgctcaccgccgtcgccgcccgagctccgtagcgcctctcgtcgctggcctccctcggtgcatttcctcctaatccagcgcaaggaatggattcgcggagtcgcgtagatgctctagtgcgaaggaatcgaactcccgtcacgccgtcgccgtttcccccttctctcgccgccggttgccgccgccacaatccgccgccgtcgcactccctccggcgaatccgagccgttagctcgtctcctctagtcccgcgctacctcccggtgtgttcgccctcgcccgcatccccgtatatcgccccgccgctcgccgccgccatccgccgtccgttcgcggccgcgtcgtcgtcttcctctcgccggtccgcgtggcagccacgtcggcgccagctcggccaagaccgggtcaagcagaccacggccccccgctccccttcgccacgctcgcgcgcgcggtccaccgcgagccgtgaggctgcgcgtgggcccgccgcatccgcatcccaccgcgagccgcgcgcgtgcaccgcgccccctccgaaccctagcgccgcgtcgcgtgctcctcgctcactgtgagccgagccgccgacaagcgggtctcactcgggaccacgcgaggtggacccagcccaccggttccccctccctctctccccgcgcgtgccctttggccgccttctcgggccggccggcccatttagctcggccaagccgcccttttctctcgggccgcgccctagccgcccgagggaagtctatttcccctccctctctcttttctttttccaaaagggtttaattaaatcctttgtcctttagaccaaaaatccaataattttagaaattcaataacttctcaaccgtacatccgtttgactccgttcaacttccaaaaatcctcaaatctcgagatctatctaatggcacgcctataggtcaataatagggttttattttcgccatttgttgagttgtcccgtttcacgtgtagttttggagcccgaagacccgcagtgcgaggatttcgaggatcaagctcaagatctcgagcaaggtaagtcacctttgatcatcttgcacctataatttaaatctaagtatttcttttccgcaaatattgcatgaataggtttaacacaagtaattcggccgcggcttgcaagatagcctacagaccccaatcctaattgctgcaattaccctccttgaattattgaacaattaaaactcctttgtcgacttttgtgcttcgatgcacgggctttcgggcacgcgcattgaaacacctcccctcaaatataaaatatccaacaatgggtaaaacttggggttttacaaaagacttagaaaaacctgacacctgggtcggtgtttgcgaactaaatgaatttccaaaaccgcagaccgggggacgtaccgggagtacggtttcccgctcttgcacttaaggaccgtttccttggaatttcatccgaacataagacaagtgcgaccacatgggtgtaatggaacgcccctggctgagtaattagctaatcgggggagccatgatgccaagagacatgtggattcaacggggtggtgccggggagaacccccgggtttcctggcacagtatggtctgggacctaacctggtgttggtctgggacccctctcgttggcatatggtgaacctgtgtcggctttcaaaatgccttgtcatgaaagcctcaaggtctccagacgtggccgttctgcacgggctgggtgattcgggttagtaatgtcatgtgggtaaagtgtaccccctctgcagaggttattaaactgttcgaatagccgtgcccacggtcatgggccaatgtgaggtgattcctagcgtagttttgtttgactacagcttgtgaacttactgttgtggaatgggttcgatgtttggaaaatctgcggctgatgggatcagccaggcccgggtggccgtttgaaagctgttggccgggtgccaaccttgaaccaattcaaagactgatacattgcacatactccgaccggacaagacgcactgtctcatccgtgtcgtttgagaagcactcacttagttgtttcaaaaaggagtttaaataaaatcaattgtaaaaacaacagcctttcctttgaatcctgcattaaacacttaattcccatggcttgctgagtactcctgtactcagccttgctctatataaataatccccccagttgctgaagaagatgaagtggatcccgctgatgaggagttcttccaggagcaagtcggctacgatgagttttagggtttcggcctagttcccaagtcgcgcctatgatgattggtccaagtcttggcttccgctttcccttttgtaatgcatttttttttgagctcgggatctgtccgcagcccaacatgactgtactcctactctgtaataaagagatctctgttgctgtgatattctgtcttcctgtgataccaacactgtttcctgggactggtatcgattaacaggttaatttggagcgtcacgggctagttccgtttggggctagttcggggcgtgacacatgcttatgtaatcacatgaaaatattatatataaatatatcaatatgtgcacggataaaaagagtggtacatatagcttgatctccatacatttcatccttgtgatttaggtacaccatcaatgaacgtttttctcttaactcatatgaagtccagaaatcacctctcacatattccactttcatatccatatgagactagtagacaaagaaatgcttataacaatgttagtctcatgtaattggatttgtcattaatcatcaaaaccaaaataatggcacttgaactttcaggttagcggcggcggagctcgggcgtggcggttggcggtgctcgggcgtgggcggggaggtcggatctgccgccgccgcgccgctgggaggccggatccactgtggggacaaggccgtcgccgctgcaggggacaaggccgctgccggtggagctactcctcatccaggtctatcacctcatcacctcccaatgtcagcacccatccgttcttgcgcttcgattcgccatttttgttgacacggtaatctgaaatccgtgtgtggtggtggtggtggatgcgcagaggtgacgaaggcgctgtgggcgaggaagaacgagaagatgcggtggtgcgagcctaggcagtagcatgaccagctccagcgaggcgacccgctcgccgatgtagccaaggagagatgcagcggcagtggcgaggggacttcaaattttttttattgtgttgatttttgtgatgctattgtgttgatttttgtgatgcttgaatgtttgagtgaatgaaaattctttaatgtaaatttctgtggaattttgaatgcttgggtaaatttctgtgaaatttttgaatggtgaagcgttgacggaggcggacggagcagtgttgctccatccgtcgttttttttaaacttggcaagcattaacactggcggctggttcctataacccaccagtgataattcatttacgccggcggctggcttaagacgaccgccagcgaaaatgaattatcgctggcggtcgataaccactagcgaagatctacattttcactggcctttgctttgtggcagctgcgatttccaccagcgaaaacccaaaatggccgccacgaaagatggtttttgtagtagtgtcaagagtaagacatctgagttttcatgccgcacagcccatggacagatgatggttgatggcttcaaaccgtctattgccatgtcatatgtgcaagcaaggtccctgctcttatctcgtgggtcatacgtcatgcatataattatgcacaagcttgagaaaaagaactgtaagactgctgtgatatgttagttgataaaaggaagatgagttgtgggagatatgacaccagagataatggtgagactactatcttagatgcaagcactggtagagaactcatattcagtcccggttagaaacccccattaattccggctataacaaccgtgactagcaaatagagaaccggttgaaataatcgatactaaagatgcataccaagtcaaaaaaaaatgtgagcttggtaaggtcacagtgatgacagcacagtggctcgatgaggctacaacaatgacggagcgacggcataaggtactggcagctagcgatatcgctggcacgcgaggcaagtggtcatggtttgcgcctatagtgtgggcagcgaccactagtatcaattagcgcctcttcggataagaggcaactaaggaggaggctgttgcaaggatgctggcctatttgagaggaaagcttgtgaggaggtggacaagcatggtggtggtcataaggaggctaaccatctgttgaagaggaggtagccatgaggtggtcgatcgatgagctagcgactcttcaagaggctagccgacatggacgaccagtggatttgaggtggagctccccccagaggatgttaactggaggtgtggtggtaattacatgttagtgattgttggttggtggttgatttggaggatgatggagctagggcgtcttggcaaaggtaaggccgatgctaggcgaaagcctcatccagtgaccacaatctcctttggggtgttctcgtggtggctacaatctctttcccggtgagatgctctaggtaataatcattcccaatagttctttgggtgggcaacgatggctctttggtgtcacggctttattggaggcctagtccttggagaactgtctccgccttttcatttttagacagttggtcctcaccttctttggtgttcattgtatgtcatgatagcgatggatctgtctgagagacgagagaatctttcttcactctcaccctttacccccgcaaccctaatctgttgtgactatcaggagtccccgctcgaatttggtaactagttggctggtgaggtcaacactaggtaggcagttttgtggcactcctggctgatttgattgataatgggcctattagagagaagagtggatccttcttctttctcatcctctccctctgcatctccaagccgggatgggaattgggagcccatatgtgtttttttgagcggtttggctttgttggggttgtgggcttgtgggcttgttagaggcctagcagcggccacctagtggcgcacggtttggtgctaggttcttccttaagggtgtgtactggtgtcgtctgcacacatggttgtcttgtgggcatggttgctcagcaagcggacctctgttagactttttctgctataaaatatagaaactccacgtgctattcgttagaaaaatgatgctagcgcagtgcgctaccagtgacacctttctttccaaaagaagaggagtgttcttttcctcacatgaatgtgtcttgctaaaaaaagatgcgcacatacactttcattaggccatcaccaatgcgtagcctcgggtcatcccctcgccgacggacgtccggctccgtttgccgtccccccacgagagagcgcgtccctcagctgggagacgcgtcccttggtcacttttggcttagggatgacatggagcgatgcgttgggggtgacgggctcctgtggacaccgtagctccaccaccaaattctcctttcacccctctcccctctctctctctccggttcccctcgaggtcgagccggaggaggcggcggctgccgcggtggaggcgtggcggtgacgccggaggcggagaggacgaggatggaggtggggcgaagagggagagagaggcggtggcgcaccagatctggcgacgatccgcaacatcaacgggcggagggagccacgccgtcctccccagcctcctccgctggtcggagtcggagcgtcgtgccgtcctcctccgccggcgccgtgcccgacaccgccggcccctcgcccgcatccgccggtgccgcgatgagggagagacgccttgagccggagacgggagagagagagagggtgagaggcatggagccggcgacgggaggccggagtcgtcgagccgacggaggcatcgtgttagtgatatgccctagaggcaattatagagatgattgtatcacatactatgtttacatatttatccgacattgttccttgaaatagataactccttattggttaatgaatatgtgattctttcatgagactctttatgttgtttattactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatatgtagtagcttacttagggactgctaaatgctactccgtaaatgggtagctataaaagtagtttttgggtatgctatgaaacatgtagtgggatatgaataatcaagatgggatttgcccctcctatggagagatatctctgggcccccacgatgttgtagattatggaagtgcttggccatgccaaaggtgattgaggagtcaatcacaagttactatcaacaggttcgagtgaatgattgaactattagaggatggcacatatctagccttgagcttaatcgatattgtgaagcaaaggggttcatacaagtatacactagaggttcagccgatatgatctttatgtatgcccggtgggtcaatacgttctgctaagggccgctgttgacgcattgaccgaaaaggagttttcgtgttacagccgagtatatatgaacctacagggtcgcacgcttaatgggccggaacatggggattggatagagatccaatatgagcttaattcggatatggatccgaataggagtcctacgggccttggaggcaagagtgatagatcctatatattcgtgaggggcgtgaccagcggaggcattgtatcacgtgagaaaccctagctaccacttccctccccgagcaaaaccatagccgcgcgcgggtgctagcacatctgcgcgtggcgttcagtccttgtatgtgtggataccggtggaggtgccgttggtttgcggtgctgatcggcgtgggagtacggcgaggagaacgcatgaggaggagaaggtcgagccggtgcgatcgactacttcctctacatcgacgcgcgctactttgcgagagttccttcgacttctcagcgtcttcttttgctgcacagcgcgtcgagtggtaacgatctatgatctaatacttgcatggttcctagtttacgcaatagaaaattttgatttatgctatcgtagcctacgcgtatcccaaaagtggtatcagagccgccttgtatagtttatgatctagatcattgcatatagttagtatgcgggtgtagtagatgagatctattatgttgtatataagtttttaggtgatcggaacatgagatgaaccgatagacgcaagggttgatgagatcaatcggtatgtgtgttggtgacttcactgaaatgtttagtactcaccaaggccgagcgcgattgtgttcatcggatagtccgatgtccactggaaccgcacgccaatgagaaaaaacgaggcaataagattgactcagtttcggcataattcgattacgccgttaaagttttcacatagcgggactgccgtgtgcgttgtcccttagatttcgcttggggtttttatatctatcttactttattgctgttatatatttgatatgacataataggatagattccctcagaaaaattaagtgtaatgtatgctcttccaataattgcacctattacggttgtgatcataagtgataggtttgccatagcaaagtgtcactttttatcatgataaaataggatagatgtcggatatctatatgcggagattattggtttacttgacaaggttatcaaaacagttttggaccttggggcataggttgggttggacatggagatgtcaccccaacagcacaagagtcacgtatgatgtgattagcaaggtgttgcttacctattttgatagttgtctagctgtgataccaaagctcactagacactaataaaatgaggatcttggctcactatgttattagagggaattttgtttcacaatacatagtgggagtatcttttgttaaattgtttaatgaaaggttaaatgtaaacatggtgctgattttgcatacatatatttctattgtagatcatggcagctcctgcaccatccaattttaacttgcggtctattcttgagaaagagaagttcactggaacaaacttcatggattggtatcgcaacctgagaattgttctcaggcaagagcacaaagagtttgtgcttacagagtcttttccagctaacttgcccaacaatgctcctgctgctcaacgtagggagcatgaaaagcgatgcaatgattatcttgatataagccgtctcattcttgctactatgtcccctgagcttcaaaggcaatatgaggcattggatgctcatacgataatcacgggactacgtaacatgtttgagggccaagcaagagctgagaggtttaatatctcaaagtccttgtttgcgtgcaggctagtagaaggtaatccagtgagcccacatgtgatcaaaatgattggttacaccgagagtctggataagcttggctttccccttagccgagagttggctactgatttgattctccaatcgctccctcctagctttgagccgttcataatgaatttcaacatgaacaacctgaatagggccttggtagaattgcctgggatgctaaagactgccgaggaaagcattaagaaaaactccaaccatgtgatggttatgcataagcgcaagcccaacaacaagaaaagtggtcaaaagagaaagctaaactctgatgagatcacgagtactagcaattctaagaccaaggttcaaaagacagggcccgctaaggatgcagagtgcttcttttgcaaggagacaggtcattggaagagaaactgtaagaaatacgtagagcagctcaagcagaagcagcaagatggaaagaattccacctcaggtattaatgttctagaaattaatcttgctacttcctctactgattcttgggtatttgataccgggttagttgctcacatatgcaaatcgttgtaggggctgaaaagaagtaggagcttagcaagaggcgaagtggacattcgtgtgggcaatggagcaagagttgctgctgttgcggtcggcactatgccattatctttaccgttaggattagttttggagttaaataattgttattgcattccagctttgtgtaagaacgttatctctgtttcttgtttgcaagcagagggttatggttttagatctgtggacaatggttgtccagtctattataatgacattttctacttccatgcacccatgatgaatggcttatacattgtgaatcttgatggatattcagtctatgacattaatgcaaaaaggcaacgtcctaatgatttgaatcccacttttatttggcattgttgcttgggtcatataaatgagaaacgcatggagaagcttcatagagatggacttctacactcttttgattttgaatcatttgagacatgcgaatcttgtttacttggcaaaatgacaaaggcacctttcacgggtcaaagtgaaagggcaagtgaactattgggactaatacatactgatgtatgtggaccaatgagctcaactgacagaggtggttttgggtactttattacctttatcgatgactttagtagatatggttatgtctacttaatgaggcataagtctgagtcttttgaaaagttcaaggaatttcagaatgaggtacaaaatcatttgggcaagacaatcaagtatctacgatctgatcgtggtggagagtacttgagcctagaatttggcaatcatctaaaggaatgtggaattgttccacaactcactccgccaggaatgcctcagtggaatggggtgtctgaacggaggaatcgtacattgttggacatggtgcgatcaatgatgagccaaactgatctgccgctaagcttttggggttacgctctagagacagctgcattcacactaagcagggttccatcaaaatcagtggataagacaccatatgagatatggactgggaagcgtcccagtttgtctttcctaaagatttggggctgtgaggtctatgtaaaacgtttgcaatcggacaaactcacacctaaatcagataaatgcttctttgtggggtatcctaaggaaacgaaaggatattatttttataatcaggaagagggcaaagtgtttgtcgcccgacacggtgttttcttggaaaaagagtttatttcaagaaaggatagtgggagcatggtgcgacttgaagaaattcaggaaacaccgaaaaacgcttcaacgtccacataaccataagctgagcaagatgttgttcaacaggttgaacaagttgttgttgaaccagttgtggaagcaccggcttcatgaaggtccgataggatacggcgtacacctgcgaggtatgcgttgttaactacaggacaacgtgatatattgttgttagacaatgatgaacctactacctttgaggaagcaatggtgggaccagactctgagaaatggtttggagccatgaaatccgaaatagaatccatgcatgtcaatcaagtttggaacttggttgatccacctgatggtgtaaaagccattgagtgcaaatgggtctttaagaaaaagacagatgtagatggaaatgttcacatctacaaggcacggttggtggcgaaaggtttcatctacaaggcacggttggtggcgaaaggtttcagacaaattcaaggtgttgattatgatgaaactttctcgccagtcgccatgctaaaatctattcggattgttttagcgattgctgcctatttcgattatgagatatggcaaatggatgtcaaaacagctttccttaatggaaatcccgatgaggatgtgtacatgacacaacccaagggttttgttgatccacaatcagctaaaaagatatgcaaattgcagaaatccatttatgggttgaagcaagcatctcggagttggaatattcgttttgacgaagtactcaaggcgttgggctttgtcaaaaacgaagaagagccttgtgtatacaagaagattagtgggagcgcactggtatttctaatcctatatgtagatgacatattattgattgggaacgatattcctatgcttgaatccgttaagacatcattgaaaaacagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcatgtatgctatgctatgtacacgtccagatgtttcatatgcacttagtgcaacaagccaataccaattagatccaggtgagagtcactggatagttgtaaagaatatcctgaagtacttgagaagaactaaggatatgttcctagtctatggaggactggaagagctcgttgtaaatggttacactgacgcacgcttccaaaccgacaaagatgattttagatcgcagtctggatttatgttctgcctgaatggaggcgctgtgagttggaagagttccaaacaagatacagtggctgattctacaacagaagcctaatacattgccgcttctgaagcagcaaaggaggctgtttggataaagaaatttgtttctcaactaggtgtgatgactagtgcttctagccctatggacctttattgcgataatagtggtgccattgcgcaagccaaggagcctagatcgcatcaaaagtccaaacacattttacggcggtatcacctcattcgcgagatagtgggtagaggagatgtgaagatatgcaaaatacatacggatttgaatgttgcagatctgttaacaaagccactccctcagcctaagcatgaggcacacactagggcaatgggtataagatacgtttatgattgactctagtgcaagtgggagactattagtgatatgccctagagacaatcatagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgataatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatacttagacctgagattatcatggttctcaacatgtgtagcagcttacttagggactgctaaacgctactccgtaaatggatagctataaaagtagttttcaggtatgctatgaaacatgtagtgggatatgaataatcaagatgggatttgctcctcctatggagagatatctctaggcccctcgatgttgtagattatgaaagtgcatggccatgccaaaggtgattgaggagtcaatcacaagttatataatctatcaacaggttcgagtgaatgattgagctattaaaggatggcacatatctagccttgagcttaatcgatatcgtgaggcaaaggggttcatacaagtatacactagaggttcagccgatatgatctttatgtatgcccggtgggtcaatacgttctgctaagggccgctattgacgcgtggactgaaaaggagttttcgggttacagccgagtatatatgaacctacagggtcgcacgcttaataggtcggaataaggggattggatagagatccaatatgagcttaattcggatagtgatccgaataggagtcctacgggtcttggaggcccgagtgatggatcctatatattcgtgaggggcgtgaccggcagaggcattgtatcacgtgagaaaccctagccgccacttccctccccgagcaaaaccctagccacgcgcgggtgctagcacatctgcgcgtggcgttccgtccctgtacgtgtggataccggtagaggcgccgttggtttgcggtgctgatcggcatgggagtacggcgaggagaacgcatgaggaggagaaggtcgagcaggtgcgatcgactacttcctctacatcgacgcgcgctatttcgcgagagttccttcgacttctcagcgttttcttccgctgcacagcgcgtcgagtggtaacgatctatgatctaataattgcatggttcttggtttacgcgatagataattttgatttatgctatcgtagcctacgcgtatcccaacacgtcggtccagctcctcgcctcctcggtggatgccacacgcggtagatgggagggagtaaatgaggggaagagagagaggggggagaagagaggggtagtatagtaaaatgtgcttttttggtagggatactcattgggctactaggggtatcctacattgtgacttgtgaggggagtttcctagagagtactctcagttagtgagggcacccatagagtatccctgattggtgatgcccttagtactaagcagagcccatgttatttaaaaaacaagtaccgtatccccactctcccatgtatataagtaccgcatcctctctctcatatgtactccatccgtttcacaatgtaaatcattctagcatttcccacattcatattgatgttaagggtatccataatgtagtaaagaagtgggtattagggattaaaatattcttactactaggtaagatacattgtggaaatagtaaatagctactaccaagccataagcttactattaggttatagcactttgtggtgggtcctacctattttttaattgtggcatggctcatgtttggggttatttttcagatgggtcccaccttattacccactctacacatatatacattgtggtgcatcttcaatctactattaccatcttacataggcccaccttactacctacttttgcaacatacattgaggatgccctaatgaatctagatagatgctaaaatgacttatattgtgaaacagaggaagtatatcattttcaaaagaaggcaccatgcagttcataccccattgcactggtatttttttaataaaaccacttatattttttaaatcgtatgttattttaaagatttgtttaaaccattttactccactcaaaacatgtaaaaaaacaagtctaatattaaatatattttgaatagcaatatagttactttaaataccatcaagagttagtaccgtgaagagtacgatggctcaaacggaatctaaaaataatacatggtttaaaatatgttatatttggtacatctagatttattaatattaatattaatgtgggaaattttagaatgacttaaagtataaaagggagggagtattataaaagaacatgtctacttcaccgagagaaaaaaacaacacgagaaaaacctggcgagcacaccaccaccgcatcaccggtccaccgctcttgccttcccctttcttgcagtgcaggaaagaaccccacgccctcatccaatcccagccgtccatccaccatccaacgtctctcaccgcgccgctcacctcctcaagaccaccacccaccactcccctcctctctcctctccattcctcctcgcttcgacaaacaaaaccccccaaaaccctagcctccgccgcccgccgccgccgccgccgcgcaacccccgagctcgagcggcgcgatgaacatcaagggcggaggccgggtcccggtgcccccggccggcgcgggcacgctcgtcaagctggtggtgctcggcggcacggccgtgtacgccgccgtcaacagcctctacaacgtcgagggtggccaccgcgccatcgtcttcaaccgcatccagggaatcaaggacaaggtaaccggacacgcccatccccccgccccttccctgttccatttcgttacttggatgtgccgcgtggtttggttgcggcgttaacgattcggtcgtttaggggagagattggttggaaataaatatttggtctcgcgcgctatcttatgttaggttgcagggtaaattgtgttttgaagcaaatctatttgggtttataggtgctatctggtaaatctgaactaaccaggtggtcttcatgatgtgtgagatacctgcctatctttagataacttgtttagctgcagcgatttatcaggctgaaaacatgacaagtgttccctttcttgtgggtgatatcatttgttgaggtttgaggattaaaaaggtcaaccattgcgtgtgctggaactgattccaagttcttggtaaaaaatccaatttgtagtatgattgactgctgattccagtaccttatgccttgaaaagagaattacctctgaaacaacacgatcgctctgtaccaatgtgtgtggtttccagtctggcttgcactgaggttatgaaattttcctgcgctagatacctgtaattggttctagaaagcagctgctttgtcttatttattggcctgcggcaggtccacgagtaccatgccgtggtgtagttcagaacagatagtcacatgatgtttctaccttcattttttatgttgtttgttgaaatgatctgaatgtggtaaacacttattgaaattaaattgtaaatgaacacgactacttttgttttatcattccttaaaaaccatttgaaaatatggtaacattcatcacagtccagtcgatttaatgcacacgagaccactgctggttggaagatggtgccaagatcaactgaaaaccattgacttctttcagtgtttgccgcattgtggtttttttataccaaatttaccatggacaagtgcaatcgcattatttgattttagtctggaagtctggctgtgaccattatatatggctcgccatcagtacaatcagggcatattgaagttgtttgtgttcacaaaaacacacattcttttctgtactcacaatgaactgcacatttagttctgtcacacatgcacctttttcttgtaatttctttaaatgtggttcatgggagtaacgcatttccttttaaaatatgtatctttattttatcactatgtggtttcttatgctctttctttctctcttttttccttttcaaaaagtaataaaatgtattgttattaatggcattcaattgtggttctctgtttcataatgcaacttaaatagcattaaatttgttagatttgttgaaaatatctgttatcatatatcttctgctctaactatcttaatcgaccttagatggccggttcctagcaatctactcaggaacagcctagataacgacagaggctgctttcaccttcttgcccataggttacttcgcccaaaccgacgacacttctccccacctttttgagcagctttgatacaggatatggcgactctttattgcgagtatagcatgactatgaacctgacatgcacacacaggtgcaaacaaatcataacaaggagtagtgtcttttacattctggctccttgcattattttggactaaaagtaaatttagggttgttttgtttgctgtgccatccttccgtcgccagctgtagatggaccccagacatctaatgccccctttgatatcttcctcgcccaaatgtgtcatgcctgagttagtctcctagattccttcttgacatatgatctcctgttcctttaaaaataacatgtccatatttcttgcctagaaaagtaggtttcaaatggaaacggagttacgtatgtatatagcatgcatgacttggtttcctttatatccccatagcttgatctttgtagttaccaaggcaggtgttgatgccgagaatagctctaatgtagtgtctgtccgctccgtgaagcgggaccaaatttgcagccccacacgaccagatcgtcattgggtgcaaactctgtcacttttggtaccaccaagcggcaccatctatcaggtgttctgttgctgccagtcctgtttttcaattttggctgcttgctgaagaatcgctcaaagcaattgaactaaggttgtgggtcttccttgctgttttaaatgtcataaaccctagatgataaaattgtgaagctaaagcttgcttgcaaacagaattaccgaaccctgcagcaaaccatagatggcagagcagctattagctcagatagcaagttgtcatgaaccgaaatcatgatgaggccaatgtcagctgggaggattgctgaatggtgcaggctgctactgatgagttgagggcttagactgggatcatgaacattaggggaaagattaacagtttaattttcttcattgaatcctctccggtagaccagctcattgcctcttatagggccagctcctaacagtgtaatctaactaatttaaattgattttatcagctaattaaaaggaacaacctagataactatggctgctgctgctgatcttcttggtccatgcccatggtaaccaatattatgtttttatcttttaagatataatttgtgattgtgagttatttccttgctgttcttgattttcgaatgagatttgttgtgtgcatgctatttattaaaaaagaggcatggaatcagattttacttcaaaaaaagagaccacatgtttgcatgttacgtccacctctcactgtttactgtgtttggttagtcattccaaagtgagctttagaatttccttattttatttcctaaataggatggtagtatttatctaaagttgtgttaacaatgcttgtatagctagatgctctattctttcattgttagtgctggagcattaaatgttttatgcttgtttaaagtgtattatgaaatatgcaagaagcttgcctatgtcttcatcattataattattgatcttatttagtataaaaaagagctgttgtgagtcctccctttcctgtgcatcagagctttgcgtggatctttcgcactaggtaaacctgtattcttattgtgtaaagtagttctcaaggttttgttgctatcatgtgaactaagttttggtgccctttccttgtgctgcgcttaatacttcagttcaatccaccttaacatagctggatgactaatatatatttaacatgtactacctacaggtataccctgaggggactcactttatgattccatggtttgagaggccaatcatttatgatgtccgtgctcgtcccaatcttgtggagagtacttctggaagcagggatctccagatggtacgtttgcatctttttaattctatattttcatcgttggaatgtgtgtatacttctcatctaatgatagatatacttgatttgatttgcatgctctattttcattgtcattgcacaatcaagttaaattgaatttaaagccaaaatatgtgctgcttagtgcttacatggtttcattgttgatgatgatgaatcatcacatcctacattgaatctttgcatacattaaagtattgtgtcattcataatcattaacatctttgactgttagtttgtttcagaagctattaccacattttgcaactaaccaaccttttgctgatggttactagggttctatagccttttgctatatttttttgtctgtttttttgcatgtttgttttcatagctatttaggttatgatattaagtttggagcatacctaaagtggtgtgattactcagagttcattttggctcatggattttagtaaattaattattggaggcaaatgttaattggtcattctgttattgtttatagataggtacgtttaggggtaaaccttttttgtgggctaacaaccagacagtccttttttacttatggctatattccaaattctttcctactttatgatagcatgttactccttgtaaagatatttgattgtggacttatttggtgattaaaactgttctactaaacatgccaggcatatgtggtcaggttttagaaaaaaaattgaactagtgagtagtgagccaattagaagggatgtgccaaattttggaaataaacacagtcgaagaaaatatgcaatttcggaaataaacgcagtcgatgttttagtttatggttgtgccatgtgcttttatgcttggagttccatttgctgaacataaaacccttcttcatattttttatgcatctattgtactctatttttggcaggtaccctttatattttttatgcatgtattgtactctattttgggcaggtgaaaattggtctccgtgtccttacaaggcccatgccagagaagctaccaactatctacaggactctgggggagaacttcaatgagagagttttgccttcaattatccatgaaacacttaaagctgttgtcgcacaatacaatgcgagtcagctaatcacacagagagaggttaagacctgaacatatgctttttatagtctttttttcttatatttgatgggggtcaacattacttgggggcgctaactgtttgtttcactctccaaatccagaccgtgagtagggagataagaaagatactgactgagagggccaggaattttaatattgcccttgatgatgtgtccatcacaagcctgagcttcggaaaggagttcactcatgctattgaagccaaacaggttgctgcacaagaagctgagcgtgctaagttcattgttgagaaagctgagcaagacaagaggagtgcgattatcagggcacaggtaagaaatctgttttatagccattgcctgatgtcatgtgccggagatacagtttgacagtacatattatataatggttttgccattgcatgtctagttaacattgtctcttaaacatggcctttctcttctttcaacagggtgaagctaaaagtgctgagctgattggtcaagccattgcaaacaaccctgctttccttgccctcaggcagatcgaagctgccagggagatctctcatacgatgtcatcttcagctaacaaggtgttcctggactccaatgatctcttgctcaatctccagcagctcaccgtggcaaacaagtcgaagaaatgaagtcattctcgcaccatgttctaggttattagcagatgtcagtctaccagacaatgtgaggaacacttggtcctctctgtagttgcactagtgatcatctgtgatacagaactcgacgagtgactcaacttttggcaaccggcaatctttttgcaaattgcagctaaactttgcaggctacattttgactctgctagtccttgaggaagttcaataaggaataccattctgttttaaggttctcaatctgtgattgcgatgatggattaagaaactgttagatctattgatcaatctggtaggtcccctactggtatgtttatctgatatcatgctgaatgtgtaattttcagcaacattacaggaaatatgccgttgaagaatctaaattagtacactgattaacagatcgtcgatatgtccgagtggagacagactcgaaatctgttgggatttgcctgcgcaggttcgaatcctgctgtcgacgttttttgcttaagttcttttttggctacgacttgacagatgatactccatattcgtttattggaaaaaccagaaagaagttgaaccagaaacattttttaagagaaaatattaataattttggctctttgagccttacattcgatcaaaactatcacgccacaggaaaatgaaggatctacaagatgtggtagttttaattttgtgaaaaaaaaagtaacttctatgctaacgcatatattgagtctccttactattactccctccgtcccaaaatagaaatatttttagcacatgttaagtcaaatagttttaattttgactattaataaaaaaataataaaaaagatcaatcatgttttgtgatgattttggggataattttgtgatgcaaatttgtgggtgatttttagatgtttttgtgaatatgtggatgattttggtgatgtaaatttgtggatgatttttagatgtttctatgaagttgcagatgagtatgtgatatcaatttgttgatgattttatctgtgtggatgattttgttgttgagttcggtgtgaaatcaatatgaaagtagcaaaaaaaaaagagaaaagaaaagagaaagcatcacgtggcgcttttatttttactcccgcttggtgactcaaaccaaatatcgctacctttagtcctggattctctctctcgatttgcaacctgggactaaaaagggttgcgaacggagagatgtggggtactctggtagtgatcctatataattggtacccactaaggggcatttatactcctataaagtaaaacatgcaagaagccacatcatcaataattttaagccatcagatcatattagtacaaagataacaaccgttggatcaaaaagctacttattcatccaattcaatcatttattagcaatccattcacctcaatttgctccacctcatagtcacacatagcattgttacatattttgtgtataacaccatgttttccgaatataattcaaattattgtttaacacgtgattattatttaatatgtgtgttttattttattatgcatgataagatggcatataattattaggtatcgttaactgaatacattttcagaaaaagacgagtgaagtagaggtatgcaaactgtctaactacaacgatacacatattgcgcatgaaagtaatattcatatattataacaatacacaatgacacttggaaaaataaagcatgaatttattgtaataatataaggcatatataaatccatattatcgtatattttgtatataaatagagttgcacctaaccatttaaaactatgattttgtttgatcataaaattacaaaacccgcgacaaagatgtggggtgccaactagtaagttcaatgacagactcctagcagaaagatccgctcatcctcgcgcgaacctagaacagaaaccgagagaacgccgaaggccaaactaggaagaaggaagggaaggcgagggaacatgacctcctaggtgacgcctccaagaaggttgcaacgtcaaaggtgccaccgtcgcctgctcatattggactaggttttcacctaaaaagtcatgtcggggagggaggatggcagctcaacaatgcccacaagagggagcacggcatcaagaggcgttgtcattctcggcccaaaaatcgagctaggcttttgccaactgtatcatctccctccgaaccatcgacatcccaaagctctgccacccgaacgacctcctccatcacgtgggctcgtcgcaccagagcccctccgctggccaacacccctgtcacagccccagctcgtgccacacactacctcgctccgctagcgcctccacactgggctcacctcacacaccgcaacagtctcctgctgtcactgaccgcattttcgcacgctgcatcagattccgcactacaagccgcgcctccacgcgtcacaccagtctatcgctgtcgccgaccaccggatctggccagagggtaccagatttggcgcccactgctgccgctaccgcctcgacattgccgccgtcactgcaatcccaccgcatgacatcgctgccccgccgcctatcaccacctccgctcggctctagatacagcgatgtccatcgtggatccggtcgggtttggcgcgtgggtggctctccgtcgccgccgttgtcgcctcccgtgccccacctttgtactctgcctcccgtaccccgccaccgccggcccgaccacgcttgcaccaccttttcctgcatgccaacctcaacgtcggcatccctccggccatcctcaacctttgagtctgccacgccggatctgtggaggccgccgccaacctcacaagtcgccggctttggtggccacttgctctggcggctgcgtctagggtttccacccgagtcgcccgacgcgggcagtgacgcggacgtgggagtatagtgttcttggtctattttcacgatgatacctaggagaggccggatggagaggacaaaaggtgggtgaggtaggatgcttgtagtccggggatggggtccttgacctggaccacgttatccacacgatttccagtgtgccaatgtatcggcccatttggtacgtgatatacatcggcttttacaattaatatataaataataaagcattagatgctgccaaatactcacgaactaatattaaacatgcatggttacacagaattatggagccccgttgattatcctaataaaccaaagctgttgacggtcgttatacaccaaattcgactgtcaatataactaaaataaagaaaaactagctatgcttgcaatgcatatttatttaagaataatatagttccacttgtacctagagtattatttgtctgcagagattaatacataaatggagaagaaatgagaacacttcactcctaagcaagcttaaggataagatgggcccacatgtcaggtgtaaccatgccggaaaccgccataactgccacaactgtcatagggacccacctgacagtgacctgaccgaagctggaggcctgctgggccggcccaggttcggccgaactctgacagcggtagctcagctcggctctccagtgtacgctccagatgactccccaatgacggttgcggggcatttctgacaattccaaccgttttaaccatcattgcaaggctatataaagaggtcacttcattcattctccaacacactcaagcaagctcaagatctttccctatactttagttttgtgctctagtgctaagtggagtagaatagaatagctcttggagtcctcagagtcttcggaagagttcgagtatggctgtagtagcttttctttcttcttttgtatgactttcagaattactagtatattattctttatatactctcggtactttatttgtccgagtatcggctttattttatatctatgtcattatagttgtgtagctagcctaccagagaggtgcaatggtgtgggtttaatgtccgattattcggttgctctgtgtcattccaggggacatagagtagtagaggtggtgtgtagattattaagtatcattatctgagcatatatgctgcgggacagtagaggtggcccgttgatggtgacaactcagtatgggtattcctccacgtcagtatatattcctaagacatttttctggggagggtactcctccgtatttagccccgattggatggccatgacaggttgtcataagaaactcggtaacctagggtggtctctcgaaacaccaggagggcactgttaggggtagtggccacacaattgtatactagcagatgtaaactaaaatggagtgtatactagaagtatatgaattgattgcttttctatttcttcttccacatagcttaggattaattaataagaagatctgagttctttttgctttgtgtcactctacccttatgaatgtattaatccctgcttagactctaatcgtaccagtggtgtaaataaattattagcatagttctatattataaatctttctttgggattaaataaatatgataccttggaatacttctgggtaaaatgctacaatagtatatccgtgcgcttgcggatcccttatgtaatcatatatataccaggactatttctggcgtcattactgggaatttatatttctagtaacatcgttaagaaataccatcaagcatttctagcgccgttgccgggaaagattaataaagagattactataagctaataattttatatgcattacctctgtatagatcactgtcctttgttggctaaccttgattgttttcacccttaaggagttgcctccatgaattcaaaggaggaggtttatgatcaaagatgaaaccattcatttgcctccaaatattcctagtcccacaaagattttttttccatgaaacaatggctttgataacagtttcttgattgtaccatcatgttatccaagctcagagatgtgtcccaggagatacctagaacatcatagcaagactttgcaaaggtacactgaaaaaaatagacgcaatagattctcaagatggtgaattggacaaagaacacaactaagatcacaatcaggtgggggcacaatgcttatggtccaacacatattttgtgttcaacctgtccatcaaaagtaaccaacaaaaaactttaacctttgaggtagccttactcttccatagccaaatttggccaaagaattgatgaagctgtccatgttctgtaatccaattcggccacctgttacagtgttgacttcaaacaaccgccaaatgtgcatacgagctctgttttcaactgatctatccccgtcgccaaattccatcttagtcatccgcagttgaagaaacaaggtgttgcatcatttgtaatgggcctatgagcttgtaattttgtctgggacctcggtccaactttcgccaatgtggggtgtgccccaatctgggggagcacgaacccaatggccctcttggttgtcctcccacctctttcaatagctagatacccctttagggtttcgcgggttttatttagattaaagtttagccattgcaacttttcctcgtgcttacgcgtgtcggttagaccgcctaattactcgtcttcggaagcccatcttatcgtgcattttaattcctatttgcaattcaaattgatttatcttgttcttgcttgtttctccgatttgcttgccggaataagattgatctgcaccggcaagatcaataacccacagagaggtgtatcgatcgctaagacacaacacaacaatatcttgtacgattatagttgggtcatcaacgtttctcccaaatgattgttatcatcaactcatcgaaagatcgggtcaatcgaagctgtgagcgtatcgagtggagctcaaggtttatcagagggtgtagttattttggttagtgctttagtcggcaaaaattccacaaacaaagcagaggagcaaccgtacattaggagatatggtctaccatgagcagcatgtctgtccagccaattacatatctcttttcctgccgtctagttggtggtgtgtgcttcactcatacattttgcacagtatttgcagccaaacaatactatctacagagcttaattgttcctttaaagtaatatgaactaatagttgatatagaaagtaagataaatataaatccataatgccgactgaaagatcttccgttggttcttttcaaaagaaagcaaaagaactttggttgatagatggttttcattgcacatgatcaaggccatatagatagttccacacttccacatacacttaccgacttctttttagaaagggttaagttgatttatgtcatttcagataaataccactactattcgtgtgttcgtaaccatgtcattgcaataactgcaaaattagatcataccattttatacgcataggattatcttttgaataatttttgctactgtatttttatatggaaaaaaaatacctaatctacatatgggatccagccgtaagtttcaccttcttcctccaatcctccacccaatccggcgccgaagctttctttgtgctgcacgaccccgtcgccgtcaacgccactgcacatgagggagccatggccacatttgagcggcatccctggtgatgagcctgtctagaccatggcggcggcctctccatgctcttcgacaagctagcagtgtcgcagccggcatccaaactcatggcaccgctgctacttgactcctgggttcatccaaactcatggcacagtgctgccaagccgtccaccgtgtccatcgcccagacgtccttgttcgccacgtggactataccatcccgaggccccatccctccagtgccgttgcctccacatctcggcttcctctcgttgccgatccaacccaagccggggcaaagctgctacacggacagtcagtccttgcacagcagtggcgacgggaggctagggttgatgcgtggtaatacgggtcagcccaaagttcgtcctccaggaacacatcggcgccagcagtggcaatggcatggagtgcacccgtggagcccgcgaccatgggcggtggggagccactgcggatcgaagaggtccatctccagttcacactccctatttcgtccatcgagcatccgaaaggggatgagtcaaatctttaatatgcaagggtaattttgaccatatgaaaataaagtacaaacaaaataagtcaaaccgggcttgtgatgtacagcatggcatggaaccaaattttttgtgtagtcaggtaacatggttatgaatagatgaatagtaatgtcatttatctgtaggatcgtaaatggtctttcccaccccaaaagctagccattgaggtgaggggatcgtaaatggccttttccaccccaaaaactagccattgaggtgaggggctccacggaacaggcccacggtccatcaggtatacggttcccgcaggcacccacggtccatcaggcaacctagcctggctctgataccaattgtaagatcgtaaagggcctttatcaccctaaaagctagccattgaggtgagggactcccctacttataacttaggtcctttacccttccacaactaatatggaactattcaacattatcaaaaatgacactattgtaatagcatggatcaaattaacccttttagaaatcactacacctaccattttgataacgcattgaacatttacctgtttcaccattaaataacaagaaattaaaccgtgattgatagactgcaccaaactagctttatatataccaatcttatcatattacacaaaccaaataacctttacatgaaccagctagaagggagaaaaaaaatcgttggagtaggagacatcaggaaaacatggaagacgtaattgtcaatgtaagcatcatccatggaccatgaaaccttgtgaacctataaattgatgaaaagaacccagattgggtgatgtccgctcgaattagagccccaatttatatactctgcttctagtagttccttgcataagcgtgttcaacatgataatccatcttttgtatcggtttacaaatcataggcttttgttctggccgttatattgagttggatgagaagttcatcatgtgaatgtagtattcatcagagatctggtttactgaacattgataaatgttttgtcaagtactaagatgacatatcaaataatatctcaattgaatattgcccaaatcataagagaaccaccaccttttatttgcaaatttacagtggcccccaacttcacgatcaccgttctgagacgtcatatgagatttaaaccacatttaatttaatttttggggtgcataattaaaggatcgctatgtaggaaacaattttttttataggtaacacaaaactttagtcatgacctcatccacattaatagctcttagctttgtcatccatgacctcatccacacaaagcatcattatcatacatagaacacaatagcattgcgactaacagaaacattaaaaactgaaataacagtagagggttataccctgtgaaagtccctccgctggattatgaggcagaactgcctccgttggtgttgtcgatcagtgcaccagctcccggtgcactagcttcggctccaactcccggcgcgctatctccaggtgcggcagacatgggtgatgcaaacgaccggtcaaagacaaacagaggacgaggagcagtcgtgcggaagcactccccaaaaacctaatcacccacctacccggtgcagatctcaggcgaaggtgtggttccgaaggccctgctcgttccgatctcttgtgcgcgcaagcgatcagaaccggggaagcagcagcagcacaggcagcgcgaggaggaggaagaaccagtgtttggaaagcaatgcaggagatctgatcgaggttctctctttccttatagcgcaggagagaaatccgcccgttgccgtagtaacgacacgatcaatggatattgaatcgcctgcccgttacagaggcaatcatgtggttggattccgatccgttgcaaaaggatagagagagagagtgagtcgcaatgcacgcatgcccgccacgcccacggcctcggcccgacctagcgtgcacgcgcgcgcgtgtggctttccgatccccacctcaaccggtcaacagggagcctccaataactctctatttaagttgagatactcctcttttaattcccatggtggtattattatccttaacatttattatgggcccttgagatttaatagaaaaatcgggcctcgcctatttattctaacaatccccaccaaatttcatggctcataagaaatgttgtcaaagttgtgcctgtttgatataccagtgttttggtggagactgttaagttgaaattccacctaggaaatgaactacgtcagaccacaactgaacaatggactatgccttaaattgtcagtcttgtgtgattaggttttactcaaacccttgactggtactaggctgccgtttgcaccccctctgtttggagcatataagtcaaactccaggccctttcatgagtatctagagatcgcccaaatctcatatactatgactagcagtcgaactcatataggtgtgttccttctgagatgttcttcaggtcaacatctctgcttagaaaagccacttggatcacattaaggtataagccatcctaccatgcagagtagaagagaagtacatcatgaaaatgagcccttttcaagggtctcttctctcagccacacaatagtttgtttcgccatccaaatttacgggatctccgatcacaatggacaggtttccactattatgcaaccttaagtgggtatcaagcacatttccctcgatgcactgtctatcacattacgtggtagccccttggtaaactgatctgccagatttttagccgtctggacatagtccaatgctatcactccggagtttttctactttctgacagatttcagtcttcttttgatatgcctagatgacttcatgttgtcctttgaactgttcactttaataatcactgtttgattatcacagttcattaggatagctggcactggtttttcaaccaccggcaaatccatcaggagttcacgaagccactcggcctcaactgtcgcagtatctagtgctgtaagttctgcttccattgttgacctcgttaagatggtctacttgcaagacttccaggaaacagcgccacctccaagtgtgtacacatatccacttgtggcttctatctcatcagcatcagatatccagtttgagtcactatacccctccagtacttttgggtacccggtatagtgaattccatagctcatagtgccctttagatagcgcattactctttccagagcctgccaatgatcatctcccgtattttgagacaaaccgactcagcttgcttacagcaaatgagatgtcaggcctcgttgtactagccaagtacatcaatgaaccaatgatttgggagtatctcagttgatcccttgctattcttcggtttttccttaatagcacgctgggatcataagaagtaggatctggcatgcagtcgctgtatccaaagcgactcagaaccttgtccacatagtgggattgcacaagtgtaatcccaccctcatctcctcttagtagcttaatgttaagaataacatcagcctctcccaaatctttcatttcaaaactcttagacagaaagtccttgaccccctcaatcacattgaggctggtcccaacgatcaatatgtcatcgacatataaacacaagatcacttcttctcccccaccatagcaatagtacacacatttgtc

SEQ ID NO: 73610 - DNA, 217656 bp, Oryza sativa
  unsure (1)..(217656): unsure at all n locations
atccgcatcatggcatcatagatagcaaaaccttcactctccattccaacctgacaattttcaaaataaaacgatgattagggggtgggtaaagggcttaatatctcaaacattggtagtttgacaggctaagtaaataatttaaccttgtcaaagcctttaaaccaccctaacccaagaggttaagattatgttaacccccccccccccccccccaaaaaaaaaaggtggaataagctaactgaccacaattgatcctcaagagtctgttgtactgctaagtgctactactaccccacctttaaaccaccctaacccaagaggttaagattatgttagcccatagaaaggtggcataagctaactgaccacaattagtcctcaagagttctatctgttgtactgctaagtgctactgctaccccatctaatctagccaaaacggtaattcaggttatccatgttaattgacaaacgtaatttttggaattaagcttagctaacttggttatcttatcccctaaatcaaagtcagtctaagaacaattcggcaattatgatgataattaatgacaaaaggctacttaatactatcaaaacggtagagaatagttgactgcgagccatgaaccgaacaagataagcatgcttactggttcaccatcatcacgagctgttcctgtggagttgatgtatatgtaaacaggttctttactattcatccactcaaggtacatcaactgcgcaacgacaagctctgtaactgctggcaccaactacatagcaagaaaaaacaatcttatgaggctataacagctgcatgaataaccgatttaatagatatttacaaaaaaaaaaagaggagaaaagacattggtagtccaagacatcttaaataatgcagagtatataagaaagaatttgttatgacaggcgtataccgggaatagaagtcatccaaccttgtattcaagaattaggtcaacaacaattatattttgttgctaatataaacaatttttaacaccactgaaatgcaaaatgtcagtagccagtccctagtagtttcaacttttgatagctcaggatctaacattctcatgaaattgcttatccacgttggttgacctcaccaacattcttgtcatcatgttttacatccacatatgtaaatagtaagacttgaagaaaatatttcacatagagaacatggtgcaattcataccggcatgccaatgtaaacaattcggccatgaagaagcaatgatggcaagtcagggggaggccttctaggcctgtgctggctgtaagaactgctagatcgttccacctgccacagattataggtaatgaagtattaagtgaagcaacgttcagtatgaaaataaaggtgttctctgcacatacagatgattaagctgggtgcattacagttcaaatcagcagttcattgatcgaaatcttaacacaataggtatcaccatgtataagcgtgtaacattccaatcccaggtaatcttaatgtattgcttgaggagcgattgaggttgtattttacatgttactagttgagaatcttttagaattagtaataaatgctccctctgtttcatattactagtataatgcccatgcgttgcaatgatttttttctaattgtctaatatattatcattgtgctaattttactgccatttcacagagatggaaaatttcacaatattctatcgttacattttcctttcgacggggtctatggtatgtagggctgtcaaaaaagctctaggctcgcgagctgctcgagctcggctcgagctccagacgagccgagcccgagcctctccctaagctcgcgagctttgtcgagccgagctcgagcttccaacgagcctagttatatatgatttttgttgttatttaataaattaggagatcaaatatgttttgtatgtcttatattgacatcatatatttattttattcttttttactcttctactaatatgatgaactagaaattgattatttttttaaagattatctttgaaatatatattgtcttacttaaaaatcaagctcggtagtcgagctcgagccgagcctgtcagaaagctcgaacattttataggctcggctcgagcttgtatcgagctcgagcctaggcagacgagctcgctcgagctcggctcgttgacagccctaatggtatgtgggagctaggaaacaagaaaagtttttatctcacggttcatgagtcccgcatggtagttgggtgatggtaatgacaaagtcaccactaccaccactaccatcttttatattagtacagataaatcgctttgattttttttagtcaaatttcttgaaagtttgaccaagtttatagaaaaatagagcaacacttatagtaccaaattagtttcattacatctaacattgaacatattttgatagtttatttgttttgtgttgaaaatattattatatttttctatcaacttgatcaaatataaagaagtttgacttaaaaaaagtcaaaacgacttataatatgaaacggaggtagtaccaacctatgataggtgatgttgagcgctatgcactactttgatttgtgctggactatggatgattatagtcattctcaacctctcatgtttcggctaactcgcggaacgctatgttgctattgctatggactacggcatcagcatctcatgtttcggctaactctttcgcaggaaaatcacgggaaacccctcccccccaatcacctgcgcgggcgaggccatgagcttggcgttctggaagatctcgaggaacggcaggtggtcgtcgccgcggcgcccgccacctgccgccgcagcctggagctcctccggcgaggcggcggcgagggtggacaggaacgggtcggccctcgggttgaagagcgggttcgggctcccccccgacgccgcccgcgccaccagcgcggaggacgccgccgcgccaccccgcgcctggcggagcaaggtcggaggcagggagaggaacgaggaggaggccccggaggaaggtgcagtggagggcgtggggaggcggagcgacagggaggcggacgccatggcggcgggcggagctcggcggcggcagccgtgcgagctcgagctcggggtgtgggaggtgaagattggataattttggtcggggatttgggagaggagtgatttgagtggtgcagtttgttcgtcgtgggctttggatgtgggctcactgcgtaatgggccgtaggaaacggagatgggttattttgggccttacgggatactgacatgtgggtcccaatcgtcaatgggatggggacagcttttctcgcgaacgtgcaaaagaattgcacgtcaatatattagaagaaaagagttatagttgcacgatgcaatcagccaaaccggcttatgcaaagggaagggggaaaaaagcaaaaaagaaactggagcttaaaaaactacggcggctaaaaacaaactccaaatagcgggaaggggccgagccactctatactcccaacaagtctccaaaagcggcaatgccagctaaagaccacagatggccctctgagtggatggactccagaaccactgagatcgaagagagtgcatagtcgaaaaccctagagttttgttccttccacagctgccaagagaccaagagcaccagggatggggacaacttgcaacgggagatggagggctttctcaaacggaactagtttctctccgaatcagaaggctttcttaatcaatttagtttttcgtctagatactaagaaattgtagtcgtagaatccagaaaatggacaaaaaaatcacaagttgggaaacctaacttttttagattctcataatttgacttgataccaacagcttcttataatttcaagtttcccaaacaagcccgagtctcttgcgctttcgggcataagcaatgtgccaatgtatattgctcaactagtcattataggtggaaccatgagaagtgatcattagctattttcatttctcacaatggttaagtttagaagtgagttgtaaggtgggcccagataaataataaaggagtatattaaacaagattcctattttgtaggtgcgcgctatgaaataaaatcgtgaacagttttggcccagcttcactacggcgaaggctttaggtctagtagatccatgtggataacccattcctcattttcttttctttttttccagtacacattatcctcttaaatagatctattccacacctatcgctctgcttcacctcctcctaatgctcccacttctagttcgccattacttctcccaacctctatccaacctcgacgtgccacttttccttgccttcatctaacatcaacagcattggcaaagtccgctgctcctaattaactccctcttcctcttcctctccccccaagacaccaacgaggttaggatcaccttctcgcctcctcgatgtgctactccatcaatcgatgctctgctcgaatgagaagccggcgaactcaagacatcagcttacccttcttcatcctccacgtcctcaacaagacatcgacctcctcttcttccccttcctttggcgagtctcttgctactgacaagtttccaggttttgcgatttttggttgaaagttttaggtcttgaattgaaagttttcccatttgagttgaaagtttttcaattcaagttgaaagtttctaattcgagttgaaagtttttcaattcaagttaaaagtttcgtgttttgagttgaaagttttctaatttgagtcagaagtttcaatccataaatagaaagattaaatattctaaattttttattgttcttagttgaaagtttctttttttttaatttgaaagttttacaatctgatttgaagttttaaccatgaaccatggatagaaaacgctactccaatccactcgtcacggtagggggcttaatatctaagtcgaaattgaggggagcacgactttgattcctgacgtgtgcgcgcgtattaataacccctatattaaatatctcatatgcatagaaaaagagagtgtgaggagagaagagaaagattgtattgttgttttgttatattgttgttttgttccttatggctacccaaatgcatatggatagctcaagccatgtaccactgtaaagataatacacgatgtataagtagactatactaggcttatgacctctcccattctattggacacatatgcgttacaaatgattttttattcagtttaatggaaggatttagaccaatggattattcgtttttcctagtatggcctttttcttttttagaaatcggtatttcagggttgacggtttgtacggaaggaaagatgtttttacatggaggtggagtagtagagaaaatacggtataaatacatgcgctcacactcatttttatgagtgctcacacgctctcctcccctataaacatctttaaaagaatgtaccaacatatcttgacgtcttgaggttgacgaagttatcacaaatatctcgctgtcgactaatacatagcctaaaaaaagctataatttggagggataaattccaccgcaagttgtgctcggggaaaaaaaaattgcgttcgcaaattcctgccacatcctgattcctgccaatcaacttgctgggtttccattggaggggtgagaagcttcgtgtggtttttggtttggttgcgacgttgggtcaatcctattacagtttgtacctccccaggagattgaattgtcggcgcgattactcctctcaatacttctctctcttttttatttttccccgcgaagcaagctccttccgcgttccagttcaacaatgttttcatcagcacagaatcgagctatgcatgcagcaggaaatgcttgtctccgatcaatcgaagcatccattactttggtagctagctagattaccctcgtcaacatgacgatgcaagatgagtattgcaagtgcaatgtgcaaccacatgtcatgggaaaatgacaataacagcatagtagtagtaattgaacgcgctgtaaattaaatcaagcaggataaaaaaaaccctctcaagatcatggacatcgagacaggcagagtgaccagatggtccagattagaacaagagctcaggtggctacaggagatcaggttttatatcatctatcataatagcaccaccattataaacactaacagatagagtaataaaatggtgaggtccacatacgaataactgtatagtgacattgtggtagaggatcccctcggagatcggcgacaactaacaagggcaaagaaggagtggaggagtggcacacgagctgcatgcgcgtgcagtgcaccggcgagctggctagctagtcgcggcactgggtgatggcggagcagccgcgggtgtaggggttggcgtcggcgcccggccggcagttgtagtaggacgcgccggggatggaacacggcaccgagttcctcatcagcgccgcgtagctgatgtactgcgccgccgccgccgccccggcccagccgccgccgtagtcgtccatcagctggaacagccgccgccgccgctgccaccgcctcagcccgacgacgccgacctccccgtcggccacgcattcctcctccaccgtgccctccaggcacggcgccgcccgcatcccccagtgggcgacgagcgcctcggcggtggcggccgtcgcagggacgacgacgagcgccgccgcggcggcggctacgaggaggacgaacggcggcgcgcgccgtgccatggcggacgtcggcaacggaggccctctgtgccttgcgatgcgcgcggtggtcgccggcaggtgtggagactggagagtggccgtagcagctgaccaggggcattatatacaggcagcacagagattctggagactactaggcttcgaattctgtgcaaattacgtgataatgacacgaaaagttgaccttgtttaaatttgacaagcgacgactgtttgaatttggctgaatgctttacttgtgatgttaaaaaaaaactcaacttgcagggaaagatcacacctgctgacctgaatggcttgccattaagaagaagtctcaaccaaattaatcgcgaaaggccacaaaatactgacctatagcctacgttattttctttcaagtaaatttcactttggaccatctttattgactaaaatttcacattaagctatggctagactcatgtttccacttaacaccacgtataattaccattgtttgcactttagacctggttttatagttaccatcacacgagttgttgtctaggtgcttagcattttacaagaaacaatgatatagaaatctctgccatgcaaatatgcttagcgcaagaacaataattgtaacatgttatatgatatcctatcaaattaatgggacttcattactactacatatgaatattcacaacccttatactagggacaaaattggagaaatattgagtttaagaactatttttctagaaaagatattacatgttttacaatacccaactgtagtgttagtacaaattgttgaattctaagttttctaacacaaaagaaataagatcagatctacaatcattatactatgtgtaatttgtgaaacccggtacgaagtgcaaataatggtaactatatatggtgttaagtgaaaatataagtctaactctagtccaatgtgaaaatttggtaaataaaggttgaccaaagtgaaatttactcttttcttttaactccaaactgcaatttctttgttttacgttagcatatttttcaagatgttagatgatattttttttttcaaaaaatatgcatataaaggttttataaataaaaaaaaatctgattttttaaatttataataattaatacttaattaattatacgataataagccatcatgttttttcgtgttgttaaactacaactccaaaatagagtttagaacagggcagtaatagtgtttttacatgagggtaatgagtgaacttaactatgcctaaaatttactcctataaacagactgttaatgttaatccatccttgaacagtaatattttaccttgctaactactacatctgtccaaacatataaagagttttagagttaaacatgattattaaaaaaatatgttgaattaaatggtggaatattgtgattggttgagaattgaagatactatcagttaggaaatttgaatgatggagggttatgattgattgagaatgtaatgttgggggataagttgttatattttagagtaaattctaaaggttaactctttttccctaccgatagtctttctgagttcttgctaaccaatactccagggaaagaccaatgtatcagatcaatcaaagcattaaaaataaggtgataggattgagacatcaggctccatcaaagcagaacgcgcatggcaggatgccgatgcaagatgctcggaagaagcaaaactaccattagaaaaaggaagcagtttccatgccagatctcaaattacattttttttaaccatcttctatggtcaggtaaagtaaaagcatcatgttagtttaaccacattgctacatgcacagtagtaaacaaaccaaaagaccatacaaagcagatcatcacaagccatacaacgcatgagtggttcacagagattgagaaatattggaatatggaaacatatcactaaagaattcatgattcctcctaaactttgcagtaatgcaatgatgcaccctgcagcacatgcgtccgcatacacaaaggtttatgaagagatcacataaacaagctgatacctggttgcaccccccaaaacaccgggagtgtagaaatgttgtttatgaacaagggactatgcagctcgtatagattcaaacacaattattttccttacaaacaaaacaaggacaaacaggccacttgtgcaccatagaacaattcacattcaatatgtcataaaaaaaatctctgcactatgagaaatgccatagccacatcggatacaaacaagtcacattgttaaaaagattaacatattctgtgttaacttcaggcctgaaagaactaagagcaaagagaaaggtacttaactagtttctagtccattctctttgcatcgggctgatagcctgatatgtacctaaagtataaggatcagcatcgatccctagtccatgtagtgcggtgttgtttggacgaaaagctcctcatcttcgtcatcatcgtcatcttcatcagcacctacccaattgcttgggtgatgctgtgatcgaggattatcactgacaacatctacaacaaaataaagcaagttatttagatatattgtaatataaatgcatcagtaacagacgacttcaaaatatgatgtgttttatgttgtgatattaaccaggaggctcttccaagtgatccatttgcataggctgcattctgtagtacaaactagtcaaggaaatacattctggaagtaggaaagcagaaataactcgaaactcagacctcgtggatcctctttcattattaacaacatatggaaaactctacatgaacatcaactatcttgacataatacatcagttctgtgcagtaacaaatgctcaatactaggacctaattgccatattattccctataggattgtaatgctctgttctctccattgatgtaatgttttccttagtaactattccctatagaattgtatgcaagattttctatggacctcagggcctggcattgtgtctaagaaaaccacaatctatctccctctgacactgtatatatctatattcatgcagattagtcagatcaaatacagtatgactgattgactgtaagttgactcctaacactaaccttaacattatcactgaaagtgtcttatggttttaactagatgaattgcaataaatacatactccctccgtttcacattgtaagtcattctagcatttcccacattcatattgatgttaatgagtctagatagatatatgtctagattcattaacatcaatatgaatgtgaaaaatgctagaatgacttacattgtgaaacggaggaagtatttaccatggggaatataggcaagtggacacaggttctgttctgtctattgatataatgttggaaggaagcattttgtgttgagggatgctgatctcacaatcccaactaaagaaaaattctcgcatgcagccttaatttctttggattgagagaaagacataagtatataataccataatgatatcataatccataatgatatcataatcccgattaaagaaatttattttttaagtccagacttaatttacttggacagagagaacagagttaaggactgctgttaatatgtctgatgtctgatgaacacattggaaggtcacagtcgtaagaaatatacaagatataaagctgcaactgcagaataggatgcagtagcaaataatacaagaggataaattagaaagaatgaattgaagtgatctataggatacgtatcgtttgcattatcagcgactggtggcttgtagcgagcatttacactatgcagcattgatgtgtcattcagtgcattagaattggcatttctctccttctgggtgtatttttctctgttaacttcaaaacttttgggagcactacctgtttaacaaaagctttcttatgtttgactagcatgatgatatatcaacaggataattctataatcagagagaaatgaagttctccagccaccagttagtttgatcacacacagtcatatggcgtacagtccaattatggccttccgaaagtagccaatatgcactgtacaggccctttggtcctgcgttgagtaccacacagaaagccctgcctggtgtgtgatcataccaatagttgacaggatccatttatcagaaatacacacctgatagctccgaccatattttagtatggtttgagacattttcagggactggtggtggtgtagcagcaacccttggttcttctgctcgctgtgcagaagtagttggctgttgggcaacactgctgtcagtaagttgtgatacaagcatagtggcaagaactagtgttgcatcaaaatcagaacttgatccatcgtcaagcccaaatttgggaaccaaaaggacaggcctgcaattcaaatgaagacttgtaaggtccaatccaaatggataataaaactaaaccagtatggctacttactcgccagccttctgaaagaataggaggatatcaacttcacatccttcacaaaatgttaagaaagcctgggttggaagagatagaaaagtaaatacaatatatgtagtctcatgccataaaaatacctgagcagggaactaagttgtttccttaaagtttcagcagtaaagtttaaaaaacaatgaatattctataccaattactcagaatacaactagccataaagccacatccttctagtccagcaaggagacggaagaattaacaaaactacatcaaggaagcaacctacatgtattcgatggaaaagcaagagtattgacttgcaacttgtaagctctacatacattcagtactgtgcatgctgacacacggatacatattatttacgttattctttctataatgatcttaaagaaatattctctgattcaattaggtgaatgctaaataccaaattatttcccatttaaaggagccattctataattatcagaagttttttgtcctacatctattgaatgtaggttttcgaagaaacaaaatactgatagggctgatcatagatcaccttgagttctttcaccccgaatgtgacatccactgaatcaccggaatgtacatactccacgaactcctctgttgggtcaatccacagctgcgtgtgcagcctcgtatcgcagtcatctgcataaccgcaaagtgcaaagaaaattcacattcacaataccacaacccaatcatcacctcataatacaaaaaaggacagtttacaaacaccatgagatgccacctttcgtcgggtcaatgtagcttctgagctcgacagccttcccctcaatctcaccatccacgccgacgttggagagcccagcagcaggatcggtggcaataaccgtgagctcctgcagcgaggactggaaattggagagcaggcgcgccaggtcccgcggccggatggcgaggcggctggagaagttgctgcggtcgagcgccagcgtctgcacctcggactccgcgctgcacgcgatccagtacgtcttcttcacccctgaacagctcgaaattttgatgagaaattcaggagcactcgccaaaaacagcaaaaatggcggcaaaactaagaaaagcgcgccaacggcaagaaaaatgttgcgcgcaaaaatcccccacaaaattgcaaaaccctagaggacggagggggatcggcgagtaccgttgaggcagtggagggtgagctggagcttgggcgcgtcggggttggggagggaggcggcgatgcggtcgagcgcggcggtcggcgtgcggagcacggagaggacggacttgaggaggacgctgcactggagcggcgtcgacgacggcgccgagtcggcggcggcggcggcggagaggctgaactcgtcgaagaagtcccgcgccagcgagatggacgcgtacgccgaccgcgagctgttgagcgtgtgcagctcaagctgaaaaaggagaaaccaaatcacccccaaagaaaatgtcagaacagctcgccgccggcgaatggaggaggaaaccgcggcggagaggcaggcaggcggcggcggcgaccaccttggcggggtgggcctggaggacgaggtcggagccgacgcgcgcgaggcaggtgacgcaccgcgtgaacgtccgcagcgcgccgccgctcatagacagctccatcgccgcccgcccgcccgcccgccgccggtcgccgccgcaaccgcttccccgcgccgccgcgcttcgtctcagctcgcctcgactcggggggagggaaaccggtcgggggaagcgtgggctttctcggccgagtcgttttgggcctccccacgaacgtggcccaataacggtgggcccatggacgccgaagctagggtttttctctcccgaagccataatatatatcgccctcgctcctcgtgttcttcttcccccttcaaacgccgccgccgccgccgctctcttcggtctcgcttcccttctccgggagattcaggtgcgccccccgattcccgatctgcttcctgttctcccattcgcatgcgcggttgcttagcaggacgattcttctacgatcttctgattgcgattcgcgaggaatcggtgtgtgttagcattatcatgtcgagtagcatttttttgtttttgttggtcaagttccatgtctagcagatgaaatttagtacacgctttgcaactgtacggttaaattcgtggctagtttgtcgaattggatagaaggaagtgcttttatttttctcagatccggttacttctcgttgtcgaggtctagtgtaaggttaacatcctaattcttgggtacacatagatgatatgtcgcttatatcgtcccgtttgattgatatggagctagataaactaaaactgtatgcctagttctattgagtattttagttgaggggggataagttttggtgttccatgtatcttctcctaatctttgtgtgtattgttgctttgctttgcagtcgctgttgtggtgtttgcttcatccaccgccaccatgcagaacgaggagggtcagatggtggacctctacgtccccaggaagtggtatgtttctgtcattcctgatgagttgtttgtctaattcgattgattgttgagatgtacttaatgcttgtcgtgttggtttaccgcagctcggccacgaacaggatcatcaccgccaaggaccacgcctcggtccagatcaacattgggcatgtggatgagaatgggctgtacgatggccgcttcaccacctttgctctctctgggttcatccgtgctcaggtaatcattgcaatcctttgtttattgtaatgtgcctgtatttttctttgtgaactgtcagctgtattgctcacagcctatcagaattcagaatgtgttatttccttcatggtcatgaattttgcgtgacttcttgttgccggcagctgatcatgtcactgaactttagtgctgtaaatacacaagcagaaagtttgatatggctaacaattttgtggattgtttttatgaattcacttctcgtttttgttagcctgagcattttacataattatgtgatgcttctggtttatttcatttgatacctagttggtccacatctttgtttataagtttgcgtagtcattgatattgtggcaaatttacctgaatgacagcaatgtaaaaatcatacttgtacattgactcttttactatcatgatgtccaaaaccagatagctagcatttatctttttctaatgcgagtcccatcagttatttcttggtgccatcctggtagctaggacctagctgtttttcttgctcatatgctatgtacatgacttttgttgcaatgttgcctcctccggtcggttctcatctctttttattgacagggagatgctgacagtgctctggataggctgtggcagaagaggaaggctgaggtcaagcagcagtagatcttgctactagttttacctggaagaactcgtttcaatttcatgtctctctagctacttcatgcaatgcctgtgttatcagttcgtactccgaaaaaattcgtgtgacttgatcggtttatcctgataatgttttatccatgttgaagctttattacatctgtttcttgatgcatcgtgtggctgacatcattgcacttgtttcaaaagaatccatgtcgctatgcttatcagaagttcttttctaggctgacatatttatcgtggattcttcctctcgagtcctatatgtcgccatctaggatcacagattcatctgctaatgtttggatctcattcatctgctaatgtttcatagttcatatctgggtaccgcctgatcaataaaataatcaggacttctggtactgatcctgctcgataaattcttcgaattaaatttgaaaatatactatcatttgtttttttcttaaaaataattagggtttaattttttttttcacaaatataccatcggtatcgcataattgatacgcgagaatgacgtctcaacagggagagaccgcttgctctcgcggtgccggtgcaagaccgagcacaaccaaagagcgagatcgagatcgtttttgaaaattaattagtggttattgattggtaataattagtgattaatcattctaatgacactatcattatatattgatgtgtgaggtaataggaggataggacccatttaccaattgtaggcatagctaattagacaccgtggttaatgcgaggtggctttttgaggaacattcgggcaatcctcccattagcgccctccgggtagaacccgccgggtacgtgctcatcgccagttagatagagtatcctaagcaactctgccggcgttcggctgtaggagagcgagtcgacgttggcggagaggatgttggtgcatatcttcccctcagcgccgagctgctctggcacgatgagcccctcgtccttcactccgcactgccctagcttgtttcgcagcgccgacacacggtcggtgagctctgccaccgtggcaccgtagggggacactgtctcgcggcggtgctcgaagaggaggccgcgcacgacggcgtcctggccagactcgacggcgagcaggccggcgacgaggcgcttggtggcgtagccgtcgatcagcgggttggtgcccgtgtagccgttgatgcccaggtaagggatgacgtagacggccaggaggaagttgaggctgttggcgtcggggtcgaagggcgggtctaggtggtagccgaccgcctcgtccattaccctggcgaagttgtgtgcgctcaggtctatcagcggccttgggatcccacccactgtcctctggattgccctgcatcgtcaattagttttaagtgcgatcatatatatatatcaccgccattttagaatccatattcttggtaacaactcatgaattttgatctatgaactgtgatctttccaattttgcataactacgtagagcctcatcgattggtctggcttattaaagaataaaaattaatttaggtcgtatttagttacacatttttttttcaaacttccaacttttccatcacatcaaaacttttctacacatataaattttcaacttttccgtcacatcgttccaatttcaaccaaatttctaattttggtgtgaactaaacatagccttataggtaaaacttttatatatttgttcataacgacttaaaagccaatgctaaaaataaattatgtcaaaaatatcttaaaatcaactttaaattcaagtttgaaaaatcgtatgtcaacacagggaatataggcaaaccaatgaggctcgtacacacatacgagacatgcccgttttagtagaactctacgaggttattagattcatatgtcaaacaggttttactcgcaggtgtgtaattacttttctaagttgaaatatgatcacacttaaaatatgtttcctggaagaagcgtccagatcaagaaaagttaaatcttagttttaaacttgtttttcctattgcaatgcacggacactttcctagccaaaaacaactatagttgaaatgtgaatttgaatttcaatcatattctttgttgtaacctcaggtggccgatctcctggtaggcgaactcggcgcagacgcgccacgtgagctcgtcgaggccggccttcctggcgcccaccggcggcgggccgcccagcgtcaggttgggggcgaggtggtccagccccacgccgaacgccgcgtgcaggaagaactccgcctcggcgaactccaggttcagcgcgaaccgcaccgggtccacgtcgtgcgcgaacacggccaccggcgtgtgcggcgccgccgcgctgcactgcgcctccccgccgccgccgccgccgacgccgccgtggaacagctccgcccccaccgccgccgaccacgccgccgggcaggccgggtggtcacctgcattgcacgaggaaaccaggagcagcacgagcagcgccgaacagcagattcgcggcgacgccatctctgactgcaggttgttcatcagttcatgggtagtgttcttctgcacatcagcttcctgtgaatttatagtgaaacagcagcagcacatggcactgaattatcttttcagagacgcaagcgatttagctaacgttcttgggcggctctgattgatctttcgcgaagttttaattgatcggcctgcgactgcaagagataggattgtgacatggcaagatgagctgtttggttgtatagatgaaggtggattgttacttgttggagctggaacgcaagccatttcaagtcaagggtagtttgcagatgaatcattttcagcacagatgctgggggactgaaaaatggaaattggtagccagggattgcaccacaaaatcttccttcagtctatttttggctcatccttgtgcaggctgcaaagtgtgctagcacttgattaggtgagctggtgaggtgtaatagtgccttagatgaggttgtcaaatttacatattagtactgattgctacatatatcacttttattatctttcaactttaaaatggttgttaattactactcctacttgttagcaagatgtccaaaagattagattaatgcaatgtttactcatttgcagttctccgatgggattatatgctttcctttgtgggatttcttcaggtagcaggcaaccacttctgcacttgaggttgaggccacatgcatcacatcacccatccttctgagatcagattacacacaattcaatactattggatcataatattggtttagtaaatcaacgtgcccttgtgcaacttctttctactgcttattgaattgcttcagtctgaaaacgtgctgaaagtatgaaaaataattggtctacaaatgcagggtgaagaacaatgcatctatggtaatgggaacaaaaacttaaccatatcgtgatgctaattcactcacataattgatttagcatttatattaacattattgatttagtatttatattagtagaaatacatggtagaagcaaacaatatttttataaattaagggaaaggataattaggaagattattgaacaaatcataaacaaaagttgggaatcaatttataaattctttaaaattaattctttaaaattaaagaaaaggagaggtaggaggatcatcaaacaaattatttaaaaaaaacaagttgaaaaccaatttataaactctttaaactttgatatacatatatatattttaaaactgatgaattggtgtcctatcaaattaaggaaaagaaaaagtaagaagatcatcgaacaatttataaagaaaaacatggacatgttgggggaagccatgtataaactctttaaactttgatatgcatttgttttgataatgataaaaaaaagaatatgtgtataggacactcaatttgaagtgaactggaactggaaactgaacacatgtgttgtgatatgcgctcacaacactaaagaagaatatgatttaaagagttgacaagacactaaaatgatattagaaatgaatggagctagaacaaatctcatttcattatcattcctccatgttatgaatgtacatagatcaaatctcatttcgttgcattcctccatgtttcagtttgatccgaaatattatctcatcggtatttcagcccatttcagtttactccaaaatctcatctcatctcactgtctaaaatatattgtaaggagttggtgcattagacaatatgatgcacaattaggggctaagaacatatatagtgtggcgagaggaggaatagaaaaaaaaaaacttttggtgaacacgtgctaagtatgaatcaatcatgctggatgcctcaaggcctcgagggtgtataaatcatgagaggtactaataactaaatcgactgactgtaaggaaggcatcaagaatctcgcatgatatgcctgctgtttagctgctatagatataggaaagcagtcatgcaagcagtatgccaacaacaactgcagtgttcatattgagccgcagagaaatatttagcttctgttgataagtgaaataagcaaactcaaggtggcacactcaaaatgacgttgggtaacagatgcatgactgatgattttggctaaatgtcatgttgtttgcaggttctgaattatatatttttttttaatttacaatgcatggtttagcgtttgaagtttcaatagatactccttttgttcttataaaatcatttttggcatagatgttggacctgaaaattgaaatcagtagacgtacaggccgggattgcaccataaaatcttccttcagcttatttttggatcatccttactagtaatacttcgttaggtggaggtgtaatcgcgcctttatcattagatgccgtttgctaagacgaagttgtcaaacttacgtactactactgatgatgatggctatacatggctttatcatctttcaacttcgatgattacgttgttgtcaagatgcccagaagaaatgccatctctgcagttgtccaattagatcacactttcctctgttggattgatttcttcaggtgtttggcactggccacatgcatcaggataactgagattacacgcaaatatccaacaaccctcagatcattacggcgtgcccgtcatgtaaacctcttcgtactgacgcctttttgccttttggaaaaattgagttgcctactgaaactgtatgccacaaactatttcaagttgtcagcaaagtgagcaaaactatcgtaattaatgtaccttgtgcaattgggttcttcttacaaagtgaaaagttcttgcacgttttgcagataatacatataactagcaagaacatttatctaaaaataaaagatgaccactgcacatagcacactcgaaatgctttgttgaaagcttgaaattgtaaggatgcttgtcaactcagatacctgcttaatttgttgggggaaattagtaagctcatatgtgtgggctgcagctagttcaggaatttggagttctccaggagatccatccacagattgatctttcaagtgacggcccaagtaaccattttctttctttaattcctccaaaaatatctgcccctttttttttcatcttcagatgttcccagctcaacaagcaccagaagttcaatagtactacatgttagaacttagttgaacatcattttctgacactattggaaaaacagtagaacccatgattaacacaaaaatatgaactttgaagttactttgccagcttatacaaaatgtgtatgtggcactgtaagcgccagacatttctctcatctaatattttctttttcatagtaagcatgttgttagcagtgtacgtgtcaggcacttctctcatctaataatatttctattttcaaattaagcatgttttttttatcaaattcagaccattgatcttggtatcacatccttcagctcaaagggaaggaaatccctatcatccctaatactccttcatattgtatttttatttgccgccttatgtctatcgagaaactaatgcaaagataattactacctccgtcctaaaataaaataaattttggttggatgtaatatattctaatattataaatctggataggatatatccagattcatggtatcaggatatatatcctgtctaacaaaaaattaatatattttaggatggaggattatttaatagtctttagcagaagcacatgcaacaacaataacatgctcgccatcacacgtcaactgttctaatttggaaacgtgctgaaggtctggaaaatttcaagtggaaattcggcatgaatgctactccctctgtttcagattataagtcattttgactctgatcaaaatcaaactactccaaatttaaccaagtttgtagacaaacttggttaaatttataattgaatatattttcataatatatttgtcttgggttgaaaatgttatttttttacaaatttaatcaaacttaaagcagtttgactttgatcaaagtaaaaaatgacttataatctgaaacggaaggaataccaaatgtgacctagcaagagtatcaactactcactccatcctaaaatataatcattttttacttcgacacggtcttcgagatatcactttgaccaacaatatctataaaaataaaatgttttaaaaagagagttacatcaaacatcaacatttacatcatctttttcatttgtttgctattaatattcaaaatttaaaaagtttgacttagcactattctaaaaatacttatattttgggacggagggagtagaacaatgctaacccgcaatgtcatgatgattgtactggcaaactctttacactttataatagaggctaaaaccaattagtactatctgcaaaaggaaaagtagtggtgatgaatcgtatatgtgctttgagatttgtgctgctcaaaccagagtattagatatattaacgggttaaacccgattagatctttccatttttagtgtacccgcatgatttgcatacatgcatatattgcaggagtgattgcctttccatataaacgtactcacatcgtttccatataagcaaacatgtacgtaataatttccttccgattgcatgataatttatttccatatatgatacatactttcctttttttgcacatgctcacatcgtttccctatgattgtgtgataatttatttccatatttgagatgacactgaatcagatccacaaattttcagtaattccactaattaagttgtaattgatttatttccatcaataccgattaatattttccactttttgtgtacatataaaatggtatgacatttcattttttacacactccactgtccagtccacgctattaccctgccggccggacgtcggcgagcttttcgtctctgtcggttgtctgcaaggtttcgttgccgttgtcagtcatctgttagcttcgtcaccgcgccgttacgcaccgccggtcgttcgcaaggttcgttgtcgccgccgcaggtcgcccgtgaggaggttcgtcgctactgtcatcgacggtcgccgcgcgtgtggttcgtgtgtaatttatttcaatttattcttatattttgaaaagtccctgttctaccgttttcgtagattgagtactgtaacaattttatttcgttgtcaagaccttaagatgggaatgcatcctactaataagtttttggttcatcttcctattgagccaaagactatacgtacgtatgttgccctgggatcatgcggagaagatggtcgtgggtagaagaaacaccagttggatgcacgcgctaagagctagtgtattaacacaagtttttttaaactgatgttcttgacagtgtattaacatgaaatttgcatgttgtaatcatgcaaattaatacagaatattttggtactatgtatatacctaccatcctactattccataaatatcaccacctacttaatctacatcggtagaatatacatagcacacgaggcttatatacctaaatctataaatggtttataggtatatagccaactagacttatatacttacatctacatgtatttaattgcatctggccaagctacctagttagagtataaaaaaactcaactaaaaggcctagctagcttcaaattcagttcaagaaaaaaaaacctacttgaaaattaaactttttcacgcgcatttagataggtatataccaaactacaatatgcaatttttaatgggtatatacctagtatgtgtgtttagaccggtatatacccaaatagaatctggtatgtcacacatacccaatatacgtgtttaaatacctaaaaatgtgtatcctaaatggtattatacccaattaaatgtacatctgaaatgcatgcatgtaaatacctagctttgtagtacgtttgaaacgcatgcacgtcacatacccaaaaaattaaaaagcacaacacacgagacttatatacatacatctacatgtacctaattacatctggtcagctacctagcgagagtataaaaaaaacttaactaaaaggcctggctagtttcaaatttagttcaagaaaaaaaatgtaagctacttgaaagtcaaatttttttcacgcccatttagataggtatatacctaactaaaaatgggtgtccgaaatatgcaatttttaatgggtatatacctaaatcaattctgtttaccggttatattgtacttattttttctccggtatatgctgatattttagatagtatatactagatttttcaagtatccaagatatattaaatcgaagggctaggcggcgtgatgcacaactgtacataagtttttttcacatactacgattaatttttgagtatatatcatctccgtacatcatataattacaaaaaaatgtacttctaatacctagttttttttgccataaaattaacatagactaaaatcgaaattttttcattgcatgggatttttttccccgtttcataccaaatttttgagtatacgacccattcgtacctaaaaatagaaagtgactcgtagtgcatattttgttactcaaattgctaaattaatggagtcatgaatgtaataatttggtacggatacattaccatataaatttgttgcgatattatccatgtttccaaatacatttgaatataataaatttgctgcgatatatataataaatttccaactaatttgtttccatgtttccaaaaaccaacaatcagtatttagtgttacatacttagttcccattttcacatatacttactttccatttttccaaaaaattaatttatttttccatatacttagtttccatttttcacaataatgttaccatttattcagaccccaacgtgaagcaagtaagtttccatatttacaagatattatttccaatttcacggttatttaatgtttccatttttgaaatgtacacgcaattatggaaattctctcatccgcattgcatgcatataaatgcatttattccttttttttactgtctattcaaatatgtggaatccattcattattaaatactatactctaaacgggtgtatacccattaagctatgtacccaaatgatcaaaaccgatcagtaagcatcctacggctcctaacattggagccccatccgtgcgtcctatatggtaacactcatatggggcaccatggtgcccgggcaccatggtatcaaatgcacaaaatcactcaaatttttcaaaattttcaaattgtgagtatacctagttataagaattcgattcatacctatacctatcaacaaaacaaactcaagtttaactttgtttcacaatccatgattacatatctaactaattatatgtttggatgctatatacgtagaatcaaaatctaacaaaaacaagttcaaattcagttcaaacttgctttgaactagttaataaagtagttaatgttaatacctaaatatttgaaaaagtttcatactcatttgaattgggtatatactcaatttcaacaatggtgcccgggcaccatggagcaccaaacaaatttactaattgtgagtatatacctagttataagaattcgattcatacctatacctatcaacaaaacaaactcaagtttaactttatttcacaatctatgattacatacctaactaattatatgtttggatgctatatacctagaatcaaaatctaacaaaaacaagttcaaattcagttcaaacttgaatatatatagcatccacacatatatatatatatatatatatatatatatatatatatatataggtaaattaactggtgctacatggagtatgggctccaagattcaaattgagtatatacccaatttgaatgagtatgaattttttttaaatgtatagatatgaacattaacttctttactaacaagtttaaacaagtttgaactgagtttgaacttttttttattagattttggttctaggtatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttgtgtgttttataccttggagcccgggcaccatggagtcccatatgggtatcctatatatatatatgtatatatacatatgtatatatatatatatatatatgtatatatatatgtatgtatgtatgtatgtatatatgtatgtgtgtgtgtgtaaaatcaaagtgtgtttgattattgtttcgtgatgaataattggcatatgagattattggttttgatgttgagatattattggcgaagtggttttggagatgattgatttacaggtgatggacaggattgacaagtctgacggttgcggtcagatcggctgggtaaggctagtcagaccggtgttatgcgagcggtcaaaccgaccagcccgcggtcttactggccgacgctgagtcgtggataatttatgtttataacttctagatggatactatgcgtatgtaatactgttgtttgctaacaaatgagtcaagttggtgagaacttgtgctcggatatggtttcttggttgatgcatgtgtaggtggtcttgcctcaagagagtgttgccggtgatggatcgggagtcaacttgggaaaataagacattcgaacgatcaggatatcatgtggaatactttggctaaacatcattgcacgtggttggtgaagatttcatatggcatacgatgtagatattgtgtgcgtatgagatacggagtcgaatttggaaggagtccaaatttggtacatttggagtttgtaaagtttgtttctttttcggaaaggtttcctatatgattaggacttcttgtacaaggttggttcgtgactttaggctacctacctcagttataaatagagagggagggtgtgtcttgcggtatcctttttagagagtgagaaaagttagggttttgagtttagtcaagattttcatgagaagtgctattgttacactttgtaaacacagagataagtaataaagtttaatctattttgagaatcttcgatttatgtttgctcgagtacgacggtctaacatgcatgatacttgtggttagaccgactgcaacgtggcgtcaaactggcgggcacacggtggtctaaccgtgcccgccagtttgaccggcaactgcaacaggcgcatcgggcggtcagaccggagtgactgcaccagttagatcggatgtcatcgagcggtttgaccgtccgatctgaccggtgcatctacactggtgtcgaggggtgaccctctctagcgggaggctgtgaggcccccctttgagagttcggccgggggcagcgggtgagattcgaggatttggtgagcgaaactatgtgtgatcttgatctcggaggctcctccaagacgatgagacaaaagaggtttatacaggttcgggccgctatgaagcgtaataccctactcatgtgtgtatgattcttctgtgcttagaaagtccctggtatgcaagctagggttagacaagctttggctcagggatcctcggtccgatcccacttccttgctaggcatggtcctccttttatactctaaggggataccacatgtgctgcgagtgctacctagagagaagggaaaatattctctataataattacatgtcttgtgccttagcccagaagctatctacacatcggttgctgcgcggggcccatcaaatcatgcagggcatccttgtcattcgctatttaatggatgaggacttctgggttctcgttcacaccaaaaaaggggaactcgggtcagttcagagtggttggaccagctctaaccggggtaagaggctgtgaagcccctcatcattatgatgggacgggacagagcacgccactcgccgcctgacacactgatagggcgcgggtacacagtcgccgtcccatcggtcattcaaccgtcacagaccggtcagatgcgcagcacgccgcattaaatgcggattggcgcggttgcatagaccgctttaaatgcagttaggtgggcgttaggcgcgcccacctaaccctatacacgtgggctgatacgtggagggggtcggggcagctcgaccccaagcgagggcggcctcctccctctagcttgggggggcagccgccgcgccaccccgggctcgacccccctcggggggagccacgtgggtttgggggcggcccgaccccaagctgggagggggcagccgccacaacaccccgggttcgacccccctcggggagagccacatgggtttgagggcggcctcctccctctagctgggagggggtagccaccgctccaccccgggcttgatcccccctcgcggggagccacgtgggtttgagggcggcctcctccctctagacgtgatacccccgggcccatatcaccgacaactggttagaccacaaccattgacgtcttcaatcttacaagttgtacttttcttttggcttgttttagtattctccaaaatctcatagctcaacaaaaagcacggttaagagggattgagaaaaaagatgcagcattgtacacagtatttactgaaatataaatagggttgggaagcaattcgaggagaaaaaaatagttttatgaataaggtgtgtttaagtatgaatctatcattctatagggatgattgtataaattacgagcggtgcggataattaatccgattaacagttaggaagtcgtgaaaacactcacatgatatacatgttgcttatctactagatataaggaaatagtcatgcaagtaggatgccataacaattgcagtgtttaacaatgaacctcagtggtgcagggaaatatttctgttgattgataactgaaaattgcaaacccgaagtggcacactcaaaatggcatctgggaactgggtggttggtgattttggctaattgaggtatttgctggttctgaactgggtttggcgtttctaaatgtgtagtattgacattggtttagtatttgaggtctcaattattgacgctctttgttcttgatatcccctacactgaacaaatggaattttttttggttttagatttttttttaaaaaaatatttacagaaataatctatcggccaaaaaaattacaaaaatataccctgccgcccacctctggggcggcaagctgacgtggcaaacgggggaggaacgggcagtgacggagggagggttttttgcaggaaaacccttgccgccctctggtggggcggcaaggggcccgaatgcaaaaaagccagtcggggccggctattttgcaggcggccccttgccgccctctggccgggcggcaggcctccctgcctataaaaggcctgctgcccagcccccagccctcattcttctctcctcaattccagtgaaaaaaaaataagagaggggaggagaagagaagaaggggcgaagtcctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggactaggaaacgtccgttacgggccaactggggtagatctgttagattttattgtatcagaaagaggaattgatagactggctgagaggagtgtaccttctataaaaggatggttaatgaggggcttgagagttgatccacagacaagtgacataacaatcaatgttatagtaagtcaggcaactgaggttttttttgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgaaggaccaagagctgaagtaaacgagacttctgtggaggaggtcaacgcacgagaggacgggggcgtagtagctccagtgggcattcaaccaggtggagtggccgacgagggggagactgttggtgccattgtggatgaaatggagagggaggattctgacaacgagcgtgtagaggaaggtgattcgtcagatgatgagacggatattaatccagcagaatgggctagtaaggatttttctgggctgatcgtctctgaagaggatagtgtgagatgggagtacaaagaaaatgaggttattcagggagcgatttatagtagagcagaagatatgaatgaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacttgtgcatttgttgcatctgagatgtatgcgcatgtcatcgataatctcacatatgaagcaaggtcaataatccgacacatcgaagagacatacaagtatactattagctatgccaaggcctggagggccaaacagaaaataatagagatgagatttggaacttacgaagcctcgtataacaatttgccacgcctgcttggtgttatcgaggaaagaaaccctgggagctcttacgaagtgaagaaattcccctcaattgaacatcctagcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcagatattgcccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccccggtgtttgggaagatgtacagagtaggtggtgcatgcgtcatatgggagcgaatttcttcaagcaattcaagaacaaggagctcaagaacatgttcaagaggctgtgcaatcagaaccaggagaaaaaattcaatgagctttggaagagattagatgagttgacagccaaatgtagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctgtagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatatgtcacagtacttcagtaagcaagcaatatatcatacatggagcggcaagatttatgggttcggcatagctggggagttcacagagactaacgatgaagtactcaatattcctgacccatcgaagctccgaggcaaggctggaaggaggaggactcgtcgcatccacaatgatatggacgagacggaggctagcaaggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcatttcgaacttatcgatgtgtttatgtttcgtcgtgtaatgtcagacttcggcatgtcatgtctttaggtctcgtgatgtaacgtcggactaaggcgcctaacgtctttaggtatgctgatgtttgtcggacttcgacacgtaatgttatgttatattattgaactctacatatatgttaaattgcacgtcatcgttatgtaccattagtaacgtttgctatatttaaatagcatgtactcttgttgtacataattaatctcatgattttattactatttcataattttgcaagttatcttttgttttacattactattttttgaattgttctaacacgaaacactatatttttcagagatggcatgtcaggatacacctcagttgttggacccggcgatagatcaccgacaccggtctcaccttactgcggtgcagggggctcagcttgggacgttccgggcacggacgtgtggtgagctactcacggttcacgactcctttgtcgagaggtacgaacagtgttttactataagttagttgcactgtaataatttttataatgacatattaatttgttattgcaggctacgtgaggccggcctcctaccgatgtgtcggctggtggaggctgcggccggcgacgcggacccggccagacaatggactgtggacaggtccctcctagcagctttggtcgatcgatggaggccagagacgcacacttttcacttgccgtgcggtgaggtagcccctaccctacaggacgtatcgtacttgttggggctaccgctcgcgggagacgctgttgggccagtgaccacggctgtggactggcaggacgatctgacggcacgtttcgcactagtatagcgcgcaccgcacctcctgctcgagccgttggcacaccaccgcaacaccggacctacgaagaggtggctgcttcagttcaccgtgagtgtttttgtaccgaaatgacaatcgtattacatatttaatccgcagttaaggtgcctaacattttatcgacggcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgactcagtggagctggggttccgcattgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaagttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaagcgtactggatgactacggttccgatggtcttcgacatctgcgttgagcctcacgcccctttccgcgtgatgcggcagttcggcttccgtcagccctttccagtactgtttccgaccatcgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggtgactggcccgccaagttggcaacttttgttgaggactggttgctcgcaactgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaatcatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacattgctcgggcagacgcagctgtacagcggccacccgtaccgactggtccccgtccagctgcgcacgttcctaggccgactccccctccgcacagaggtaagtatttttattactatttttgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcaacaatcaatttacatacattttatgtcttagcttacaagggtcccgttgtcgatgtgtaggtttcgcccagtttgctatgacgaaggccgcccacttctcccaggctgcagggtcagcgtctcaggcagctgtgtcaacctcgcactcagcgcagttctggcagtacaccgggacttcgtcacaggcagccggcacgtcgagtcagggtccaccactggaccatgctgggacctcgtcggaccgcttgctgccttccaccttgctcttcgacatcactgattttgacttcgcttcaggctcgacagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggcgcatgcacgactactttctgccgcaccgatgcagcctcctttattcgcgtgtgatacgagtatttgcccgccatttagcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcaatcacattcagtactctcttccccacttgcttcattacaaatctgaccggctttcgtcaatggctagacgccggggtgttgaggatccaaactggcatagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgtagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtctatataatgtttctacgacccagactgcgataggcctatataaattatccgagtactaatacgtcgaataaggtacaaaataatacctcacttaacatatgaaattgcgcaacaaccaactttaatacatttttataacaatattaacaagttttaccaataaatacttctttatttattattaacataacatagaaaaatcttttggccgtacttttttcatctgggtagggacccagatgaaaaagtacggccgcaagctctttgggcggcaagggcctaatcgcaattttggccgacggcggcagacggcgtggtcgacccaccgtctgccatgtcagcttgccgcccaccattagggcggcaggggctatttctgcaatttttttggtcgatagattatttctgtaaatattaaaaaaaaatctaaaaacgaaaaaaattcgaacaaatgccacacggaaacaaaaaggcccgttcatctgggccgatcttgcgtggatttcagccttttttcggccatgttttctttgtttggaagtctactatacctcccttaacttttgctcatgtttgaatcaaaaccggtgcaaatcgcttgctttagtggtttgggagtcggtttcgtcctacgtggcatatttgaccttattgattggctgagtcagcttgtgggtcccacgtgtcaaccggttggtggcaacgtggtcaggagcaggaggtctagttggagaaggtttcggtgccgcctctagggatagaggcaaaggcggaggtgggaggggcgatgtaaggggtgcaaaggagaggtgagggaatggcttcggcaggaagaccacagtcgctggcggagaacgagaggaactgcaatgcctagtacgtgaggaacctttcccacgatggcgccgtggactcctccggcacacatggctggacgacgagctcctccccccgcgtgcatctggctagtgactcatttcactggtcatggcccaccgggagctcctccctctgtgcgtggccggccggcgagctccctccccagcacgtggctggccagtgagttcctctaccacgtgaggccgaccaactccttcttctagcacgtggcctcccgatgagatcctccccctgtgcgtggcctcttggcgagctcctcccccgcatgtggccgaccgatgactcctcctagcgcgcggcctcccggcgggatcctccccttgcacgcggccggccgatgattccttctagtgcgcggcctcccggtgggatcctccccttgcgtgcggccgaccgatgactcctagcacgtggcctcccggcgagatcctcccccgcgcacggctggtcgacgagttccctccccagcacgcgggtagccggccagcgagctcctcccccacgcgcgaccttccaacgagatcctcccttgcgcctgccgccacctgggcgctgttgcttatgggaggtgagaccgtgagagaggagaatgagatgaaagagagaagggataggtgagggagaagatgggatgagatggaagccattgacaagtgggtccgaccgaatgattcagccagtcagctgccacgccggacgaaaccgcctccaaaccactaaaggaggcgatttgcaccggttttgatagatagaggagacattatactgggttttatagttgagggatgcgattcaaccaagagcaagagttatgagaggaaatatagacttattttccttttgtttcgtttagccttaagttggttggatcgcttgttactatcctgacctattgggcctttctcaatgagcactggtcgtctgatccagccagaaccatatgtttactatgttttattttttatttttaataaaagaaacatacttcagcagaaaatagctactaggtgaccgaacttgcattttggagaccattattttgacgtcagaatgacatatacctttgtaaccggacagagagtatagtagcagtagctagtattaatcggcacaaaagcgacagcaaaaaaatcattgaaaagtatgatacaagcatgccagccataaaaaatgagaccgatacttaatacttcacagcgaaatgcatttatttttcaacgtacaacaacaagcagccaagtccatcaaacaaaggcagacatttcgatcgatcgacgtgtgcctcccccgttcgtctgaagaaaaaaacgcgagaaaattgcaggtttcaagtttcagcgacgccgatcgatcgatggattgcgcctgcgccgccgccatggtcctgcaagcgaaggcaacgttgaattattggagatggggggaggaaatgcggcgagaacgacggctccaatccaaaaccatttgacaatttttcagggctctgacgaatctccgaaaccattttcacaatttttcagtcttgacaagcactacgtataatattcagtcaagaattcaagatgatcttatttttcgttaatactacctctgctgtactagtcatccatttgagcagtatgtatgcgcactaattcagctggcaacttttgtgcgtctagtggaagtgcactaactgtctctcttgtgttgccgtcgatccaacagtcaacggcactgcatgaattatttgaaaccaggattaagaaaatggatgaatagcagagagacacgattttaacagtaacccgtttgatttaacagtaagaaaaacacatataaagattcaggacatctgcttttagtaagttactgctccacatttgaacacatgataattcacttcacaagcaaaagctcatttcagtacagacatgacacgatgacaacaaagcatcatcaatgtactacaaagttaagtaggcaagcaaagggccaaaagcaatgcacgtcctttgtacaagatcagggccaaaacactagtgctacagtccacatacttgtgcactgcccataacctgctgctgtctgacgatacagtagtgatacacacatgcaactgcaaaaagcatgtcttttctttcatctttttttaaaaaaaataaaaaataaaaaaaatcatgccataatctcagtgtcaacaagtgcaagcatcactttctccacttgattttccaggatcaaatcctaacccccactactaattccccccctcttcccaagtcctaatccactaggctaaagctgctaagctaagctaaatgcagctgattcccaagttgaatctatcacctgttcatccagcgagatgtgcagagtactctatactagtacttactactagtatagtatagtacatagtacgagatgttgctgtccggtcttaattaggcttgcagagaaagcacatggagtttttaacctaatggcccgcctactaatcctgccccaaagaaacctcatcgccattggcgaactcctgtgttaactacgttatctcatgtgccgacttgctgacactaagccattaagataatttagctgttgctgccatgcatatcatcgctgggacatagtagtagactttgacgccaacgacgatgtcgccgccgccgcagcagcagcagccggctgctgcgacgtacggtttaattactgctggaatcgtcgccggtttttggccatcctggaggcttctgcttctttgatctccgctgactctgacgcatcccagcatcagcagaatgggcgtgcgagtttgcaacgagccgtgtacgcaactaagtgtcccctctatttcttacaaacacacgatcagctgacaaaaaaaatcagtaaacgatcagctgatcaaaagctgtatcttgcagtgcagcagagagtctagatagggttaaggtggatatatgatattcaggatgcgtttagttcctgaaaaaagttagaagtttagaaaaaaaagttaaaagtttatatctgtaggaaagttttggatgtgatgtgatgtgatggaaagttggaagttaaggatagttgggggtgaactaaacacagcgttagatatttcattttttgcagtggatgaaatgatcattaggttggactgatcacagcgtgttcttcctcttttcgtccctgatctttgcttatggtttaagactcctgggaaaaggcaagaatgcaagatcgatggagctctcagaaaaaaaaacgttttgaaaaaaaaactgaacttctgaagaatggccaggcaagatctcacctttccaaaaaggctccttttacggactgtttttaaggtttacatgattcaaaagatgagctaaaaggcggtgaaaattaaaggaaaaaacaagaaaatgtgcttgcgtggctgcttgtcagactgtcaaccagttcgtccttccgctgctgctgattgccatcgctgccgacgcagctccatgtcagcctcgtggatctttcgagtgtaaagtcatcacctaccacttcttgttacggaatgtggcacaagcacccatccgatccgattcagctctgaaaggatctcctgatcggtctcttctcctaccaaaggggggtacaggtacaggtaacaggttacagcctgtgctgtttcagcacaaactaactttctttctttttttaattcagcaaatgatctgctgctacctgctactggctctcaactttggttggttggtcagattgattggccacttctttctgaaaccaatggcatgcatggaactttaatttccttggaaaaattttcgtcagttgaaacaaaagaatcggtttcgaacaggggacagtatcttccagtaggaatagttcaatgaaagcccccagatgtggagatgtagacagaggctcatcgatcagaagattcagaacacaacttgcaatagaaatgtcaatactattactggctttaattgcagctcccctccaagaattttcacagtttcagacatcctcgttaaacgatggttgtgacttttacggtacaatttactggcagtatatatttccagtacgaacaaggatgctttaaaattttgtcacaaaattgaaaatgacatttttagcaatttcgtactttagtccctagccactcatcgaatcgtcctgtcatcgtcccgagtgagtcggccactcccttcggcaatgtcatggcagctggccatggtttttgatgacgcggcatactcatggtgtgtcgtgtgctcgtggtgacaggtggcactacggcatgcttgcggtggctagaggcggtgttgcatgtgtagactcatagtggttggcagcccctcgccacggtgaaggatgagggggaaggacaaaccaacctttacaatatatactgcagctatagtatatcataaatgttttctattttaaatagctgaatgatttttttaatcactagttgaggatgtaaacaaataaataaactactagaaagttgagaatttaaaacagtttttattttccgaaaatttcattgtttaggagctagtgggactttgaactttggtacatcgatcaccacgtcagcacctctaatattctcaaatttagtcacccaccagtctaaatttcttcgaaggccactcggtgcagtaaatactcctatctagcaaaaacttcaaaccatcaggtgaccagagaaaattcagcacatcaaccattttctgcaaaattttaaaagaagctcctggcttcctcttcagcacaagtttcttccctcaacgaaataaacttcccaagtcggcaaatttaagtgcactatattacctactggtacgtgttctcaacatcaagaacgatttcagaaagcaaagctacgtaaaactacacccttggccgattgccacaaaattattctccacatgcaaaagacacagaacaaattgagttctacaagaaagggatgacacgattttgcagaatttgcaaaatcgctttagtaagtagtactccctccatattttaattaatgacgtcgttgacttttcgaccaacgcttgaccattcgttttatttaaaatttttgtgcgaatatgaaaatatttatgtcatgcttaaagaatatttgatgatgaatcaagtcacaataaaataaagttatataaattttttgaataagacgaatggtcaaacattaaaaaaagtcaacggcgtcatatattaaaataatatggagggagtactactaaagctcttgcagacaggtacatatgtacactggtaggggccaagaggtgaagtatttggcaaatcagtctggcaaatgtcgtccctacgcactaataccgtccttgttgatcctgttcttctcttccatgacagctagtaccagaccaacatgatccaaaatccaagttattttcaagtttggtcagatgtagcttttcatccgatgtactcgttttcttctagtcatattttgagtgttttttcagttcaacagggtgtaagacagctctatctataaaagatcgaaatgcggatttttttttttaagactgttactcttgctgctaccttttgatctactctgtttatcaaaaataaaactaaatttgtgacattcatgaagaacttctccagaaactagattcgtggttgataaaaatgaggtgcttattagttctcgctacaagtttctatattgatgctacctactacctacgtcctaaaatataagcatgtctagtttaacagctaaaaaatttacattttaaaacggagggagtatgaaacaacgaaaggtaacatttttctaagacgattactgttgttactactgttttatctaggtgttactatatgattcgttgtacgtatctagattcacaaaaataactttttcataaaccaaaattgtggttgacaaaatgaggtctttgttaatttttagtgtgcctcgctacaaattataagtttctaaattgacgctaccttaaaacaatgaaagccaggattttttttttaaagattgttactcttgctaccacctttcgatctaggtgttactactatatgactcaatatacctagctagattctcacaaagctttttcagaaaaaaaaaggtgatcaacaaaattaatgaggtatctagctttttgcctcactacaactataagtttaacttataggtcgacgctacctaacttatatttgaaaacaaaaatctaaaaattttttctgactggacagccacggatatgcagaaaaggcatgagccatctaaggtagttatacagggaaccaaagcagttagaccatgccaaactgctaaaaccttgatgattgtaagctagctaaaggtagacaggcaggccggcattgcatattcttcatattcctctccatcacgctaacctaaaccaaagatgcagcagcatatgagaggagagcaaaggagtaatgactcaaaagttcactttgcagatgcagcatgtgatggtcaccaccagctaagcatctccaaatcatgcatgaaaccaacctaattaagacaaggaaaaaaaaggaaagccatttcttgtggagaacctcaagagtatccctgccattcctttagcttaattgtcatatgatagtgattagttcaccaaatgctcctccaaaataaaatcagaactgaaaattaagaccaggtcgcctgaaccggcatctgtccatggctgatgacaattaattaggatcttccaaactaaagccatataaacacaaagatttttctttttcttttgggcttgcatggtttggagcttcatgggcagctctgttcttcacaaggaatctgaattggtgacatataatcctgtgtccaccaatgaaagcgaccaagtgtgtgactgtgtgagagtgtgtgccatttgctgatgctgctagagagaaaatcttagccgatgcttccatgtcggtggtccatggctactcgatcctgtgaaagaaaatgtgccaaaaaaaaagggggagagaagaattaaaagatggaacaaaaattatatagaaagaaacaaatttgtgaaacaagtaaatcagataaagaaaaaccaggaacatgcgtgataaataattgcatccaacatccatcgtgcagagagctattgcaccaaccatatcttatccttttttttttcttcctctctctctctctatctgtatctctggcgccccacttactctgcgtccaaaattaggtttcaattcatcaagcactagtgataagtgagcgagtgacaccgaaaatgctgtcgctgttggtagtgaagcggtgatgcgagcgcgatgtgtgctaaatcatccaattgaatcaaacgtcttgttttcgaggaaaaattggcaaaaaatgtacaatgccattaccaaactaaagttgtgataagctagctatacacttaggcctccttttggaacaaagaattttgtagatgagtttttgcatgatttgaatcctattcgatcctttggaacaaagaacaaggttcaggtttttagaattctataaaatttctttcgaacgactcgaaatatggggattttagagaaaagttaccgtaagaactcatggggttttaacgagtctacatctatctctactcaatttcttgttcttttccttgcagtctactcaaatggctatctatttatttttattgtgtctttataatatatttatattaaaatcttatgtttttgttgtttctgtattctattttcgctacgtttaaaaggagccctaacatgatatgtagcaccattattcgaggaactctcgagtgcccggatgaactagctggcaggtgaataattagatttgcactatgaatcattagatttgcactatgtttgtatctatgcatgtaaggaaccaccggttccaagcattggcacaattagatggctcccatcatgctagcagaggagtccctgttgttcttgacatctatctatctatctatctatctattatatactaaaagtctattaaactttctataaacgctctcatgccgccacatggcgctctaaaaacgctctcaagctgccacatggcgctttaataaaatagagaaaatattagaaattttgagaaaaagaaaaaaaatctagcctcgattttcatttaagttggtggacccattaatttacaccgtcagattagattcattataaatagtaatatatttctcctaatttatcatataatactttcctaaaaataatggccggaataggccaagaaggcatatacgtacgatggtacgagttaaaaaaaacattgccttttaaactggattttcacttcctgtgtattttttccatgaaggccaacgttaaatatttggtgaaactaccaaaagaaaacaacaattttaaactagatttttctattatacttcctctggatatttttgttttctttatgatgatcaacgacaaatatttagtgaaggtggtagtataagaaaaatatattacttcatataacacatacacacccaaaaatagatctataatataatataaatataaaaaacgtatcatttcatactacaattgttgagtttagatagattttatttgcatcaatgggcctacattgatagttcaagatgaaataatgagtaattaaaatattactcgggacatattgtcagaaacacaaataatgaaacacaaataaaaaaatgtattgtttaaaatatgccacattttttcttgcaaaacacagctagaattttagccgttaatgactcaagtaatctatactttttgatttgtacatatttttaaaagtacataagaaatttaaggttgagctctaaagtgtttatcagattggctctgactcatttatcttgagtatgttctccgaatttttgcaaatactttctatattttttaaaaaaaaatctattttcatgtttgtaatatttaatacttaattaatattacgtagatgacctacatcgtttttcatgccctacataagctcaacaaatgagatagaatgtagcctaagtaggagataaattagattatttactataaaatttaatattaaaaatcaagttaactacgttattaaaaaatccattactttggatcatatatattctaaggataagctattattcactaatctatacatttttaagaaaaaaatcaaatacgttttgttgtctccttgctatttcttagctactaaagtaaaatagaaacaatcaataatattggattttttttagaaacgcagcacgcgcacaccctacccttttgagtacctccaaaagactgagccgacacattttgagattgacgatgtcaccgcgggcgtctcgctgtcgacgggtatgtcacctaccattgaaagaataattagccgtaactgcgagcacccgtgtcaagtctaggacttgaaccaggtgggcaagttccaccacaagaaatctaaccaattgagccgcgctcacttcgcaatagcattggatattaaaacaatcataatttttaagttacattactggaatacttatatgccttttaaatcggtgaactattacttacaaccgttagatctatcttatataaaagttaagcatgtattcatggtactggtacatgacatttccaaaatattattgtgcaattatatttcgtcattatcgtattcatattaggttgcatggagcctctcacccaccctacatgaaatgtttatagatggatcacctctcaaactacatcaatcgtattagcctatataaacccatacatttagtggagattcatgtcccatccaatttattatttaatgaactattataatagatatgcaattaaaaaacactttactttactttcattaacatgttttctaaacaaaaagtctactttattttcaaatgataaaagaagattataaataattgcttatagatattgcttaaatatgatgttactaacatgttagaaacttattaagcaattaatgctgatgaaaacaatttatggacaaatcacggcagatgttctccgtttaatatttcacttttatacttatctcaaacttagcgtacgacgcatacccacgtgaatgtgcaggctaccttcctagttttgtccgaaataaccatttggcatttcttttctgtttctatccccaaagacaattcatgcacaattaacaagagaatctgggggaacccccttgtgtgttctaagactggcatgccatgtgcaggatttgttgtgcactgaaagggaagagaaaagatttcacttgtcaggcacagttagtgacgtgacctgttcttaatcagtagcactattacacatcagaatgctcaccaatgagcctgaaatcctggatccctacaaatatgtgctcaaaatgatgctcttgaggaaaaggtattcaaacacctaccggttagaacaaacaaccaccggtttccttgtgttgagttgaatagtagtagcactctactcacagagttgtcaatgtgagagaatagtagttagtacatgccaagcatgcacacaagccggcaatgcttttgagtcactgacacatatgaaccaaaaaacaaaattgccttctctgatctgatctacctaagcacattccttagagtggaggatgccctacttccatccaattgtcctaatcaccaatggctaattaacaactagccaaagcattggtttaagaactaattactataaataaatctcctacagttgaagatccattagctaagttgcccctactgatatgtccaccactcccccattatgtccccatcagccacaatatataaatcaagattagattagtgaacaaattacatgtatttaatcttgccatcacctaagctgagctgagcagagcatgccggcataaatcattgacatgtggacaaggccaactctttatattcaaaagccttcaaacaaaccggccagcttggcctgaccctaaactccagctaaaagttcataagctgagctatcacattaagattattaatgatcattatcgggcaaacatcatcagagaagagaaaaaagatgactaacccataacgattaaactaatacataagattatgtatggataaagtaaatctatgggtatggtcccctgtaaaaagccttagggcctaaagacttgaaagtaacagttttcagcatttctggaatgcatgtagtgtttcttaaaacttagatcttatattggtccttttaaattctagttttatatttaaaaatgcatttgtgaacataagatttttcttttcgcatctctttaaagggagcaaaataaaacaataagataaccaaattaaagcacgggagcacaagccaatacaagaaatgggaaataaacactattagtgcgcgaaaattagctcgtagtctttttctatgtccgtgtttacgcattccgattttagacacataaggcatcacaatttctattgtaaaattatagtaaccattaatgccttaacacttagtggaatatagccagttactaaactttaaactagaaaaaaatatagtatattcgtatccatcgttttaaaacattaaaatttcaattgttccttatagaatctacgtaagttgttatgcttataaaaactaacaccctagtccgccgtcctagagaaagatgcagcatgatgagagagccatcctcaatcctcatagcttctcacaaaacgaagagatgtagcaagaatattctctacaaaagatagaaccttctctatccatagaaaaataattagtacttatagtagttatgtaatctgttatatatatgtatatgtctttgccttatacaaaatgataagagaaaaacatatataatttggcgtgtctcattacaattacatgctctagttaattagaacagtaagagaggaagtgaagaaaaaaaaaaggaaaaagaaaaaaaaaagaaaatgctcggtgaaggagagctttgacctctccaatggaggagagtgtaaacaagctactctacctctcctcaactactacttctcccggccggcctggcctgctagccggcggcggcggcggcggcgcgtggcgttcacatgacgctgcaggcgttggggttctcgtcgtcgaacatgcggtactcgtcctgcagcggcggcgcgtgcgccgtccccggcgggctgtagtagtcgcggtagtaggtgtccggcgacgagtgcgggtacggcatgtacaggtacgacggcgaccactgctgctgcattgcctgcggctgcggcgacggcgacggcggcgggtattgctgctgctgcggcggcggcgcggagtacgccggcggcggtgggtgctgctgcatggagtacgccggctccggccgcggcgcgtagtaggagacgctcgtcgtcggctgcgccatgtggtagctcatcaccggctgcggcgcgccgtagtacgggtaggggtagtgctcctcgtgctgcttgtgcgccgccggcgtcggcgagaagtgcagggacctctccgtcgttgtggcggcggcgggtggcgcggcgtcgccggcgtccttgggcttgctcttctcgtcctttgctccttcgtcgtcattgctagcctccttcaccgccgccgcgggaacggcttctttggcgggttcggcgccaacgtcgtcgcccttcgccttcgcctccggcgccgcctcgctctcgccgccggcgtccttcttcgcctcgtcgcttggcttcgcctcctgctcctcctctttcttctctgcttccttctccgcctcgggcttctcctccgtcttcttctcctccgagctctctgcctgcgccgcggcctccttcgccgccgcagccgcagcatcactacccttgccgccgtcgtcgtccccggccggcgcagcctcaggctgctgcggcgcggcctctatcgccttgaccgcctccggcgccggcgccacgtgcgggtgctgccacggcacggcctgcttcccggacttgtacagcctcttgacgagcgtgtcgccgtccaccgtgccggtcaccgtcaccttgtgcatcgcggcgtccaccttcacatccttcacgcctgaaaccaaacataaaaaaaaaaaaaacaaagatcatctcagcatccccgaatccgaatgcccgccgccgtcgccggcgaagcgccgccgcacgcacgcacgcgcgccacgtaccttcgatgctcctgagcaccttcctgaccttcttcttgcatccgaggcagtggatggacaccctcagcaccacggtccgcagctgcaaaatcacccaaccaccatgtcagcaccggacgaacacctacaaaaccccaactccaaccatccacatcggccggcgtcgcacgctcacctgctgctgcgccgcggcggacgtcgccggcgccggcgagaccgcatccgcagacgccatggatggagcgaggcggattggatggatggatggatcgagcaccgttggattggtgagagcctttcttcggtggcgttggggggagggagggagaggccgcgtcggggtggggctcgtacttatactcggtggcggtgcggctgcgtgtgtcgctgacacgtggggcccagcccccgcccgcccttctcctcttttgcaactgtagcggcggtggttgttaaggacgggggagactgtggcggctgcgtgtgggggaatagtctaccgcggagcactgtgacagtaacagtgtgatacggaagtggattttttttctcccttgttttgtacatctcgtttaaaaagttataaaaaaaactattaagatagatcaatatatgatatatcttttcgcaaacatgcgagttaaaattagacttatactgttcgaaacaaaaatagcaaatttgaccgtgaattacgcgtttagtcaaatttgttatttttgtttctacttgtataagttgaatttgaatttacatgtttatgtttgtgaagtgacatatcttatattagtctattctactaatttttttaaaaaaaatttgtaactttttaagtgacatgaaaataaggggatatccccttaagagttgaattgagttttccgtgtgatactaatattaatattattactgtttttctttaggggaaaacacacatggaaatgttccatgtgacgtgaaaagacgcatgaaatttgatagctttgtcaagcagagccttaggtcatggatatttttgttaccatgtatacgaaaatgtgtggtagtttcatcgaagacgagttctaggagaaacgcggacagagatagggggtttgacatgcatctggtattcatcttccacatatattcacttgataagattgtgctcacggacttatcttcctcgatctggtctcataatttttcaacactattaactgaagttgatggtatatcttcctcctcccccgccatttgtcatattgataccacgagaagtttggtaggctctcgactcttgtattctcttcgattttaagaattggggagtcaagctaaattctcgttgatccgagaaacggtggaatggaatggattaattggagtgtatctaaaaatgaacgggactacctatacatttgtcgacaaattttctactaaaaatttgacatatataattataatacaatcatagtgtaattacactgtaactcgtatgtaattacactgtaacttgcatgtaactaaggtgtaacttgtatttaagttttacgtaattttgaatcgttagatctattacaaaatttgttttggtgaagaagaaaaaaatctcagcacacacatatgtaaaaggatttgttcccacgcccgctatttggcttcgataagctgtatctcgaagtccagcggcagcgacgtccagtttcattgtagtcacagtgtcctcccatgcagttacagtgtaattacactatgattgtactgtaattacatctgacaaatttttggaggaaaatttgtcgacaaatatatagcaaattcgaaatgaactagaacctagagttaggttatacctaatacatagcaccaccactaccaatttgtttccctactacatagcaccaccactatcaatcttttgggcttcacgcacatattgccttccatttacaaactctgccttcgtgttgtatatttatattgatgttgatgaatttagatagatatatatgtctagattcattaacatcaatataaatatgaaaaatgttagagtgacttacatggtgaaacgaaggaagtaacacacacacacacacacacacacacacacacacacacacacacacacacacacacacacacacacacacacacacacacacacacacacacacacacacacacacacatatatatatatatatatatatatatatatatatatatatatgagggtaaactagagaagatcaactatgttctctgtccatgaattaatataaaggattctagattcattagagagattaaggatgaaaaaatattaaaatgacgcttcttaaatgggagataatttgggagtgggaggatggtttgagacaaaactagataaaaatcaaatgagaggtacaacctcttatatttatgaaaaaaataaattaaacccaaaaccccttataattgctttatgatggactgacggaggaagtaaaatttaggctctgtttctttcagcttgagattattataatctagattattgagtcagattactataagctagattgttataatctgtagtagaataagcggttagttgtttctttcctagattattagagcctaaattattgggtttgcaagtctaaagagagagtggggtggcatggtgggtaatttttcacccaataatctggaaaaaaaactcacctaaatgagcttatcagattataataagctacttcaataagttgtctgtttcttttagcttactcccaataatctggattataataatctcaagctaaaagaaacagaaacaagaccttaggcaaccaaagatgttacaggtcatgttccgtttggctaattggctgagctaactcttcgttttccacaaacatgtttccaaacagctaaatagaaacatattttataaaaaactttttcatatacttatgcactttagaaatcaaataaatctatttttaaattttaaaatttttaatacttaactaatcaagctttgaacttgtttcgattcacatgccgctgataatctcagcctaagagcatctccaacagcctctccaaccctggccaaaaccctccctccactagccaaatttggccactctatttggctggccaatggtgggccccacacaacccatcttctccatccccaattccccacacgacaaccgcacggaagaagcacgaggaggaggcgctcgccacgaccgccgctccgctcgctgtcgccgctgccagcccccgcgcggcgcggccgccgtccctcgcacacggtgcggccaccggcctccgctcgccgtggccgcccgcccccgcacggcgcggcccgctgcctccgctcgccgcggccgccgtcccccgctcgccgcggccgctggccccgcgcgccacgcgctgcgcccgccgcatcagctcgccgcggccgtcgtcccccactcgtcgcggccgctgccgccgtccgtcacgcaccgcgcccgccgcctccgctcgctcccagcttgtcggcgccgcctgcttccagccaacacgagaaaaaagagaaagaggggaaggaaggggaaaaagaagaagggagaggctgacatatgggtcccggtgtcgtagaatcaaagtagagagggtagatagagaggctgttggagtgaacagcttagtttgactagccaaatcaaatagagagttggctatacagatgtttggagagttagatttgaagaagctgttggagatgctctaacattccaaccgaacgcaactagtttgacaaccaataaacccttgcataagcaactagtgtggctgacttggcatgattagtgtccgtggcatgccttgtgattggattctgaatgattggagcaatttgcaagtcaattaagtagtaacacttatgatttacgaaaaaaaaattacagccacagattaatttgtaatagacacatcttaccccccacataagaaaatcagaaaaaaaaaaggagaaagaatatagggacccacattccactagccaatacagctgctaggttgatttacatcagctctgggacgtagggaccatatctcgagggcccaccagatgggccgggtgggcccacggtccacgttcgtctgatctcgatgacatgagcatcgcacgaaatggcgacccctcctgtcctgcacgatggatcgttgtatgatgacacggtggactgcaccaccccaatggatcatccatctcatctcccactacaacgtattactactaattattgtttttttgttaaatggctaaatgacagaattgatgaatgattgatgctaatcactagtacatccgttctataatataatataattgattttatctgttgtaacttgtctcgcaatataagtaattttagtgcgctggttgtcacattaatcaacttcaattcggatttctttctattatcttcacttaaccaattctgattaaatagggcatcttagtttttctttctctttatccttaacctctctaaaaactaaaacaataccttatattatgcagggagatagtattcaagtgtacatgtaaatgaattaacttattataaagtttaaaatggatttataatagattgtaagaaagtcatatataaaagagttattacaaaatggagtttaggaagcatacatattcatatatataattggctgtaactcgttaagcaaaggctgcgatgttatattttattatcttaaaaaaaacgtattcatccattcatccattaaggagaaaagcgaagtgagaatagctcaactggttaggttccttgtggtggaaccagcccacccgggttcaaatcctagatttgacacggatgctcgtatttacggctaattattctttcagtagtaagcgacgtacccctcgacagcgaggcgcctatggtgacttcgtcaatctcaagacatgccggcccagtcttccgcaggtgatcataggggtagggtgtgcatgtgtgcgttcataggggtgagtgtacacacgttgtgagcgtctgcgtttttactgtgtttctcaaaaaaaaattaaggagaaaagaacagccatagttttcttttccttttttcttttctttttcttgttcttcctctactcctcctagctactataactccctttttctcttgggtcctgagatgtcgataaggctctagctaccgacgactctactacactgtacaccgtctctgtactatagtacgcaggcgctgttacttgccagtgcaagatatggatagatgctggatatgcataatcgagaacttgataggcgtccttttgcccctttctgctggccattgccgtcacattcgtcagctaatagctatagctaaagctgaaatctatcgaaattttgcatgcgcagctgcgccacccgtggctgtacgtgagagacccggtttccgtggtcagccttgacccggatggcgttttcgagttcttggcacagagagacacgcagtttgctcaacttgcattctgcttgcccccctcatcgagcgagagaacgagcgatcagcattggagcagaagcagaacaggggcatgttcagtgagccctaaattctgataagcagccaattttgaaaatccgaaaaagctagaaaacgttttcagtttattttctagattctacagttatgttttcttaaaatctaaatgaaaaaggtacaccagttaagagatctagtttcttttttattattaagaaaattgtagttgctagaagctcttcaaacaaaatctggggtttaatttgttctagcagtcgcaaatcagctgcgaatatgaagcattatcttgatgaatttgatcggataaactgtccgtttcatcgtcgtctgttgatgattccgtcttcgtttatgtttgcggagcaaacgcgcgccctgcactgcatgattcgatcagaacaatggggtcagcataataatgcagaccgagatactaatatagtacaaggtgttcattagttgtggtttagccgtggtatggtaggagtgtcacacactcatcgtcagctctcagctatatatatatatatccgagcttaattagctgatgcatccgttctcgcattcaacttgcgcttttttcctgatcgctttcagcgtcgacggagacggcagctaattggcttggttgcgactatgattagcacgtattagtatttatacgtaaatatcgaaatatatttacatattggagttttgtttagttttctctctgtagcggccgggcgagagagaacggcacgcctctccctctgtttcagtttttatttttcgtgtgtgtgggtctgaatttatgaagggtgtaccaccaagtactggacctggatcgtgacatgcgtgtcgtcgtacgtatacaatgcaaccgtatagaaattaaaggggtgtttaatttgttggttacagtcgaggaggagtgtacacgtactacgaccgatcgagcagctagctagcacacgggacagcatgcaggaccagtacgtgtatacatcgggtaaatcaggtggtggtcaaattaaaagtgtctaggttaattcaagtttcatcattgacagtaaaaagcttcagaaattcgatcggatataacatctaagagcacccgcaataataaagtaagatgatatctataatacatgtacatctagcaatagactagattaatagtaaatcatgttaatagtatatctatatgggtatctatagctctctaatacattgtctcgtttttctctataaactatctccaggttagtagatacctttgctctctctcttcatttaatctcttccaagtaagaaaatatgctgacatggatctcttatagagagcctatagataactattgcgggtgccctaagagcaagtttaatagtatagcccactactaactccaaatcatctatagccaatataatagccaattcatacaatagttgcttactatactattaatatatggtcccacctgtcatacacacattacgtcttgcagtccgtgttgcagctggctacagatctgtagcccgctgctcttctctctcttcttttatctctttaaaggtggtgtttgggaaggagggactaaagtttagtccctctcacaaaagcataattccctctctcccaaacacccctaaaatatgtttatagctggcttatagcctgatattgtacccgctctaatgtaaaacaataattaaacatatttttttaaccgattggggccacatgcatgaccgggggaggcatgtgccgtgcgtgggcgcgcgtggtcgcatgcaggaggcgagtgagcgtcgacaatatctcgacgcatggaggggcgtgtgtggttcatttcgtcgcgttgatttaccgccgcggagcggagaaaatagaaatcggttcggggtaaacaagccgccgggggctgatggatctaggttgcctgccgccgtcgcgagaggtctaatctattactctctccatttctaaatatttattaccgtttatcttttaaatatgtttgtccgtttattttgttcaaaaaatttaagtatttattgattcttttcctatcatttgattcattgttaaatatacttatatgtatacatatagttttgcacatttcacaaaaaattttaataagataaatggtataaaacatgtgctaaaaaaccaacggtgttaaatatttagaaacggagggagtaacttaataactaaaaaaaatccctcgcgtttactctcaccgtctcacgacctaggaagtttcacattaagcgaaagaagaggaagaatgaaagatagaagggtattaggattgggttttgtgtaaacggaaaaataacaagaaaaaaaagaagggtactatgattgagtgtggtgtaaaccgaaaaaaaaagtgaacacggacaagaaaaataggaaaaaaaagagaaataatgtggaaagtccaacaagaaatataatttaaaatagagtctagaaatacaattttaaatttttgaaaacttggataaaaataaataaaattttaaaagaatacatacagtatgaataaccttactaataatcaaccaggattggactttgcaagaggggatcaatcaaattgccatgcactgatctcctctaagagaaagggtgaaacctactaggatccgccgaggcaaacaatcaatgataggattgaaaataatcacattgattaaattgctcaagttagtaaaaaaaaattaaaattattttaccattttaatatatcttaataataaatatataagaatataaaaatctatgatattatgtgataaaaatataacgatactagagttaaaaaaaaacaagagaacaatcgctgtatgattaattgagttttgattagtataaactttaaaagtaaatttatctgatattttaaaataacttttatatacaaagtttttcacaaaatatatcttttagcagtttaaaaaatatgttaataaaagttatgataaagtctttattttaattagtaaagaactccagttgtcacttgccattgggccgctactgttaacgtacgttgccacatttctatgtgccgaaagcctctgatgattctgcctttttctgctcctctaaaacccgatcgccacttccagaggggagggaagagacgtgttccaagctactaaggctgtgtttgatacttggggttgggaacccaactccaccgcacggaaaacggagcggtccattagcgtgtgaataattaagtattagttaatttttttaaaaaaatggattaatttgtttttttaaagcaactttcgtatagaaactttttgaaaaaaacacaccatttagcagtttaaaaagcgtgcacgcggaaaacgagagaaaggggttgggaaacttgtggaaagaacgcagcctaagagcacccgcaatggtaaagtaaggtgctatctataaaacatgtacatctcagcaatagactagattaatagtaaaccatctcaatagtatgtctacatgggtatctatagctctctaatacattgcctcgtttttctctatagactatctacaggttagtagatagctttgctctctctcttcatttaatctcttccaagtaggaaaatatgctgacatggatctcttatagagagcctatagataaccattgtgggtaccctaagaagatcaaattaaaagatcccactttaaagggttagaccatttaacttttcaggccacacagtgcaccaagaggctaataattgaagcttgttctcggggagcgtatcctatacacacaggctctcgcgtgttcacaccatgtacaccaactaaaaattatcataaaaaattctaggaaaattcatacatgtactttcaatagtattacatctacgtgcaaagtcgcatcttcaaattcattctacatagagaataacaaaaaaagataaaattctgacaaaattgcaaccttaaaactggtcagattttttgttttttttgttacagctaaaatataatgaatttgacgttatacaattgaaagtatgtgtatgattttttctagatattttggtgatattttttagttagtatgcacgtatgtacacatgaggacctgtatgcataggataatatgttgcttgttctcgagggttaactgctagcgataataaaggccataggtagagaaaactgagcgatggattatttgtttagttaattgtacaccctctgtgatataaggtgtgttttgttgtggttagaatgccaacaaagatatatttattttttaaagaacaaaaattaaagcttatgcttatcccgcttcgttaagggggtttttttatggtgttgaaattcatgtcaagcttatacctgcccccttttttatctgaataagcaacaattcatattaaaacagggtcgaaatttatgcctgaatgcttcatgtcaaaacatgtgcgaaatcattaagtctttgaaaagtaggagtaaatatgtaaggacatatatgaaaagtaggagtaagtctttggaacgaatacaaactttagataaaaaaaggggaaaaaatcctaaatttataaaagtttggggtgtggggtaaaaattacaatcgagtatgaaaactaggataagaacacattcgtctctaataactttgtttggtgcaactattttagacatggttcagggcaaccacaatgtataaaaaagataaccttaaaacaataattattcttataaagtgagatatatacattatggaaagtattttttttggataaagggagtagtatgtttcaaattaaaactaggatgtcaaccccaaaaatggaacaatcgtacatggtttactaacggttcttttatagttccttcgaaacacatgattagaaaaacggaggcatataaaaaaacagtatgtttcaaactaagatgttaaacccaaaaaagaaacaaaccgtacatgttttactagcgattctattatggttccctcaaaactcgtgattaaaaaaacagaggcatataaaaatacgttattttaataagaatgtaggtgcaaaacatacgaaaacatacgaaaatacaggaattatcgtttgcttaggctatgtgaaacagaaaaataacaagagagatactaaaatagaatttttcaagatcttgctaacttttctccaaaatctctatattattgttcatttcatacaaatactaaaggaaattatatgattcaatcctttatattcaagacctttttagaaacttttttataggattaaatcctccaaatatatatactatgtttttcgcaccaattaaaggggatgctaatgtaggtttaattaattcaaactagaatgcagtcatccccgaaagatggaagtattgaacaatcgggaaaagatgtgtgtgtaccatttccattttccttttgacctttcatactataaacaatctacgtagcaagtttgaactgggccaacagactgtagagtatcatgggctcatggcgataaataaaccgaacattattagacaaagtgtatattggtggtgtcataaatcctggtgctcacaattcgacagcaattttaaatacaaatcattaccatcctctagataggagagacagtattaaagggcacagctatactggtctgtccgtgcagtctctcgtgtgatgaaaaggtcttaacacgtttaaattgctaaacattatatttagtacgaaaacattttatacagaagttacttgaaaataaaaatctatttgtcttaagttttaataattaatactttattaattatatattaatcgttttttttacgtgcgagctaataagctctttcctaccgtagcttacaaatctaacttgcggggtaaaagcaagtagaggaatagagacgttgtgctcggtagtttgagttgaaaactaatatcttacacacgtaaaacagagcaattcattagcgcatgattaattaggtattaatttttttaaaaaaatatattaatattattttctaaaacttctttcgtataaaaagagttttgtaaaaatcacacattcagtagtttagaaaacgtgcacgtgaaaaacgagtaagaagagcttccgaccacagccttagagtaggtacaataacagactataaattagctataacacatttcgaggagataaaagagtatagagaagagtaatgggatacaaattttagtagccagttgtagcacggactccttcaagatacatgtgtgtatgataggtgagaaatcagatattaattatgtagtatatgtttgtaagtaattaatctataaattggttatagataatttggagtgagtagtccatccatcctgaaaaaacaattttaggactggatgtgacatattttagtacaacgaatatggacagagatacgtctagatttgtagtatgtgtcacctcctgtactaggttgatttttttataggactgatgaagtagttggctatagttgctcctagagagtgtcagatcaggaggaggcgcacagccggatgcacctggatgcagtttgatctcgatcgatctggttgactggttgtccgcatgcacgcacctggcccccgtgtacagagcgccgcatgcggcacgcaccttccacgttgcggatcggagtcgccacaaggaccgtacgcgcgcggacccgtgaggccgtgacccccgtcccaagcgagtcctcctacgggtctgtttggcacatctcaggctctaactccacctcttctggagctgaaacttagccaagcagttttagctccactaaaactgagagtggaattggatagagctctctcacaaaatgtactagagttatgaaactggatttagacagctccagaacttcactctagactcaactcctgaagttaaatttagaagttgtagctgtaccaaacatgccctgctccaccaactcctcctccttgcggtgccaagggtcatcagctcatcatccaagcaaggacgtcatcccagacgcgatgcatgcaagccacggcgaaattcagcgcgaccggattttgactgattaatcagctgcagttcgtagcatatgcgtgtagtatgtgcgtgtgctccgcgctaaactcatgcatttctgctttcacgtgacggtagactcctcctggcatcctgggccctggcctgtccgtcagccgtcagctttgaattgaaacagaaatggtagtagagagaccttctacagtctatacaaagtccccctgatgttattaattagatgaggatttttaccgtccagcaactaggtgtggtaccgttacggtaccgtttgctggccgttcgatcctggccgatctaacggctgatattagtcgggactgaccggtactaactcagcccttgattttgtaccgcacggtggagaagggtggaggggtaagattgtattttcgcgtgccatggtcggaagaggcatgcagaaaaccctagaataggattcgatgtcgtttcctggagggttcccgacttcggcggcggtggcaaagtcgatggcgacggcagagtggctccctgatggccgagtcgttccccccgcagcgacggtgatgcggccaaggtggtgggcatcaatttcgttttccggtggcgacggagtcgttcccgacggcggaggctgcaacggtgatggtggagtcgctggcggcggtggagtggctccctagtgacggcagatgagggcgacaagcttttctctctcgctaacataatccgattcccatcgtaacctccgtgtaatcaacggctagatttcatctggtaccacccggtacatttcgctggacagaaacaaagctctaattagattagttggatccaaatcattacaaatatattatgtttttaaaaaataacattattattcatttatatgtatccatattatacgaacatgcatataactaaaaccatgtcagtcgcatcacgttttatgtcatcatatagactaaaacacccatggacgtgggacctacattccatcttcttcctccttcctttactctttttccttctccatctctctacaccttgttgagccgaaaacatcgggttgtgaggagggtgccgacgagagagaggcaaatggggaggcaacagcgaaccactagctcccgttcacccgttggcctgcgaaggatggagggaatttagcgtcaccccgcttgagcttgctgccacttgccccgagctcctcccgacaatgaagaagactgttctcgctagatctaggttgatgctctccctgtcaccacaagctccgccatcctcattgcgtcattttctttgtggctgccgacagaaggatatggagccccaaacttaatgcctgagatttagtggcgcacgtacgacgggtgatttagccgccggtttctcgggattgccatcggagttgtgcagccagagctacgtgtatgaagcacccgccaccactatcgttgctaggcgccaccgtcatatgctctatggtgggagagagagagaggggggctagagatgtggggtggccggccagcaaaagaggaaagaaggcagatggaatcgttagtaataaataagtagtaattatttttttaaaatgacacatttataatgatatggatccaattaactttattagtttgtctaaacacgaagaaatttaacgttgaaaaccttacgaaccatacagctggttgttttggctcattgttttcattgatcgttactccaaaccaaagacgtgatttcaaaaaaaaaaaaccaaagacgtcaaaggctcaaagcttagcacacgacacatgcacaaaaacccatgtacgttcatctgcatcctcctcatcccatataatactcctagtccgtaacgacccatatgacacatgcatcggacaaattccgttgccgccgctcgatcgcgcgagagagatttgttgtatgcgcgtacgtacgtgtcctctatctcgtatgatctcacgctaaaacaacaaaaaaaccaaacagcttccgcgagtagagtagcggccaaggccatccatgtcgacgccgcaagccgcatcatcgccatgcctgtccagcagcggccgcagtcagcacacacatgcagcggcatgggcgacgtctggatttcctccgctcaccagttaactccaactcccccccatcccctcgctgaatcggacgatgactttgctttccccgatgcgcagtgcaacacaaccccaaaaatacttttattttttcgttgtcatcgagattcagaatagaccacacacggcgtgtgtaatgtaatgttaaagctagattgatttacacactgtggcctaaagttacagccactgtgatctgcacatctgaggttcggaagagctgatagctcccgaaagcgaattatccgtcttttcttatcgttttaagcttttgaatgaaataatagcctattatatgttatcaatgatgaagcattcctgatcaggcacggaactaaattggcagcacatatatcggtgcatgcaacgtgtgcaacgatgccagcaatatagcagacctagtagcctaaacctagatgtaatctgaaagaaattaagaagtggagacaaacatatgaattacatgtatgacattagtgaaagactgaaacgactgcgaaattgtttgggcttccatggctacgtcagagaaacaaactgaaccgctagccgcagatagaaaaggagaagattgcattgctcgccacgaatttggccaaaaaaaaaagtctatggctgctttgctttgcttctttcttgcagccactgcttgcgttgctcacttgctcatcaatcatcattacgcgcgttaattccgttgcgatacgggacaatatgtagctgatatatgtagttctcctgatcatcaatacgggaaattaaattggatggttagaagttgcagcagggggcatagaagaaaacagaacttcatctgaactttatactactccttttgttaatgtcactgtgtgaaggtcagatccttaaaaatcaattgatcaggttgatcacctgctggtcatacagatgtatactactggttggattattggcaacgtttgggtggtttcatcttttctgtttctggtttaattgagcacattgtaatgaccctttcaagccacttctttattttttttctgaaagtttggcgaaaaggtgtcccagttgactgagatcaggatttggcctccccattcgtctctgccgtctgctttcgaaacacatgtatcttatgggtctcatcacctgtttaggataagtaattgttggcgcatgcagcatacataaataatggcatgcctatccttgggtttgacaagaaagaaaaacaaagtgttaacgatgtgaggaggagatcaggttgattaattcagtggtactcgtccttgcactgtagctacgtcaggtgttgagtaataatccaatatataatctgggctatatggctaggagtaaagtagctggtgactgatcaggtgagctgatggtgtagctaacagcgctgtcttagttaacacggctgtttttttgtttttttttcttcgtccagatagcggatgtgtcatgtcggagagtctttgtcaatgttaattcgatcgtgggaaaagaaatgcagagagaatgattccaattgcaaccgttgatggctgtccgtgggttccaaaagtgctgtgacgtattggacatttgggcgctctcactctcatcatacagtatatatgctgcagctagctcctgcaagcaactcggtgctttgattaatcgcaacgtttatgccttgaagaacaattttgaagctaatgtgtatgattaattgaaatcgcaggacttggtctgtttggaatctaattaaccatcgtttgtgagcatctcgcctagctgatctgagctccaggtgactaaactaaatactaataaggctttatttggcatagctctatatccaagctttcattgagttagatactcctggctccacaaatctatagatatagatatagacctacaattacgttaataataattgcaagaatcattttgttcttagtttagatgaaatataaaattttaaatgcaatttagcatacaaacttcaaatccattatgaatctggagctatggcaaatagggactgaatttaacattaaatcatcatcgtattgcaaagtgagcgtagctcaaccgattagattccttgtgttggagacagtccacccagattcaaattttagattttacacacggatgctcgcatttacttcagaagggtttgcatgtgtgttcacaggatgctcacatttacttcataagggtgtgcgtgtgtgttcacaggggataagtatgcacgtattgtggacatctgcgtttgcaccgtgtttataaaaaaaattatcatctcctgccagtgggcgtacgtgtgcttgtgcacggtagcacgcacgcacgcaggcgatcgacgatccgaccgaagcatgtgcgcgcgcgcgcgcctaacacacctaactcgaaccgatgggttgtcgacctaacacgtacgtgattcgctggtgcaacctaacctcgtgtgcaaaattaaccgcgacgccgcgcgcgcgcgcggcgtacgtggagaattacgacgcgccgatgcgtccgctcgtgcgccggagcggccgccgcgcgaggcgagacgcatcgccggcgattggcgtttgcattgccatgcgtggaaggaagagagacggggtgaggtgactcgatcgatcggtgagcgaaatgccaaattactgtgcatccttgagcgtatacccagttaccaccgcggcatctcgtggtgtgtgtggcgaaagatcagatttttttttgttttgttttgttttttttttcgcgtgcgattcgatctagaacatggatcttacagtacataccacaacgtgtgggctggctcgacgatggagctcagctgaggcttgtcaccagctaggttgtttcgttgggccgcggaatatcgcgttcccgtaatccaagcccatctttgtctgccgtaaatccaagcccatcttctcaccagctagaaacacccgcgcgccggcctagctagtaaaacgaggatgcgcaatgtggaaaaagtatatatgagggcaatgtggaaaaagtatatatgagatccctcatcttgttatccaattacaaaataatccctcaatcataaaactagatatatgaaatccctcgacatacaaaaccgggttactctgggtccttaggtagtattgatcccggtcttgtctgacgtcgtggctgagtcagcgtgggacacacgtaggccccatatgtcagcatgtccctcaatcctctcttcataactaggatcgacttctccgacgtggcgtggacccggcggcaccgaggacaaggcggtgagcggaggtgcgtgcccaggtgatggatgcgctcacaacccactgttggttcgatgcgcactacccgcagttcacttcggagattcgcgctagcctatttgacaatgccgttcggccgctcttcacgctcccgtcgacaccaagcaccgcaactactatggacccaagaagcccttccacagctacatcgacagcctctcgggccttgatgcctataagagcctctcaatcattgacgacctcaagcctaagaacatcggcgccttcgctgaccttgtcgctggcctgggcttcctctcccgctgcatcttcggtcgctgtaatgccaccagttcatccaccaccacctctctcctcgatggcttcctcttcctccgctaggagaagggcgacgatcggcggagaggtggtgggcggcggcaccgagctcgaatgctgtggggaggtccagggacctccgctcctatcgctcctcctccgctaccacgtctccctccgccgaccaacgctgtggcctcgacagccattcctaccccgcgtcgctcctgcgccccctgacaacgggcagtggctagcagggagaagggcggcgcagaggagctaggcagcagcggcaccggcggagcacgagcgtggtgatagcatcgagcaaggtaccgaggtggcggaggacggcacagcaatggcgacgcccatggagcgagccaacgagatggagagtcgtgcggccaaaaagcggtggagggattgattcgttggcagcggtgatgctggagaccggcacagagcttcctccactctctctcttccctcaaactcttcccgttgccgctaggccgtcgacgttccttggagccacctaccaccggctgccactccgatccttagcgccaccgcagccggggccacctcccgccgccgtcgaggtcgccgacagccgacggagccacgccctctcctctgcgcttcctccctacatggtgcaagaaagagaggaagaagagagaaaaggaagaagatggggatctaagccgtgggcccaactttttattattttattactttttcggatcaaactgtcacgtaagcgtcatgtatatgtcacgtggaacgaagacctagtcaaaggagccacgtaaacgccacgtcagtcaaaaccgaggacaataacaccgagagacctcgtttgcagtggttttagaaattggaggatacgttttatttgattttttttgattcagggacgattttgtaactcggtaacaaggtaagggacctcaggtatacttttgcctgcacttgttgctgggtcgggctgtaacttaggtaagggatctcgtttgcagtggttttagaaattggaggatacgttttatctgatttttttggttcagggacgattttgtaactcggtaagacggtaacaaggtaagggacctcaggtatactttttcctgcactctgttgctgggtcgggctgtaacttaggtggagcttggagccgggggcctcttccgcgtttgggcctgaggcaacagcatatctccgcgtccgggtgcaacaagcccttgccggggggccatccgttcactcgtgtcaagcataaccctcttcttgatgaaataaagggttttattttcacaccgaatttggaagtagattgttaatttgttacactatatatgttgatgtgacctcacatgatcgatgtcttcgcctcctgttggttacatcatgtctacatgcgtgtagtacattagtgtttatatgtctagatttcaaataataagatttgtttaattttatattagattgttatatttcatgacgaaacatgttatgtgttaccttttcaccaactcaatattgaaaaacgatttctgtgaaaacatcaccttttttaggcggactaaaagaaagcccatatgtaaaaggattcgaaaaactcccaatatagacccgtttataaaaatccattttcacaggtggacgtcttaagaggcatgcctgtgaatatttgcacccgaccggctccatctcttttctttctcctgttaagtcttttcctctcctctctactccatagccctctcccccattttctctcctctcatccatcgactctccttgacgaccgacgatgggagcgaccagcaggcggcaacgcgaggggcagtccaccattggaggcctgcgggaggagagcgttgctgatgggcaccagtgagtgccagtgccataatgggcggattcgccgttgatgactaggtggtggtagtggtgcctcatctggcgtggcggggaggggcaagcacgacaatagcggcggccataggtatcatgaaaaaaaatgtcagttttgcttctagctaggcaatatttttttaacctaattttatgtcttacatctgtgttttcaatttctcagggattggtagctcagtgattatagataaaaagcatttttcttagcaatgtatgatgccattttctttgtacaaacagggggcggacaaagacttattatataatagaagtcattttccttcccaggttttttcttattaaagggacatatgttttcaagtctgtacatgttttggacctcatggttcatgtattgtttaattctagttaaatttagtaaaatatataagtcaagaatgtttgttgattactcgaatagagcatatttttattttacaacgtcagctttgtgcaaacctattgtaaacagttgctttctatactgcagacaagtacgagtctaagcacgaggttttactcctcatgtttgttgattggcaactattttttttttcaattttaaaatagtgccagcgtgtgcaaatctagtcaaatggataaaaatatagtttttatgacgtatgagaaaagtataatttctcagcctttttttcataaaattgattgaattccaaagggaaataaaaaaataaagcctataaagatggcttttttgcgccaaattttgtgcactttcattgtgaatagcaggccgggaatatttgaaaaattgtttgcatttcaaaaatgttttggaagttttaagctaatacgaatgaaagttcatttattatatttaaaaaaaaaaactttccacgtctcggacaaaatatttacgtattttcaaaagaaagttatacttctatataatctccctatccaaattttatgcctaccataccccatccctgaaaaataaatggatagagaacaaacaatctttttttattgccaggatgttctttttgggggacgcagattcagtgacattcccccgtgacattttgagtcactgacatgtggaacccacatgtgctgggcccacatgggtcccacacgtcagtgactcattgtcacagggtatgtcaccagagcaatgtcaccgaatcccaatccctttttgggccgggtataaagagaaaatcaatgagtcttcttttttggctgggacgtgtgtatgaaaggaaaagaaaaggtgcacacacactccgccgccgcaactagcgcaagaacgagagagagatgtgtggatagggttcagtggatggataggtttcctaaggggtattatgggtattatgaatattagttacattctttttgtattttaaatcaaaatttaacgggttagtggaagcagggtcagacggaagcttcattttggaaaaggagggtcaaataagcaaacttaaaaaaatatagacaaattagcagttagggttcaaaacgggatcatataagcaattgtcccaataattaataacccatatatattcacctttcttaatatataaatggagtacctagctaatacgcacgattgtgaaccatttattatgtgcgatataaaatttattaattctaggctgtcctttttctttttgcccttaattaatatccccgacctgtgctagctgattgaacgtatcaatgggcaatgcatacaaaattcatcagagaacgtgcaaactgtggaattaaatgttgaacatattgtgggggcaacttcctttttctttcgagggtacgtagaggagattttattattattattattattattattattattattattattattattattattattattattattattattattattattattattattattattatgcagcttgattaaacatcgttcgatgtagtccagaacctcgatcagctactggctagctagctagtaatgtgccaagcgtaaataccatgcatattttgagcagctcatggcctatactttattagtatgatctctcttaaccttttgcgacatcgatccttacatataaattaaagctgacaactgacaatatctcgcaaacacaaaaaaacttgtagtaataattagtgtagcaaattaagccaaatcgatcggccaaatgtgtgtatacatatatattcgtgttacatcacctttgcaggcgcacattgagcagggtttgagacacactaatgcaacaacagtgtacaacacggttacacggccacacaatcattaataatgccccggccattaatttaatccggactagtccggccgtacatgaacacgtacacacagcacacaataatgcatgctgatatatgtgtgtgtgtgtgtgtgtgtgtgtgtgtgttcgttctccacgcgtcacacaagaaacttaaccaagccaaactatattaattaagttaactgcaagctcatcaatataatcaagcaaattaacctttttgcttgtgcatgcataatacagccatacagtactgtacacacacgctttatatatgctaaaaatcagtcgtacgtgcccgatcgatgagtagaagtggtacgcagctggcagctgatagctatggatcatcataattcatactagtgatcatggacgacagatgttaaattagctagctagttatcaaggaccttgaagtggtcgcggttcttgaggacgacgtcgtacatgtgggtggagcggaagcgggcgaagtcgcgggggagggagatgaggtcggcgccgccgtcgcggcggtggagctgcaccacggcgcggtcctcgtagtagcgctcccacccgagccccgccagcctccgctccagcgcctgcagcgaccccatcgtctcgttcgccggcacgtacaccagcctcctctgcctcctccccgtcccccccctccacgtccgcctccagctgcatcaccccgtccctcttgaacacccacacccccgtccccgccatccaactcacacggtttttttcgatgttttcgtgagagatgttgtttactgctataacgttgctggggtgggggtggttggtttatataggccaccaccaccaccacgatgacgctgctgtcgatcgccggctgcgactgcagtaaagcatagctaggttcagtggcacggcagcaggcaggtagggtctgggaccgtgtgaccggttgaccgaatgaatggatgaattatgaatgaaatgcaatgcaatggcacgcgtggacaccgggagaggataatacagataacggaatatgcatgtgcggggagggcgacccgtcaattcaatgtggggggggggggggggggtcctacggacggggtgagctggataaacagaggggatcggaggagtccagaggaacgcatcaatggcgcgccatgcatggcggtggtggttgtattatttgttcttcaacagcttcctctgatgatgatttttatgacagtctcattgcaaaatatcgatagaaccatcaccactaatagcgagtacaataacggaaaacaagagagaaggaatgcagcacggacattatgtgtgtatgagaggttggatatatatcaatgttgtagtatatatatacttatactccctctgtcccataatagatgacgtttttgactttttatttgtaacgtttgaccattcgtttttttaaaaaattagtgcaaatataaaaaaagataagtcatatgtaaagtacttttaataataaagcaaatgataaacaaaataaataataattccaaatttttttaaataagacgaatgatcaaacattgacaaacaaaaactcaaaaagacaagtaatatgggacggaggtagtaggtaataactattgtatgaatgagctattagattggctatagatgatttggagttagtagttggctatactattaaacttattaaacttgctctaatgaccgcatcgaggtttctctgacggccaaaggtggcgccaagcgaccaatgtctactgaaaatacgtttgttttgctggcggtaatcgaccgcaggggtgaaaccgttttcgttgctggacaaatatagcccagtcacctgcgaaaatattcttcacgcgtgtccagctaatgatgtgcgccagcgaaaatgtttttcaatttctaccgatgattttttggtgacagtctcattgcaaagtatcgatagaccatcactactaatggccacatcgagttttctccgacggctaaaggtggcgccaagcgacctgtgcccaatgaaaataggggcaattgcaaatttaccaccggtttttttaatattgcaaggatgccacttgaatgacagttctaatgacatttttgcaattttctagtggcagttttgcaataacgattcaaagtagtggtaaatttgcaattgccccataaaaatacgtcccttttgctggcggtaatcaatcgtaggggtaaaaccattttccttgacgggcgacgtagcccagtcacctccaaaactcaacatggccccattcgtgtagaaggtaagattttaccagcactggtggagaaacgtttttttactcccggtttgcaaccccctatagtcccggttttctaaccgggactacgaatctgggactaaagatcgctatctttagtcccggttcaaatacccgggactaaaaatcgatctttagtcccggttggtaacaccaacaccaaccgggactaaagatggagccatttttaaccccggttggtattaccaaccgggactaaaaataaagccagatccggttagtattttcttttttcttttattgttttttactttgaatattgatttcaccatatccccaaatcatccctaaaatcacagaacaaaagatcatctccaaatcccaaatcgatcgtctacaaatccaccatatccaaatacatcacaaataatcaaaacaaatacatcacaaattctaaaaagaaacatcacaaatacatcacatatttacatcgcacagatcaaatacaccacaaattctcaaaagcaaattcatcgcttcaccgctgtcacttggccgccgccctccgccaggccacacggccgccgccgcggccgcttctgccacacgcgccgcctgcaccgccgccgccctccgccgggcggcagaagcgccgccgcggctgcatccgccgctcgccgcgcgcggccgggcctgcgtcggggagggatctgccacggccgcaggggagggggaggagaggggaaggggaggaagagggaagaagacaagaaggagatgagaagatgagaagggaggagaagatgggagaagataagggagaggaggagagatgagtggatgagaggataaggctgttggtcctctcgaggaggcgcggcgcgatttttttttcgtttttcttttgtctcggttgttataagcaaccgggattaaaattggatctaccaaccgggactaaagatcatagaggggtctaacacatcttgccttctttcgaaccgggactaaaaatgatctttagtcccggttagtgttaccaaccgggactaaagatcaaaaagtgacgtcagctttttcaaccgggactaaagatcatttttagtcccggtttttatttaaaccggaattattatggattttgggcaaccgaccaaagatggtttctctaccagtgcagttttcccaaaaaaaaaaaaggaaaaaagaatgtagagctgctgtgagttggtaagaggaatgcatgcatcgctcagcttggaaaggatgtatgtgtacccaactacccatcggtatacacatccactggccctcctcccctccctgatcaccttcccactgcaccaaccatgccaatcatcctgaattcctgattggtatatccttccattaatttgatcgattcacgtgtagctagcttatagttagcccagccagctcgatcaacggcgcctacggtcatacagggccaccactccacagtccacaccaattgaggcagaggacccggctatactcgagctatagctagacttgggacatattctgtgatgatatttgacggcatcaggttcactatagcttttctctccgtggacatcgatggggcggattaggcctgtttggttcccaaaattttttcaaaaaacatcacatcgaatatttaaacacatacatagaacattaaatatagattaaaaaaactaattgcacagttagggaggaaatcgtgagacgaatctttttagtctaattagtctataattagccataagtgctacattaattcacatatgctaatgacggcttaattaggctcaaaagattcgtctcgcggtttccaggcgagttatgaaattagtttttcattcgtgtccgaaaacctctttcaatatccggtcaaatatccgatgtgacactcaaaaattttattttcggcttttcgcgaattaaacatgcccttattttggccccaaggaatcaagcaattcagcggccagcgaccagcggcagcagccgcggtcattccaccgcgctagaattgctgcaactaatacattatatcatcatgcgctcgatggatgggtccgtacgcctggacatatcatcttcgttttctcgacccactgactgtatcatcgcatgcatgcgcgttttttttttttgttttttcagacagaggacgctgacaagcggaaggccatcagataagggggggaccgggtcggccgggcatgaattattgctacactgtattaggccatcaccaatgcgtaaccccaggtcatccccctatccccctccgtccgtcgccgattgctttatcgttggcatcatctcccatgatggaacgcgtccctctgttggggggacgtgtccctcgctcgcttttggcaggggaacacagccgaggggggcgcgttgggcacgagcgtggcctgtggacacctttcctaccgaaaaatttccccttccactcctcgtggccgccggcgacgggagagagagggggagagagagaggccagcggcagcggcgagggagagaggtgtgagtcggcggcgagaaggagagggagacgagcggcggagacgatgccagcgacgacctacgcaacctcctccgccggcgtcgcggcctcctcctcgatgcgacgcggccgaagccgctccatcccgatctggccacgagggggccagatccacgcacgacggcgccggatctgccgtctccggctgccggcggcgccggaaccgaggtcggcgacggtgccggggtgaggcggcgacgagcgggggttttgccgcctccggccggcgacggcgtcggcctaggtcgtgaacccgacccagcgacgaccgcgcgatggagacgaccccgccggcgccgcttgccatcggccaccgcaagggagagagaggcaacgacgagagagggagagagaggcggcgacgagagagagagagagagagagaggggatccggcgccggcgaggtagaaggggagggcggaggaaacggagcggcgggggagagagcggaggaaaaatcggtggagaagagtagagaaagagataggagcggctgtagggaggggtattttcggattttttcagttgaggctacaggggccaggacactcattgtgagcttgagtatcttcatccagttagctcatattttagggagcacatctagagcgtcctcaattgtgagatgagttcctcggagagtgccctcagttagtgagggcatccatagagtgtccctgattatagatacccttactactactactgggaccgtgaaggtgtacccctcggtctcaaaaagaattcaatcctaactacaaagtaggatttgctttttttttaatggagtagtacgtaccaaatggtaatcggctttattttgtgatttcccttcaaatttcctagctagggttataaaatagccattaattggggatgaaaacattcagaaaatggtagcctctacgggaacggttctcggttggtcaagaatcagccatatttatcaatttatttaactatttagtgtcggtttgcaatataatgcttaaaagatttagaaaaatataattttttgtatggctggaatcggaaacgtaccacttttactgaaaccatggtcgattagcaatttcagtcaccatttttaacccctccccctactccattccatgtaaatttcaacagaatttaattgtagttgcgcgccagatctgtgatccaaaaagattcatatgaaccttctcccttttgttattctctaagagtgtgttcaggagtacactttcccagctttcactgcgcatgcttcctaatctacttaaaaaaaccttttttaaaaatatatatattggaatattgctttaaatattatattgatttttaatagtacttaattaatacgctaatctgcagctccatttatatgccggggaacccaatccccaaaacgtataacctaaatttgcctatcaggccattcccaacccaagacactagacatagtttctataaactccacattatcaagaaaccaatactagacactactcttcaatataagcacaactattctatacttaaatttaatgctacttatctcacatgatatctcagatgttgtgtagaaaacatatttcatgcaagacatagtttccttctctttcctcatttattcacttgccacatcatttttcatcttatgtggcagcttatttaatgttatggataccatcctattcattgggttaggaatgtcctcatacggagtatcacactattaaaaaacgatttttcatgacgttgccctataatttttgctggtagaaaaatacgaaacagccagcgaaaacataatgaggggtgggggggctacggaccaccatcgaaaaacaatttttactggcggtcacactaagagatccgccataaaaaacaactcaatttttcgaggcgggcctcttaagcaatcgccagcaaaaattggattttcactggcggaggctaaatgtaccgcttgtaaataaatatacgccttatttaatcttctccactttgccattctcttcttctccactttacccattctcttcttctctgctcgcgagctccactcccttctctcccctcccgagctcctcccttctctccccacacagcagaggtgatgcagacgcggtggcgcggcaaaggttgcggcggcgtgatgggaggaggcctaaccttcccctttccctgacacatcaataagaaacaagctgcagattatctatgttttactgtattattgctaccgggcattatttatatttaagatttaactactattttctcataaataatgttttgaaatcttaaatatatactagtatatagtaccgaagtacgttacgaaagatataatcatgtaacttccatttcataataatttacagttcataataatctaacgatttatagcctcttttggaatagatgacactactacgaaaaccatcttttgtggcggttattttaagtttttgctggtggaatttgaagccgccacaaagcaaaggccagtgacgccagctagcgaaaaaatatctttgctggcagctgtcttaagctagccgctagcaaaaatgaccattttcgctagtggcaccattaggtcaactgccagtgaagagatttttcccaaaaaagaattaaatccacatattcatcatgattttcaaaacaaaaacacctcaacatcattttcaaaacaaaaaaacacatcaacatcaacagattcatcgatagatcagcagattcacatcaacatattcaacaaatcagcagactcacataaaaaaattaacataaacaaatccttcacaggaagcaaatcgatttcacagcagtcagcatgcatcaacaaatcctttacaggaagcaaatcgatctggagagaggcggtcgccgtcctgtcgctgcggtcgctgtcgagccggagagccggagaaaggcgaagggaggtgggaggttggaggcacagagaggagagagccgcgcgccgtcaccgctgccagcacgcgtcgtcaccaccgagacccaccacgcgccatccgctgccgccgagcgtcgtcaccgctgagcgccgtccccttgccactgccgagcccctaccccgtgccgccgccgccgagccccctccccggtctccgccaccacagatctggggggagatggcggatttgggagaggagagggcggatctggactcgtacctatctagcctccgcccatcccgcaccagcaccggcatcctcctcccatcccgcgccgcagcctctgttgtcgccgccgccgcctcccctcccccatccggatttgagagaaggagggtagccgcgcagagaggagagagttgtatgccattggtaggacggaccttctaaaaagagtggcatgctagtggagcattttatagaaaatagtacaaattccagttagatcaaaacgtactacagtacaactttttaacgatgattcttaaaaagcagtcagttgtagagttgtaggtaagattgagcatgcatggcccataccaaatttcaataacagaatcttttgtgcgtagagagagagagggggggagagtagagggagaagatagatctcccctctgccaccccttgttccttctatcgttcaaaacatgagccatatcagactcttgacacggttaatgacattttttttcccttgttccatagcagtatgaaatttgtttctgtatatgtgcattgaaaaaacaattgcagctgtaagcctgaaattatgccttgatcaatttgcaactagtccctttgtttcatatgaaaagatgttttgcctttttataagttaaacttttaactaagtttatagaaaaatatagtaactcttaaaacacaaaattaatttcattaaatatattttgataatatgtttatttaatattgaaaatattgttatgtttttctatgaactgatagtcaaatgacttggaaaaaaaaagttaaaatgttttatagtacgaagcgaaggagtagatatataaagtccggtgaaattattaacacaatatttgtcaggaattggtgacaaatcgatcggtcaccggtgaccgcgcgtcgcacagaaaaacgatcgggcatgcgtgaatggccactggccacgtagctgaattccaaataaaccaaatcttaaccctgttgcctctgggaagtatcgaaaaggatccaactatagacagatcacagatagagttctttccgtttccatctttaccttcgtctttagctataaatctggacacacagttattcaaatttatagctaaaaaatatttatattttggaacgagagagtcctagcggttccatcaagattcaaatcaagacgaagaaaacagaaaacatggaatgattgattttgcattcgtcctaaaacataaacagtagtaccacagtaatttggagtatctcagtagtcactagtcagtacagctttataggtcacgggtgaggaagttcaatctgcaatagttaatcacggaggtgtactcttgattctctccgtacgtgcaggcagatgattaatactattgtgaagcagtgcatagaaattggcaaaacactgtgcaacatctaggaggaagtacgggcaattttggtttcttacaataatatggtagggtaagaaatcaaatgtttggccatcacatttttggtaaaaaaaattgcttttaatcctgactattattgaagttgccaattaattggttgtgcatacttttatcagtccaaaatagctcaagaagtagttaaagcactaattaattaacgagtgtagcttatatttatggcatctatttttttgaatgaaaaatagtaaaatcgtttttacatgtaaattatcacctatttcattgtaattatattgtaaggtttaatatttacattatattttttctaatataccatgtatatagaattagaattaaaagtaatttattatcaactgaaaataggacatagaaggatacttacatatagacgacataggaaagagatgatgaaaaaatgtggcgtcataattttagcaataccgttaataattcatatgtgttactcattacatggtgcatgctcaagtggactatgagttgagtaaaatccatcactggtctctaaacttgtaccgatgtatcatcccggtctctaaactcgcaaatcgaccattcatgtcctcaaacttgtttgactgtgtcatcctggtccctaaacttgcagatcactcgtttaggtcctccaacttattcagttatgtcacccggtccctaaacttggatttgaatatcatctgggtcaaataggacggtataaaaactttatatttaaaaataattcatatttttttcatgtgaactctaatgaaggcaaactttatatcaaatttgtagccctcgacgcgatctacaactttgtagttgaattttttttattgtaagtcattttttgtcccaaaatgtaattttaaaattaaaatttcaaaatctataaatatgcaacaatattttgggaccctaaacagttttaattaaaaaacttttcaactacaaagttgcaggtcacgtcgagggttacaattttgatacaaagtttgtcttcattagagttcacataaaaaagttatgaattattttttgatataaagtttttagaccgtcttgtttagggaccagggtgacacaactgaacaagttggaggacctaaacgagtcatctacaagtttagggaccgggatgatacaggcgaacaagcttgaggacctgaacggtcgatttgcaagtttagggaccgggatgacacagcggtataagtttagggaccggtgatggactttactcttatgagttcatgataacctcactcagtgtaattattcacgtactcgatcggtttggcaaataacttttcttttaatttatttacaaagtgataatatttttgtcaaaaaaaatcatatttttatcccaactaaattagcagggggtaattgttagatacacgatagttagatatacatataacatattctgtcaaaaagaaagtgtgtacatctatacaaaagaacttgcgtttctcgttgccaatgcctcaccaccaaattaaacacacatccatgacaatatgacatatgtcgaggatgaatcgaattcctcactcatttaagttgcacagtatgaggcccatcgatcgagatgcgaattttatatgaaggcccataagtcaatggcgatgacgcccgatgatcatcgggtgggcctctttgatcgtgtaaaccttcagtttctgggcttacctcttgattcctttttgttgggctctgtctgaaactctgaatggatctggccttttcccagctttacacagtacattgaattagaaaaagtacaccgaaggtccctcaacttgtcatcaagttacaaaatcgtcccctaaccgcaaaaccagatatccggtgtcccttaactaatcaaaaccggtcacagcagatccttcggtggctttgacctcgattttatcctacatatcggctgagttagcgtgggacccacatgggccccacatgtcagtgtggccacgtcagcatcctctctctttccctcttctctcccttcctcatatctcactcacttctctgcggcacgacggcatggtgtaggacggcagctcgttcagcggtgcgacgaccctggcgcgggggcagagcggccgtgcaacggcgctgtctggcgaaggatggccgcgtcagcgcagtcgtgcgaatcctgggcggcggtttcggcgtgggctgcccggcagcagccatgtgccgtggcagcgcggcgcggcggccggcgacgcgggggcagcggcaaggacggatgagaatccgaggatacggaggcagcggtgaggagggatggggatccagggacgtaggggcggagaggtagccgtcgagctcggccccggccgagctttgccgccgccaccgctcgctgggcttggtcaagggaggggccggtgagcccgttcggacagtgaggagaaagccatgcccaccttccccttccccacggcgcagatgaatgccgaagaagagatggaatctgagacaggaacgacagcggttggagtgtgctggggcatgagcggcgacaacctgccgccggcgagcaaagtcaccgagatgctccgagagaacggcttcaccgtcgtccgcctctacacgccggacagcgccgctctcgtggcgctcggcagcacaggcatctgcgtcgtcgtcggtgcgcccaactacgacctccccgccctggcgcacggcaggacagccgccacggccgcctggatccgcgagaacatccaggcctacccgacggtgttattccggttcgtcgtcgtgggcaacgaggtctccagcgccgacatgcagctcctcgtcccggccatggagacgtccacgccgcgctcgcggcggctggtttgggacacatcaaggtgacgacgtcgtccgcctgcgccagcctgccgccatgcagctgctcccccgcgcagctgttcccccgctggagcccgtgaagaagagaggagagaggaatagaggtagggaggggaggtgaagaagaggctgatgcgtggggcccacgtggatcccacgctgagtccactgccatgtcggataaaaccggagtcaaaaccgccgagggacctagtttgcactggttttgtaagttgggggatacgttgtatccggttttacggttgggtgacgattttgtaactcgatgacaagttgagggaccttcggtgtacttttttccattgaattcgaaagcaagcattgtgcgatcaggttcaaaatttatgattgaaatacaatttgaatagtgaaaggattatcgagtggtatcttccatgctatggtattgtataaaatacatgattttgacaaaaatatatgtgcagaacagagtattataatgatacaaatagaactcaaacgtcttcctagaaattttctataggattgttcaattctttgtttgaaggtctccctagaaattcccataggattaaaattctttaatttcctatgttttcctacaaatcaaataggtttaaaatagagaattgcaaaatgcataaaaatataggaatgatggcttggttagactgcaggaaaaatataggatggtgaggagagaaaaagactcaaagaaaacttttcatgaaaacatgatgtatggattgaggcatcttatatggatttcatatgatccaatagcgtgcagtcctttatttcaaaggtccgtttaggaaaaaaatgtccattaaaattaaaatcatacaagaccttttgaaacaatcatatagaaaattcacacgatcccataggatatcagagtacctaccgttcatggtaacataaatctaaacgtaaatcccataggattgttcatattcgatcgatctaaattcacacataaatccaaacgtttgcatgaaagcattagtatcattctaacaactgcattagccattttgacgttcgtttcatttcttttctcgctggtctcaccatgttcatgttgttgtcacacattgacttaatttcatatcatccttcttgttcccgggtgaatccggtgaagacagaacttgtcacccggttgaaattagccaaattagccaaatccagtggtggtttgttaccgagaaaaagatttatgagtttgatgacaggagaaaaagatttaaaagaacattcgatgtatagcaccaaaaataacttggtactataagaatttttcttcgaccaaaagcatagactaccagtttttctttaacctatagcacttctgttgtattttgaggtggcgacgttagatcggggtagagaaaattatcctcagtctcatttgccattcgttttccacaccacatacactcatctctttcctgttcctcatctcctctttctcgttccccatctcctcgttctactaagcattatcgcttgaaaaaaagaaatatatgttaaatcctattctggacacaagacaagttctatcttattccatgttctagataagttctactcatgcctttacctagcaggtagctccctttaatccaccgtcgtgagcaagccaccaactgccgctatcgttaagcaagctgccagttgtcgtcgtcaaacaagctgctagctgccatcatcagcggcgtgaccaccgtcgccctttgcccaacgtggaatgccttacaagcaaccgccgccattgccctttctcttccgtggtgtgcgacattacggctctgttcttttggaggggttggtaacccctcctctcttcataaaaaacggagcgatagattaacacacgattaattaagtattagccatagaaaactttaaaaattgattaatatgattttttaaagcaactttcttgtataaactttttgcaaaacgtgtaccgtttagcagtttgaaaagtgtgtatgtggaaaatgagggaaatgggttgggaacccatgagaaagaacacaacctaagtatgatggaacgaacatcagcctaaccatgattgctatgctagacatacatgaccaggggaaaattagtatatctaaaaataagtgctgactcacggctaaacactccaccatatttatggttgtcatggaagtgctatgagtcaaataaaaactggtggtctgtgcttctggtcgaaaacaaaaggttctttttttttgccggattgttttcttcttacgtatcaaattttctccaaattagaggcatcgcccgtccctcaccctctcgaccacatgtcgtcttagatagttgaattgcaggggccatcgttcaacctgaaggtacatgagtgctacaatcaacaagatgagacggaccctcttaacctgtagggagaggccacatcaatagttgccgttgctcttggcactattccctacccctttccttatttcattgtgatatgaagaaaatataagacaatgagcgaaatgatagtgatactgttctttttggttaagatgtagtttctatctcggttttcatcggtacttatttcaaaaccgctaaaacggtgtgttttgtatgaaaactttctatatagaaactgctctaaactatcaaataaatccatttgtaataattaaattttagtaattcatagggcgttaatgcttttcttgttgtacgaatcatcagcttcgaacagaacccacgagcgtcgattttcaatctgacgccgcttgtagatgcattgactgtcctgcagtactgcctggcgagcccaacccccacggccgtgccaagtcgtcgcatcgcaccaggcgatctcgtcgtccctttccttgtcgcaaaccgcgctggcccctctgcaaactcgtctcgtaccgtaccccaaaaaagcccaaatccctcactccacccgcgtgatctcgcaggggcaatccggtaaaactcctccctgcctcctcctcctctcctccgcctcaacgcaacgcgcgtgctgctgcgccgcgccgcgcctcgcctcgcctcgcctgtgtgtctctctctcccccacagtgcgcagcacagcacaggttgtgtgacgcagggaaaggaaagcgggggacgaggagaggggaaaaaaaaggaaggaaggagttactactccccgcaccaaaaaccaggcgccagcagcagcagcaaccagcaagcggagaggagatggagactactactcctcctacttgcaccgcagccgcagccgcagcccaccaccaccgtccgcgcgcgcggctgcctccgcaacgcaacgaggagaagagtcgaggagcccaaccaccacccgagacttgacccccacccgcgactctcattcgatcacgcggcgcccacccacgcttttaccccttcctggtttcctctcccctcctcccccttcccctccccgcgcgatctccccaaaccctagaaacccccctcctccgccgcggcggcgccggcggcggggtgtgacgccgcggtggggggacggggatggaggcggcggcggcggcggccgccgtgccgcgaggagctgcggtgcaagcgctccgacggcaagcagtggcgatgcagcgcgccctcatgcccgacaagaccgtctgcgagaagcactacgtccaggccaagaagcgcgccgcctcctccgcgctccgggcctccctccgcaggtcctcagcctccgcctccgccgcgcggggcacgaccccgcctgcgcggatggcggtcggcaggcccatctccggcagggtcgcgggggagccggtgcacgtcgcggagctggtgntcncgccgctgcggccgccgccacggaggaggcagccggtccacgggctgcccatgggcaatgctgccggcgcgcgcaccgcggcggtgagttgggttccgggacgcgttctagttttgggtaaatccacggtgtgcttggtgctgattgattcgtcgtgccttgtgatggtaggagctggtcgggaggggctcggcggggctggttgcctgcagctcggcggcgggggcggcagcggccgcaacctgccatcagtgccggagggtcgctaataccatttgttgtacaagctgcgacagaagggggtactgcaccaactgcatctcgagatggtatgctccggtatatgttgtgctgttatagagtaaattttagttccccataaggatgatttccgagtagattcagaacaggcttgaggactgaccatttgtaactattattagagaattttattttcagcactcagtttttgtgttctaaaagtccctgctaggtgcagggtagccaccgcgattaagcattagatggtggattatgcagctaacctgccttgggggctattctgctgctactttagtgttatatcgtgtatttttatgtaatatgcttgctaattgcttggaattctctggtcgagtttgccctaggcagagcccttgccgacctattagaatctagcatcttcttcaactatgtgtgcagcttatgattagtatatgatcacactgaaagaattattcctcagaagttgttgctagacaattaatgtttgtgatcacactgcggttagtaatggtaattcccaaactatcatcttattgttcacatagaaaacccttgtgtatacaatgttttttttttttaaaaaaaaaactgttttagggcattctattccaatatgcagccaaagcacatggatattttactagttaccttattaatttcagaagtacaatcttcgccttgtcttttaaaggctaatttttccccatcggctcactcaaaatcaccaaatgcaaaggcaatggctatccggacaccacagacctatcatatgaagtactccctccagtcacagaaaaactgtcctcgttggaagtgtgaagccaaactattgaaaattgaccaggacatccttgtgattatttggccagatttcatatatctagccatctggatacttttggatcattacatgcattatgttgtcctacacttttttaatgttaccatgaactgtaggtactctgatatcccaattgatgatgttcgaaaggtttgtccagcatgtcgtggcatttgtaactgcagagtttgcttactaggagataatgtaataaaggtatttaacctttaccaagagtttttcccttctccgttgccatatttatttattatttttatgctgactgatttttcttaaatttattattttcactcttaaatcacaaggcaagggttcaggagatatctgctgtagataagttggaatatcttcatagcattctggcatctgtccttccagtattaaagcagatttattctgatcaatgtttcgaaattggtgttgatacaaaagcttatggtattccagttcccctcttaacattcttttctgttattttcatccgaataatctcatatttctaacactagcgcaccatattctttgtgtaggacttaggacagatataatcagggcgaaggtcaatcctgatgagcaaatgtgctggtactgtctgttgcttatttttcacaagaagattcttatttctatgctttggcttgtagtgatacctcaaattatcctcgcagtgacttctgcaaagtgccagtatttgattatcaccgacactgcccaaggtgtttgtatgacttatgtcttgactgttgtcgagacataaggcgatctaggaccagtgttgcaagaggagaatatgctgaaggtcgtgtggtagatagaagtaaagatacttcgaataaaagagcaagaatggaaccatctgcagaaagtgcaaatgataagtcagtcccacaacgaagggacataaaaaatattgacattagatctttattccctacatggagagtcaataatgatggaagcattacttgtgggcctcatgaggctggtggttgtggctcctcgaagttagtgttaaggcgaatattcaaaataaactggattagtaagcttgtaaaaaattctgaggaaatggtcaatggttgtaaagtacatgttcttgagaatggatgctcatcctgcaatgatggcagaacattagagttaactggtcatcgtaactttggtgtctcaacatgttcaaataatggtggtattgatcggttctgtgtgttctctcctgtattagaggacttgaaatctgaaggtattattcattttcgtaaacactggataaaaggagaacctgtagttatcaggaatgcgtttgagccttctctgtcatcaagctgggacccactaaatatttggcgaggaatccaggaaatcatggatgaagaagtggatgacgatgtcattgtcaaagctgtggattgctcaaaccaagcagaggttagcaggaaattttagttgctaatttgtctttctgaacaaaagttactctttttagatagaggaatagatttatctcgccttctgcataaggcacgcgaacaaaaaagttgcttcctatttgaattcactgtgcctcctgtttgcactatatagattcccaagtgctatgacttctattctgggatgttgccatgctattaacttttagtgctactgctagtctatttgaatatgaattcatgatcatagcacgtattactcatctggcaaatatgtaacatagaagtgatggattggataactttttctagctaccaagtcttagtactatgatcatctgaacaatatatcctgtgttctatttcttttcaggtggatattgagctgaaacagtttatcaaaggttattcagatggtcacaagggggaagatggggaattgatgatgctgaaattgaaagagtggcccccacccagtgtattggaggagtttctgctatgccaaagaccagaatttattgtcaattttccattagttgattttatacattccaggtgggggctcctaaatctttctgctaaattgcccccagacaccctacaacctgaagttggcttgaagctgttaattgcatatggaagacatcaagaagctggtaaaggtgattcagtgacaaatctaatgattaacatggctgatgtggtaagtagggctttctagattcacttcgagtttcttgtgattttgttgcaaagggaggaggcaagaacatgcgattttcttttagatcctgttcgaagattcgtgctgtcaagcaccagagtaaaggtaaagggtggggaggggaaagagaaggttggggaggggaaagagagggtgctccgaggttatggtaggaagccaggctggcgtgtggcactgccctgtgtgccggttgggtgagagcagtgggttgggtcgaggttgggggaaacgaagaacacaagcgtgaatagattggggcagttaaagggcatcaggggatgcccggatgggcaggaagtggattagggagttgtctgatctgttggatatttatccaatggtcagaaaggagaatgcttgagggagaaaaaaaacatttgaattctaaacagataagtgcatgaaataaaagtcatctgatacatgtgctatttattcctcttgtaggtgcatatgctaatgcatacagccaaagggcatgacgtatgtccaaagaggctacaacctgagcgatctgaaaagattgccaatggaatgacaatgcatgtaaatgctcatgcacctgttcaaaatttgaatgtggatatgggggaacaatcacctgaccatgtaagctcaaagtttgatgaaagagcgcatgcgtctgccttgcgattacaagagaagtcttcagatgccaaacttaattgtggtttcgaaggctcttcaactgagttatcttgctcgtcacattcagaggaaccaaaagttaatggttcagaaagaagtcaggctggttctgtttgggatgtgttccgcaggcaggatatttcaaagctgaatgaatatttaactgctaactgggaagaactggcagctagtagtcaggtagcgctctctgtaatgacatcacaattctttatgacggatattgttgacatatccttgagaaagctatttcatgattatctgtttttgttgcaggttaagaatcctatttatgaacaatctatatatctcaacaagtatcataaaaggatactgaaggatcaatatggtaagcacaaagtacggcatggatgattgtcgcttctaaattggcagatgatttagctgtgaacttatcattactgatatgccatagcatctcatttcatgtagttacttcactcactcctcagactttgtgtccatattccaaagaaaacatttcattgcaataccaaagcaaatagacaatagctgtctaaatttccagtaaccaataagactccattggttctttgcttgaagggcaaccaagtgctgcagtctgctttgctaggatctgcttgctgcctgatctctgatttccgtgctacagtacatgcgcttagtgaaccatgcagaatgctaataatatttatgaggataatctcaggctattgaaatttagttctatcttattaatgtggttctaagttactttttgtgagagccttaatttggatcttgttacaggaattgaaccctggacattccaacaacatatcggtgaggctgtatttgttcctgctggctgcccattccaagtgaaaaatctccaggtgtgattcttccgttcctcgtatttgcccttttattgtccttaaatatttttgtttgctttgtaagtgatcatttagaatatgcaacctaaatatgtgaagattttggataaagcataatttttgctccatcaaattcttaccatggtactccaaacactaattatgtgctcatacttcccttctctgtatggtcaaaagctttcttctatgaataaagaatgtgctgatgtgaatgtcgatttgggtaaacaatctctatggcggttaaaaattgggcaaatgaactataaaaaacaaaaaatgcagggttttcatataatcatatgtttaattatctagtgatttggatgtagacataccaaaagaataaatacagatagaaaatagatgctgggaggcatcgatgcttagggagcacatgataattgcacatggtgttgattctctctcactggagagttaaatcttctcttttttcttcaaaatgtttcagtctacggttcaattggctcttgatttcctgtcaccggaaagtttgggggagtcggcccgaatggcccaggagattcgctgcctaccaaatgatcatgatgcaaaactgaagatgctcgaggtacctgactagtactaatctggttataagttgacttcatgcctaactttcttaggttttggagaacctgaaaaaagttttgtccctgtacagattggaaaaatctctttatatgcagctagttctgctgtcagagaaattcagagaataaccctcgatcccaagtaagtggattatttcttggagtattagagaaagtttcacctgttgtgttcatttctttatgcattgcctgccagcttggaattatatcttgagcaccgtcatcaaattattaaaactttgaactataacatctcgaacaactttgctatttacccgtacaaattataatcagtttccttcgcattttctcaggtttaatctagaccttaaattcgaggatcagaatctaactcaggcggtttctgagaacttggctagagtcaccaaacaacggaatgtaccatgcagctgagatactccatttaaattagatatagcaattgtacatgtattacatggtgtcatatgaaaggaacacaatgacacattctaattgttatcagatagcataagccctcacctgtatattggaattggactaggactaacggctgagctcatgtaaacagaataaacgtggagcaattatttagcattagattgtcagaatgagatttactgggttgcttagagactgtcactttgatacaactaattcttctgccgcttctgggagaaattttacatctgttgactgttattaagtaactttgcttaacatgttgaacttgttacagtgagcaatctgtattctggagattggcactgttttatcatggtgaatgtgcattttctcgaaagagaactagtctccttccattgcagatgaactagcttacgaagtactccctccgtcccataatataagggattttgagtttttgcttgtcctgtttgaccactcaccttattaaaaaaatttgtgcaaatataaaaaacgaaaagttgtgcttaaagtactttggataataaagcaagtcacaaaaaaaataaataactctaaaattttttgaataagacgagtgatcaaagagtacagataaaaactcaaaatcccttatattatgggacggagggagtagtgcatttgtgtgactccaaccatcttgttgctagtgataataagttttgaaagaagtgttgttttaagagatactatgtttgttgagtaattttcaacgtaatttctttttagcgttagtttttaagtcgctacgaataaatacgtaaaaaagttatctatattttaattttattctctaataagacattctggcttattagttaatatgggcaaaggctctaaccattggcaaaatttaacatttaaaacttaactttggagataattttatgatgttttcaatgaaatatattttattgtattggcttttaagttgcttaggactcatctctactgttataaaaattgaaggtttttaccggtactttggtacgtcattcgtgtataagtatgttattttgtgttattatgtatgagtcggtttttaatgtcgttcgcttttggaaatatagaagaacacatataagaaatctctttaaataaacttgcatgctaacttgagacgatcaaactcctaactataagtcatgtttttctaaaaatatatatatccaagtgaattcccacagtgaattttaccttaactaaaccataataacaataataagattaccgttgcattgcatgggcatatttttctagtaaatactccctccgtcagattttggagtaatgtgatactataacctaatacaacgaatctggataggctcatcgtctagattcatagtactaagttatgtcatatccctctaaaaccccttatattatgagacggagggaatataaattaaattgtttttgtcctaataatttgtgtagcttgtaatcacctcatggccaatcgatgattgttaagtctcgtggtaatttcagacacaagtttgaacggttttgctattttacttgtgacatatttttaggctcttgtctttcactttttagttcataggatcttgcatcttgtatatctttttaattacacatggttacagagttatattgtacttatattgagttgtagtgcacttgcactcaattacagtgcacaaaaaatagatgttggaattaatgtttttctctaaatttatgatttttttgacacgattgtctctttttttaaaaaaattcatttaaaacaggctatatcccttggttgaaaattttgcaagattcaaaactataaatttgtccaaaaatcattagttaattccagtttgatttgtaaaatcatgtttttcagcgatgaacttcttcttgttctactactacattttttattattacgatggacatggcgtgaaatcttgtaaaattttatgaaaaaggtacaagtagtgtccacaagtgaaaagaaatcgttgaaactgagaaaaatttcgtcaatattttgaaattctgctatatttttttctaaaaaaaagtttgaccagttaacctagcggttcaaaattttgaaattttgtgaaaaatgtaatagtactagcaatttaggcaattgacgaagcttgggacaggagcagggtttacattactggttgaccactaaatttcgagcactattagtatcgcggtttccaataaatttcgatcagatttcgataaattttgattgaatttcaatcaaatctactgtttaaccctcaaaatttcaatcgaaacttaattccgagcatgtcgctcgcacgccacccccgaagaatctggagagatcagccttcgcttccccccgaacgccgatgggcttccgcctcgcccacctcgccgcctgcgtggcccgcgccgcggcctcctcctcccgcctccgggggccacgccccgccgcctccgcgctcgtcgcccctctcctcgcctcgccgtgggagccgagcggcggcggccagccgcactggctcgtcccctcccgcggccacgtgggccactcccaccaccaccaccacggcgaggaggtggggggcgaggcgtcggagaggatcttccggctggggctcgcggccgacgtcgtcctcaccgtcgggaaggccgtcaccggctacctctccggcagcaccgcgatcgccgccgacgccgctcactccctctccgacattgtgcgttgcctgagccctgatgacaaaatcggtgctccttttcggcttgatttttttttttggtgctgattgtgcagggtttttttgagatgtgcaggtgctgagcggggtggctctgctgtcgtacaaggcggccaaggctcccagagacaaggagcatccgtatggtcagtctcccaattctcttctactctgtgatcctcgtttgtatacggatgtgattcttggctatggtggcaggactgatacttaggtaaatgtcatgcattgttctaagctcgtggcaaaccgagggtccaatagatactaattatctaattattgactgatatactaattaatatgatgtaaattaactagaattgaataatctacctggggacctctgaccccaggaattactatgtagtaacgccacttctaagaggcatctgtctaccaatttatgggagttttgcaattagttaactgatatactgactgacaagacgacaatctcctgttcccacttcctttgttgacataggcagtttacttgcattcataatggaattgcagaaacttagctccactagaacataggctgttactagggtcatgttttatgtgttaaaactgttaagaatagtcaaggctcatatatgatgattagcctactttttgaaagaaaaaaaaaagaatatgaagggagctgaaatccgtcagttgtttacagtatggaagctattactacatgtgcttgtgcgttattgcagccacatgcatgttcatgtgtgcaacaagatataaatgctagaaaagttagtaagggcattttcttactgattctcatgttttttctaagctacctgaattgcttgcgttataataattattaaagtctacatagaacagcctccatgcctatttgatttattgtcttgtttgattgcgctaaaagtgttgaagattccatgtcttattttgcttcccttccaggtcatggaaagtttgagagtttaggagctcttggaatttcaagtatgttattagttactgcaggtgggattgcctggcatgcttttgacgttcttcaggtctattactactcaatgtcacaatgtcaagaacactaaatttatgtttttcagtgatgttgtccttttttcttatataatttctgtttttgtaaattagtgtttggtccctgatgacatatactcccatcatacataattacacatggacttcacatgttgaagtttgtttatttcagggagttatgtcttctgctccagatattattggcaatgtatcgcatgctcatcatagccatggtagcagtgggcatcaccatggaatagatttggaacatccaatccttgcattgagtgtgacagcttttgcaatatctgtcaaagaagggtaagtgagtgttttctactgtactcatgctgcgaaaactgtgtaagtttttcttttgttgttctaccagattttacaatcttatcttatgtggtgtacttcttgctgttttcagctactaagtgttattcgctacccttcttgatattatttttgcctaccatgattttaaattttatggtctcctgtaatataatgcttgtaattcaatggcagaagtgtttctttgttaactttgttgatagtagaatatatgtagctctgaacacctgacattatgtttctatgttttggctaatgattatttttctatccgtttatatccatagcaggtagcagcatctccttaaaactcttctgttttaatctgaatttattttgtttattaatgcacagttaattatcatgcgacaaatcacataagaagatctgaaagtgtaaaattaagttacggtctggaattacaggctctattggatcacaaaaagagctggagaaaaggaagggagcgggctgatgaaagctaatgcatggcaccatcgctcagatgctatttcttctgttgttgccctattaggggtaggtaagaccttaaatgaaggcctgaactcccattttctagtaggcaagttttcttcatgttttagatcctgaatggtagaatgatgcattatgaaccccgagctagaaatagcatccattactccctgtgtacagtgggggactgttggctttggaaatagttgtatatgtatttgacctggagtttttatgcaattgatatgagagcactattttatcttgtagttagcagtattaagaaaaatcacctggtttataaatttcaccttgaaggtcttacagaaattacagtgtttatgttaagacattgttttgtttttcaggtggctccattcttggagttccttatcttgatccactagctggacttgttgtctcgggcatgattcttaaagctggtgttcatactggatatgagaggtaactctctttttattgtcaagcaggattgtcaattgaacttgttttgtcagtcagggttttcaatttaacttggtcatgatgagttcaatgatattttgtcaatctcaaatcaagaattgttttctactcaaggaatattttgttacgcattagtgtttcttcttgtctaattaattaggaatgtttggattttttttttttgctgaaaatcattttcaagaatgaaagaaatttggtctgtttacatttactgttccttgtttagtgctttacagtcttcacctttagaagtttatattcaagcagtagtggagacagggaggggcaggaaggggtctcgcctcccccaagcacactatatttactgtagcttttataaaattttaaaccgttagtattgttgggcccctccaactaataaaatccagtgtttctgctccgccactgtattcaaggctagctttcatgatgctacttgaagtgatgatttcactgatgcagtgtgctggaactagttgatgcagctgtggatccatcgcttctacaaccaatcaaggaaacaattttgcaggttgatggtgtaaaggtaatacagcctggataaatttcctttgtgccatcatgatttttaaaatgttaaaccgataagtcgaaaacaatgaaagtattgaaataattctagggatgccatcggttgaggggaagaaaagctgggacctccttatatcttgatgtacacattgaggtacatggcattgtgatttagtttattgctttggtatttattttttttggatttcaagatgagagccctgacagttttgtaatgtgggtgcttaggtgctaaataagagaaattgattatgatatctgttgtattgtaggtatatcctttcttaagtgtcagtgcagcacatgatattggggagactgtccgtcatcaaatacaaaagtcacacaatcaagttgctgaggttttcatacacataggtagcctgcaacctttaaaccagaatgctctctaaccatttggctactgtacgcattgagttctttgcatgtactaattggtatctctagctttttttttaatatcgcaaacccgtatatacatactgcctactggaatgcatttcattatgtgaaacaagctattattatatgttttgggcagctaccttgattgtgcattatcttattttagtccaatctatggtttgcgggactgctactagtatgcatacttgttcaaaaaaaaaagtgtataaatacatcttttactcatagtactacgattatgtaaaactgttagacacagagaatttagtgttgcaggcttgaaattttagagttctaactcttgtggctttctgaaaagctgttagacacatgcagtttgtattgcaaacgtacagttctgaagtacatggttgtgcaattaaccacgagacatggttgtgcaatctttctcatggttaattgcacaaccatgccaaaacccacagcaggaatatttatgaagtacatgcattgtagatccttcatattcagtggaatccaacatggaccaaaaagggatttgggagaatatagagagaagaaactcagatgctatcccacgacaacaaacggcagaagccattgtgtcttgtataatttcctcccatttctcaaaggtaaatcttttcacagtccatgacaatgcgaacacctccctcctgcatctactgaaaccatgatttggtgcagaaaatgtcacttgaacacctaatgctgcattacttgcaaggacgagtgttacttcaggtcgaagtttcaatgtctccagaaattatgatccggtaaattagctcttccatttctatcccaaatcttcaccttacaagtttctaaccctgtgttttttttttctccaattgctcgacccaaagggatgcaatggacattgcaaagcaagcggaagaggagatactgaaggctgattccagcataagccaagtaagcgtacagctaagattgggccagcaaattaagcaacttaagctgccaggaggcaaaaatagagcgaagaatcaacaggcacaaatgcagtagcgtcagctacactgtcacggttgattaggctgttttttttttcttttttttttcaaacattattcgatcgacttcgcttgctgctgagtgctgaggcagtagactagttctagcttcgtacagagtgatcttagcctgttcaggcttcagagatactactatggagcagtatatatatatatatatatatatatatatatatatatatatatatatatatatatatatatatatatatatatatatatatatatatatatataggccactcatatggggcaccatggtgcccgggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatccataaaggttttactataataataatgtagagagcagacatgcttagagatggctactggaagagactacgaccttaacgaccggctgtgaacttccaatgtataaattgcccgataccaggagaggctgctgctgcttctcctttgtatcgcgggaacacttgttatttcgatgaaaatttgagtaatctaccaactatactaccatacgaggctgcattcatattttgatctatattgcacacaagttggcatgtttttttgcacccagactgacaaaaccatgcatgcaactggccagatgcgctaggttgcacctcggtcctgttcaggattatggattactgtgacatgctttttataagcttctaaaactctcttcatcagcatatcttagagagcttgaaatcaacttaattatcgactttctaattcattcgttttgtgttattatggaacaataataatcattgtaaaaccagcttcagacacatcgacctcgtcattggcatcccgatcatgtggggtatgatagtctaaccatcatgtagggtctactcgtacgcacggacggggtggtggtctggtggcgtcggcaaccacccacacagacggacacaggctgcctccaatatccatctcgtccctcatcacttcatcagccggacggagctcctccgacgtcaaaaaatgattgttccaattttccgttaatgggtcggtccagcaatggcaaggatgccctagacgagtttgttatcgttcgacttctgagctttgctgttgcttgcttgcttagcgttgccgagttgttgctttctcgactatggagctcggctcgggatgatcggcgacgtgcagagactgtgtggtggattacgcgtgctagtagctagtagtacgcacgtgtaggaagctgctccaactgcctagtacaagtgtaggaggttcctctaacgtacgagagatttgggtcacacctgtcaattctaaaccggtcagaaactttttatattcattgatttaactatagtaacgataattagaaaaataaataaatttggtactcctatttgactagaaatagaaagtcacacaaatagtcagaatcaaaatcaataccacttgtacgaaaaccatacttaagtcagtcgggaatttccttccccgttttcatcccaccccacaaaacgatagcaccgggacaggagaggagaaatgaataaaagaaggtatcgcaccgagaccaccattgcatgcaggtgacacaactcacaaactgtcgcataacaacattgcattgcatggtaagttaaaggacggtaaaatggatacagccacttgctgctcctactatcatcatcaagctaagctaacatatccaccatggatgatcagtgcatcatcaacgagaacattaaaaaaagaaaaccctgttgttaatcacagaatgaatttctctaaaagtacggtgtactgcctctctcgttcttttcctctcccggtacaagagccgcacctacgcaaagccttcacatggcagcaacacgcaactccctctaaactacagcagctcacctttgcatatctccctatctgcataaaccgtcgcttccaacaatgtcacctgatgttcttcttccttcggcaaggctggtgtcgatcgatcactctcacaatgccgaaatgggtgtcttcctcgtttgtcatctgcgggcaccagacaggcaaaagctcattgccgagctccagagtgcatgctcgacttctcggtgtcgctgctggtggacacggaagctgcctccttggtggacttgcgagctcgctgacgaggcctgctcgagccagtggggtcagccttgcgcttcccgcttccgaggaggccaaaggcgaccgcttcaagggctcttgccgtgggaggcctgactctggttccttgcctccgaggattcattgcctgcgaagaagcctgaagatcaggctgagggttggcaggtcctcctcttgttgcctccggggcatcatgagcgatctcggtgtttgaactggaagtagtctccttattcttgaggatgctaccatggttgtctgatgaaggggcgtgcgcaattgtgacagtcttatcatcctgcggtgtttctagtttaacctgattagccaccaaatcactagactgagctactcctttggcaggttttgtatcctcaacggcggtcttcgaatgaacagaagccagtgtatctaccttatgcccagatggcttctcctttggccttgccacattcatcttctcatttgatctgtcattggcatgagagtttgatgcatcctttatctgctgacatggcttctccttgccagaacagctcgcaagtgatttggattgaaaactaccaccaacatcaatagcagttggttttgatgaagttgatggcagcttgactttctctttttctaaaccggggccttttgagaaagaaaagctgcgtcgactggtctggtcattgctacagctagttagtcttctgcgcttcgtcactggggataagtacttgcgcttttcaattttagttttctggggaaagaagcttgtcgcaccaattgtgtcaccattgccattagaagaatggccattaactggaaaaactgagcatgatgtagcagccatatttcgaaaagagtccacttggctttcattgtctgcattcttggatgaaaccatttcagtgccattctcatcagctgtaactcctgcgtagccttccttgtaatctgatgatctgtcatctgtgtcatgttcgtctgaggaactatcactcaccatattatgtgtatgacgcaaagggccaaaactaatatttgcatcagcaggcaagttcctcagctccctcacttgcgagggctcttccccttggaccaagctagtatcgattattgtaaactttggaagctcgtgatagccatcgaaaggaacatcttggttcagtttcatggctgtgtcaaagccatttttctcagcattaacaccattgcccattccatcaacctctatctcaagaagaacagggtctgctaccactttcttgaggacatcactaacagaatcaaaataatgagtgccttttgtaagttcacttcttgaaaacctttgaataccaggcacaatgaatacaaggcaattcttcgttgtgctgacatcatttggcttctctgagtgccaccctcttgcaagcaaacgaggccagacagcttcccaaaaaagatcatttgatcttgtcttgcttcttctgaaatcacccgttaagaatttgattatatcttctgaagcaagagaggaacaatctttgcctgcaggcatgccgggctgaacagaaaggacttggtttggtttggatgggtccaaaacaaaaccagtcaaatcatccttccctttaccgatcgcaaccgcctcaacaaaagcttctattccaacaacagatttcagatgaaaaacaaaatccattaatgatgtttggctgtcgttgaaagatttgaacatctgcaacatgaaaaaaacaatgcaactcatatagcactgattgatagaaaaacattatctattaatatccataaatttgaaataacttagttctgtgaaattaaactacgtaaagttccttggaccattgcaaattgaactccttgtgtgtactcatacttggagagcactagggttttttgtctttttggaacagctctaccttaaaaagtgcaaagagaatacaattcacaaaaaaggtagatcaagacacagaaaatcccaacataatagccaaatgaagtgtactgtgcacttgcttcaattttcaggtgtaacatctatatttataactgaaatcctatagtaatagttgcaatagagtagttattacactctgatgcaagatcagccaaaacacatgccatgacacttggatagctctccatatgattaagtcaagataactttgttcattctatttatatggcatatgatgaggtgagacttatacctacgaaaataggtaagagattaatctggttgacataacttggcaagaatctaaaaagagaatctggcttgaaactaaaacttcaaagaatggaagtgttttccattataacaagaaatgctatgagaaaaaaaaaaacagtgatggaactggcgttcagactaacagaacctcatttaatcatgagaatagtatcatgatgaggcatctcaatgtttaattactcggtgcatagatagaaatagaagagccgaataggtgatcaaagtatgagtgataattgtgacgtacctcatccaacagatcatgagcttctttagggattttagatttaaggcgagatataagctcctgccttcgccaacctataaaaatgcgttccccaagaatgcatctccttatttttgcttttctgcaggctgaccatcttttatatgcttctcctttgtagaactttccataatagtaggaaagcacatccccaacagtcttactacctacaaatctgctcaacacatgcagatttttgccaaaaatatagaggccaaggagcaataattctgcttcctgatcactccaaatggaagtggatgaattaggcactggaataaactgttcaatttctccttgatctgccatggccttatcagtgaagtttagaccttcttgagtggaacatggagccaatttatcatcgtgtgcttgatgactgtcagatactatctgatcaggtagctctggatgcggatcctgagatgttgaacactgtccacttgtgttattactggttgggcaaattgaggtcgtttggctatccccatctctgctattttctatagccttggtttctgaagaatgctgcttttgtatttcctcttccttcttattgaattcacttggtaatgtccacataattggtatagggcaatcataaccaagtgccatgcaactatcagttgtgttgctcatgtactgacgacgctcatcctctgtggcaagattagggatctctgcttggtacgcttttccagtgcatatacgtggtggtaagtcgtcatctgtagcatctgattggtgtccatcaccgtcttctggctcaagtgactccatctattaaaattacaaaaaaaaagaacatttgtaaaacatttcacattgatacaaaaaaaagtgcattatcacttcaccatcagcacaaataattaaattgtcaatgtactttcgaattatgaatcagaaggatgcatcatcaacacagctcttctttgttaacacatggaaaaacaaaaacagctaactgcagtaagttcaacgcatgtaaaatcttcttcctttttaagcccaagtctaatctcctagaactcttatatacttacatttttccctatgatgcaccatcttttggcatctaaaatatactgtatgcaacagaaaatgaccaagtactaatttatgaacttggcagttagaaactgaagcagaaacatagtctacatggcatcaataatgtactatacctaactgtatctacagttctacaaagtccctgaagttacccattctcatgaaagattgataatagaaaacaatgctttataaaaaggggttaaattttcccagcaaccacaactcatttggaaaaaccttgctactctcacaattgcagcaaagttcccctgtaatgcaaacatccataatgcattcaaaatgccgcatagcagacgaccaccaaacttactttccgagccccaaagctttcggagactcgtgcgcatattcgcatcgtattgccggcagcaatatggcttgcaggaagcaaaccaacacaatgtctgtcatgtataaccactggctgagtagggttcatcgttggacataacccacaggcagaatgattgacgaaaagaaaagaaattttaccagccacccaacagattgaattactcgacatcaacacaaattgctcactggcaacattgcatcaaagagtgcaccatggctagaacctatcaagattgctcgcggcatcggcgagggtctcgtggcacacagctacaacccaaaacacgagtaaaattcgagccatgttggtagatacagggtcaacaattgcattccgcgaaatctaaggcccgggcacggtggcaacacaccaccacccgcgaccaacccacccaatcccacctcccgcggcggccgcatcccgtcgagcacgagatacccaggcgagccacgcccacgcgcgaccacgacacggagcagcaacgggggcctaatccatggcgctccaagaacccgcacgaacgactagcacggacctaaaagaaaatctcggggggaagggatgacgtgatcacggaaggaaaccacccacccacggtcaaagcaagaacacgggcggacaagcaaagcagcagcagcaggcgaggcgagctaaagattggagggagggaacaagagcgaggcgaggagaggagaggagagaatcaccttagccgcctccatgtccatgtccatgcacgcacgcgaagccgccaccgccgccgacgccgccctcctcccgagctcccccccccaatctcccctcgcgccaaccgccaagaaccccacgcctccccccctccccgcggagcagacggcagaatctggaccacgcgcacggacaggagagagcccccacagccaccacccccgcgcggcgtgattccggacgcgcagggacgaggcagcgccgccccacgcgacgttgacgacgacgacctcgagacgcggtggtggtggtggtggtggtggtggttcggggcggaggcggaggcggagacggggaggctttaaagaggaggaggagcaaagagagaagaggagacgagacgggggccgaggcgagagaggaagagagaaacggtgacagcgagcgactgctgcgagagagattggtggtggtcacgccgcgcacacaccccccgccccctcgtgggccgctcgctgctggtgggctgggcttgggaggctgggccgtcctccgcgcggagagcgtgacgaacgtggtgggtggggtgccgcgcgtggacgaccgggaacccgcggacggacggacgctgggccgcccttcccgtgtgccgtccgcgtgcggatgcgggcgtgtacgccacgctatagctgcagccgcccagcggttgaacaaggggcggatcccgggggaaatgtgtgtggtgtgtgtgtgtggggggtggtggggggggggggtgttggacactttcaccacaggttatgtgagtttacgtgaaaaaagaaatgtattcgacataaacgatgaaatctcgatagaattttctttaccttgtgtttcttccataggttatgtattacgtgaaaataaaaggcattacaatcaaacggtgaaaacttgatagaattttctaacattgtgttttggagctttcttcttcattgcttggacgatggttgatgctggtggacgctaccgccgaaccaccggcttacgagttacgacaggtgctcgtcggggcttggagggaggcatcggttgctgcgggctccgtctccatgtggggtggtggccgccagtggtcttctggtccatagtgaatccgcggcgtggtggcggcactagtacgagccttggttgacggatctatgcggaggtaagaggcccttgcaggtgggtcttttttcctcacaagtaagaagaatgttgtcttagatggggatggtggaggttaggtagaacttagtttatatagagatgaaggggatcggctaggcgtggtgtttagcagatctacaaagtgacaagaagcccttgcgaatacgcctcgatcctttgttcttgagtgagaatgatggcgccttcgatggagatggagataaggtatctacaaatgagtttatatagagatgaaaaggatcagctggttgattggatctacatcaaatggctatccaaagagattaaatttagcatcaaataaatgggcatatgacatccaagaatggccgtcaacattcattttattttccagctctaccgtttctcgagaaaaagtatggttgtggaaatgattgatgttggtttccaaccaatatcacacctacatgtgggcgaggggtagtggtgttggccaccaacagtctttgggtccatgatgaacccacgggtgaggcggaggtgctatgaccaccgtcttactggttaagactaataaccaccttcggaccaacaacttacaggttacggccggtgtttgttgagcttagagagaagcgttggttgttgcggtctccgtttccatatgaggtggtggccattgacgatattttggtccacaatgaacccgttgcatggtggaggttctagtaggtgttgtggtcgacatatatgtgtggtggtaagaggctcttactggtggaccttatttcctcctaagtaagaataatgacgtcttaggtagggatggtggagatttggtagaagtgtgttcatatataaatgaagggaattggttaggcgtcatggttagggatctacacggcaacgagagtaccttgcaggcaggcccacagccactccacacgtgatcccccctccctcgtccggatggagcagcgtcctcgatggcaacgacaccaccctcgatgtggtggtggtggtggtggttcgaagaatcagagttgaggtggagacgggggctgaggcggagtcaagagaggctttaaagacgcgaggagcaaagaagaggagatgagatgggggctgaggcgaggcgaggcgagagaaagagagagaacagtgacagtgactacgagagagattggtggtggtcatgccacgcacatatgccctcgtgggcctctcgctcctgggataggccgtccgcgtgcagagcatgacgacatcgtgccgcgcgtgcacgacctcgaacctgcaaatgggcgttggctgcggctgccttcccatgtgccgtctacatgcggatgcggtcgtggacaccacgctagttgttgcagccacctgatggttatggcttcgaataggcgacggattcgagggcaaatgtgggttcaacacttccatgggttatcagctatttgggtttacttgataaaaatgtatttgacacaaatggtgagatcttgacaaaaaaattttgacctgtgtcttggggctttcttctccatctcttggatgatggttgatgccggtagccattgtcgccagacagcggcttaccggtcaagaccgataacagctgccgaaccaccagcttacgggttacggctaatgtttgttgagacttgtagggaggcactagttgttgtgggctccatttccctattgagttgttgccgctgaaagtctttggttccataataaacccacaatatagtaggcactagtaggtgtcgtgttcaacggatctgcaaggtggcgagcttttgcgagtggtccttctttcctcccaaagtacgaagaatggtgtcttaggtagggatggtagatattgggtagaagtgagtttatatagagatgaaggggattggctagccgttgtggtcaatggatctacacgataatgagaggctgttgcaagtgggcctcctttgctctcaagtaagaataatgacgtcttaggtggagatggtatagattaggtctagaagtgaatttatatagaaatgaaggtgaccggcaagacgattggatctacatcaaatgactatcgaaagagattaaatctagaatcaattaaatggacatatctatctaaaaatgcccaacatcactcattttacttataaaaaccccttagctttcacatggtggtggttggtcgagtccatggtaactcgacgatacggaaaggtgcaagaacaccatagcctccatgtacgtgagcaaccttcaccctctattcaaggccccatagatcgaagcccctacctaactccctcccttgtggcctttttttaaccgattgaaccatttgggaatggtaaaccatcagaaatagaaaacaaaaggataaaccattgaaaacataaatggtaaaaaaaacaaaaatgtttgtgttgtactaccaaatgttttcttggtttatcatattttttacatagattattatgcttctaaatactcccaataaccatggcccatgtctccatttggctcgtaggccaacaggccatcaactctcattcatgttaagttccacatgtgattttacattcaatgttttcaacttgaatttccattctttgatcgatacaacatgttctaccctaacaaatttgtttctggcattttttccattttcggctctaccgctttctgagaaaaaaatgatagaggttgtttttcaaccattttcaggcctacacgtggaagaggggtagtgatggtggttgctgacgatcttggtccatgatgaacccacggtgaggtggaagggtagtggtggtgtccgctagcggtctttgggtctataatgaacccacaatgaggtggaggtgataggattgtgcagtgatgagaggcccttgaaggtgggcctcctttgctctcaagtgagaatgacaacgccttaggtggggatggcaaagattaagtgtagaataagtttacacagtgatgaagggaatcaactaggtgtcgtgattaatggatctgcctgagaggcacttgcaggtgggcctacttgccctcaagtgagaataacgattccttgggtggtaatggcggagattaggtctaaaagtgagtttgtatagagatgaagaggaacggctagacggttggatctacagcaaatgacaattgaaagagaatcaatttgttagcaaataaatggacacacaccatccaaaagtgcccaacaacatttattttttacttctaaaagccatgcatatgtgccatccaaaagtgccttaaaaacatgcattttgcttctaaaagccaagtggcttatcccatggtggttcttagcatggttgcattgttggttcggagcagaagcggtgggtggagttacacctttaaagacaacacgtggagcaaagagagaatgaggcggacgagagataagatggagagagagaatggtgacaacaagcaagagaaagaggcttgtggttaggacagacggtcttgtaggttgttgggctaccattgggccgataacatcgtgggttgggccggaaaaggtggtggaggtgatgcatgtgggaggtaacagggttgtgtggacaatgaatggacattggcctttattggtgttaacggcaaaatttggcaatttttgttagtcaaggttgagtcaaagatggtattcacgccataattttagttgatttggttagcaagattatccacatttttgtaatgtacttccatgataaggaatatttttaagtttctatttctatagatagaattctgggccaacggagtcatattaagatcgggctcagataagtttttcttttagtttagctgattagagtcgtgtctgaattggagttgtattagtagtttccttaattagagatagagtccttagttgatccgatcgtaatagagtcggacttagtataacctatgggtataaatatgtacacacaaggtctttataaattaacgacagttcaatatataacttttggcacatcgtcaaccctagttttactttcgacgagttcttgttttcaagtttaggctgcatcaattttgatctcccgcgagaaagtaagttccatcaacttcgcttgtatcggaggaattaatactttctcagttaagtccgatatactagttaagctttgcttgcattgcctattggatatatcatgtctttctttgattgttcatgccattattattagggtttttatatcaatcactatcaaaagtatcaatcaattaggttagatctaccaaacttgttattgatctagaactatcttggttaagtccaatcttctaggttataatctgttagttagatttgttcaagtcaataaatacttgatatagtttaatcgaaatattagccgatgagttatctatttattataaattaatctactgtatcgaataatgcataaattttgccataatcggttaagttgttatttttattagtttcaatcttatactgtctcggttaggcccgatctatcaagattgtgattaataaatttagattgctaacaattataagctgggatagcctatattagtttgtctacttaatgagtaatgataggttttaattgatattatggtacatcagcctatatttagggacaaatataattgtcaaagtgcttattttatcactttcaatattatactgcctcggttgagtccgatctatcaagattaattgtaataaagttagaatatttacaagcatatacatacatacatacatacatgcatacatacatacatacatacatacatatatatatatatacacacacacacacacacacatatacctagactccggccgatgtcattttaatccttcatttttttttcatccattggttatagccgatcgatccgaaattccatgggcattggttgggcactcaatactatatcagccctatggctgatcggccccacgatctaatcttttttgtttttcttattaattgcagaatcaaactaattagcacgctctgaacccaatttgataggacatgcactatagtaaaataaatctctcaagccttcatatgtgcgacgaatttcacgtcaacaactgcatgtcatccgcatgtagatgtgtattctatcctagtgcaaccgaggattatagcttcgagctgggggtgggtttctctactaatgtaaaagcgaagttgtcgtgttgcaattccctcccagaatgcacaacacccacgtacgcgtgtgtaactctcggatcgaatgccttatcctcaatcacactcttagcccatccctaattatatgggcctggcccgctacaacatatggtatgttactagtaagggaaaaagtgggacaactaggtgtgtgcttcccactttcgcgggttatgtgtgatgcattaaaaaaatgtatttgacacaaacaatagagtatcgacatgattttctaacctcttgattgtgggtctttcttcttcattgcttgcaagatggttgatgttggtggccgcctccaccagaccaccaccttaccaatcaagactgatagccgccatcagaccatcggacaaacaatgtgtgggctccatttccgttggaaaagtgggagaaccgggtgtgtgctccacacttccgcaggttatgtgtgttacataaaaaaatattttggacacaaatggtaaaatctcaatagaattttctaacctcttgattgtgggcttccttcttcatcgcacagacgacgattactactggtggctgctaccgccataccaccaacttgctggtcaagactgataaccaccgctagaccaccagcttacatgttacgcccagtgctcgtcggggcttggagggaggcattggttggtatgggccccattttagtaaacctgcagcatgatggagacactagtaggtgccatggtcgatggatccacacgacgatgggaggctcttgtaggtgggccttctttcctcccaagtaagaataatggcatcttaggtagggatggtggagactaggtagaagtaagtttatatagagatgaacgggattggctaggtgttatggttaacgaatgcacatggctatgagagtccctttcatgtgggcctccctttctctaaaatgagaataaggttgtcctagatgaggatggtggagattaggtctagaagtgagtttatacagagatgaaggggatcggcttgacggttggatctatatcaaatgactattgaaagatattaaatttagtatcaaataaataaacatatgccatccaaaaatgtccaacaacattcattttatttccaaaatccaagcaatctatcccatagctttgcaagccctacttttgtacggggtgatgactggtctttgagtccatgatgggtcaacgatgtggtggaggtgcaagaacatcatagcctccatgcacgtgagcatccaccaccctctacacgaggcctcccacctcaaaacctcaacccaactctgtcccttacgcacatgttaagattgaaaagcgccggtaagtcttcattgagtagctattgctccccctttttttcacctattggaccttagggaatggtaaccgtaaaaaatggaaaacataagggtaaaacatttgcaaatggaagtattaaaagactcgttagcttcctcacttgcaaggcttctttcccttggaccatgttagtatcaattactgtgaactttggaagctcgtggtatccatccaaaggaacatcttggttcagttttatgtctgtatcaaagccttttttcttagcattaacaccattgcccatttcatcaacctctagcttaagacaaacaagatctgctactactttcttgaggtcatcactggcaaaatcaaaataatgagtgccttttgtaagttcacttcttgaaaacctttgaataccaggcgcaatgaatagacaaggcaattcttagtggtgctgacatcatttggcttctctgagtgccaccctcttgcaagcaaacgaggccagacagcttccccaaaaagattatttgatcttgtcttgcttcttttgaaatcacccgttaagaattcgattatatctcttgaagcaagagaggaacaatctttgcctgcaggtatgccaggctgaatagaaaggacttggtttggtttggatgtgtccaaaacaaaaccagtcaaatcatccttccctttaccgattgcaaccgcctcaacaaaagcttctattccaacaacagatttcaaataaaaacaaaatccattagcgatgtttggccgtcgttgaaagatttgaacatctgcaacatgaaaaaggcaatgaaactttcgatcactagggtttggaggaagatgttggttgctatgggcttcattgtcgcgtagagtggtgactggtcttcgagtccatgattggttgcagatgttacggagatgttaggaggtgttgtggtgaacgggtctatattacgatgagaggccctggtgggtgcgcctcctttgctcccaagggagaatactggtgtcctaaaatgaaattagctctaggagggagtttatatagagatcaaagttatcagcttgacggttggatctatctcaaatggctatcaaaagtgagtaaaatttagcaattaataaatgggcacataccgtccataaatacccaatttcatataatttatacttctaaaagctaagtagcttaccatgtagctttgtatcccgcgactcttatacaaggcggtgtccaatctttaggtataatacgatggaggtccaagagtatcacaacctccattcattttctatgccttgcctaactcaatgtttagtgacatatctataacaaatttaagtaccatataattcacacatatctattacgtttgagtccgcgtatttaatcgatgacatctttttacaaaagttaatcagcttagcagagtgtatttgatttgtgatcatcctttatgtgtatcacggaaacctacgctagtgctatatatatgtcacatacacaattattttgttttgagttggactagtcacacaaattaccgtgcttcatcaacgacactttaatacgcaaacttaacacaaaccccctcggcgaccggccgcccacacgcatctcccaactcgactcgacccaacgtcccaacccaagccggtcgagttcgcgttcgcgtcgcaccgcgtcacgtgacgaacccgatatcaaaacccccgccgcgcccgctcccgaaccaaaaccctcgaacccgacgagtatcccgaccaccactctctctctctctctactctccctcctcgccgcgccgcgccgccgccgccgccatgagcgcgggctggaggacgctgctgctgcggatcggcgacaggtgcccggagtacgggggctccgccgaccacaaggagcacatcgtgagcgccccccccccccgtttccctcccctccccgctcgttttgttctctcccccccgggggggcctcccgcgcccgaaccctaggttttcggcgtccggatttggggggcgtgcttgcgttggttcgtgcttgagtgggcgtcgttcctggttgcctgcggtagggggagtgaggcggtagtggtggagctggggagctcaaaaccctagccacctgttaacaattgctgggcgcttggggtttgggtgtgtggagcggagccgtgacggtcttgtccggatgatggagatgaggagagtagtaacaacaggaaggacagaacgacgtgttttgataatttgttctgcataatttctaccatttgaatattggaaaatgtgtgtgtgtgtgtgtgttttaatgatgaaaacagttcaaggtagagagatcaaaattgaaccctgctaaagtacttcacagatgtagtcacaaggcaatgcacatttggaagactgtagtctgtaaatgcacagcaatcttgatgtgctttaagtgttgttattacactatgttccagcttctagttgaaaaggctctttttttagtgaaattgtggcgctatgcatggtagcatggaaggtggtgctgtaatgtgttgatgcaattctgaactttttactcttttatatgctatatgtgttgatggcatgtttatttgagaaccagtgcaaccaatggacaaatattctagtcaactaatttgaccttgcttacattcatgaatcctctgaagattagctcagagcacagcatcaccaccatcaactcttttaagtagtataaattaatatttttattttatgatccttctacacttgttttgaccaagcgttttctttgtaggaaacttgttatggtgtgctttgtcgagaatacgaacactccaaagatgcaatgtttgaggtcagcacccaatattctatcatgtgccttttcacatagtattgtctaaattcacaattaattcggtcttttgtttttatagcaagctatatattgtcttagtcctatgaagaaatatcgatgcctaaaattggcatatttccaactgcagtcagtttccccttctagaaaaaaaaaactatagtccattggctaagccaatcttagtattccctactttctcaaatataagcatttctaggattcgaattttgtacacaatataagcattcctgtagtactacttgtcccatcaacctctcattcaaaagttccccatctttatccgcaaccaccctcccattcccaaccacccctcatttattttcaaaccttattccttaatctctactaaacaacctacaaatacttatatttggaatggaggtagtatttgtaaagaattctaaagccaagatgtctatttatcttgtcaacttttctgcagtgaaggcagaaaataaagatatcaatggagagatagtatatcttatattctgcatcttgtgaatgaattgatatgatactaactgaacatactttttttttgagcagtttctcctccaatgtgcagatcaattgcctcacaagattcctttctttggagtattggtgtgcacctacttgaaccttataaaactacatgctattttatggccttataacttggttattgctatttgtgagcattttattttttttgtcacaatataatgatatgctactgtgccctcttaatcctttgttatccccagaaggtgaatgcacaacaaattcaaccactattagtgtagtactaaaaaaaatctagtactcatatgccttttgaatttatgaagcctttgaagtttttatttttcgagaacaagccttgagaagttagattagctcttaaaggtggttgcaagccacaaacacactgcataattgtgagtgctgattaacatgattgatgaaactattgtgtgagaggaatccgaagttgacatacgctttgcttcatattttgttttgcttggtcctgttatttcttgagctgttgcatatgactatgctctgttcttttaaatatagttttttttcctgaagctgttattgttcattattctgccgcctatgcgtgtttgactgttcactatgtatcctctatggaacttggattgtcaatttcgttccaaacattacctatatcttgttttaagtttatttttacacaatattggtgtaagaacaagacatggcaatttagtttttattatttgacctaggcattaaactaagtccgtaagatggctctttttttgtttctaatttcagataggtttgataaacttggaaaatgaagatttttccaagggtattgtcgatacaacacatgccaatttacaggtacatgtagatgtttttcttatgccccagcagtattaggtctatgtagatgtttttctttcggtgctgaatactaagtcgaaatcacattatggttctccttcttaaagattatcttaggttataaatgatgtcttaattgcaggatgccttgcataatgaaaatcgtgacagaatcaggatattgctgcgatttctctgtggcctggtaagttttgtatttggttgatttgatttgattttgttgttgacattattgtgcttgttgctttcctaatcttaattggtgatgcctgaaatgtgtctaactgacgtactatcatagtgttatgtttcatacaaacaacacatctttgcgaataattgaatctgtttgtcaacattcccaagtatgcaaggctattagttcttgtctttcaaccttactaacttgagcgcttatgaatcatgcaacagtgcatttgcatgacacaacatagcaaactcacaggcatttataactagtgattcataaaatttgcatttggttagcataatctttacttttggtctgcattctaaaagttagtgctaggcgctgggtagccattccgattaggcattagatggtcaatcaggcagctaactatccgtggcgactcttgtgctactattttagtgttcatttatctaacttctctgtcatatacttgctaattgcttttaattgactaattatgttggacctaggtgccacctaggcggtgtgcaggcaccgaccctgcccgatcctctagcacctagagccttcttgagccatgtttttagttctgattctccaaattgccacctaggactgagttgacaagttataaactgtgaatgctttaggtctcctctccaaaagagcagagtgacttctttctacactcttcaattcttcatatgtcgtgacaaacattttctttaattgcacactatatggatatgattgagctgtttgtggtgcaacatagttttgttttttcttttctccattcttttcataactatttaatgtttgccttgtagatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgaggtaacttgaactgctgttctttactgctgatgtgaacatatgcagttcagcatgactgtatcactgtatctaaattagttgtgcatgtgaatactatttcatgtacatttctgttttatcatttttcttagttttatttcctatatgagcagctagagggaaagctgaagcgtcaacaattttttgaaacatgtgaaactatatgaaaatacaatacatttccactttaggagcacccgttgttcaattattcttttaccttgggatccatgacatgctaccttcgtttttgaagccattttgaaattgtatactagaaaattctgcagataatccagtggtataatacactaatgatatgtaacatgcagcaagttccagatgaatttgagagagttctggttggtatacagtcttatataagcattagaaggcattttgatgatattgctttctcagtctttgaaacagatgaaggcaactctcccaacaaaaaggtgaacatacactgtttctccttatcaactcagactccactagtgatatctagatcaatgttattaaagttagtccttgcaggatttcatcgaagatttatgggagcgtattcaagttctttctcgcaatgggtggaaggttaagagtggtatgcgatagtccatatgatttcttaatgaacaaatgttgttgaccttcagttgcaattgcatatgatatgtgacaattatacagagttatatcacaatatgtttcaaaaaccctatatgcatccaatagttacattcagaacacctttttcttatattaaattgggctggtggtattccaaaatcttagacatgcttgtgtctaattggtttctgcactctattttacttccttggcagttccaaaacctcacctgtcgtttgaagctcagctggtagctggagtttctcaccgtttctccccaattagttgccccccacctactatctcgcaatcatcttctgaaatagtaaaaggtcaagaaaagcatgaagctgatctgaagtatcctcaaaggcttcgtaggcttcacatatttccaacaaataaagctgaggtaatgtgcaaattttcttctgttcatgatatcagtgcaacttttcatgtttttgattatcacgttttcaagtttataccactttgttatacactacaaagtcattttgttatataactcttctttaaataatacattgcaatatttcactctgagtttgctcaatttgttgccagctgtgttcctatatgcttcatgctgtcccagtatgtacaacccagagtctaaaattaaattttatttcataaagacgcaattacacagatactgttattagatagaagcaaataatatctgaacattggaccaatatgttccttaatacctgactttgtgtgaaatggaattaaaataatctgttacttttaatgattcgaatattattaattaattccttgtagctgttccatttgtcagacaaaaatagtcacacaggcagacatctcttgtcgtatatgactagtcatgtgaaaatggtatgattagatttgtcctggaaaatatttttatattatataatgattgaacgaacagctgctaacacattcatataacaagtagcggtcaaagttgaatcttgaataccaaggtgatgtcaaacatgtcatattaattgcatgcagttacaccagaaactactgtgcacatcagcttcagtaacagtaacaattccatcatttcttggtttgattcatttctcatatgtactttttgcaactaatgtactgtatcaatatgtatgacaactgtattccatgtcctttatgtctaaccatctagttttggctgcagaacatgcaacctgtagatcgttttgttgttgaagaatgcatattggatgtgctacttttcttcaatggatggtcagtagttcaatttttccaagattatcaacacctttatatttttcacagtagttgagactggagggtatcacctacatacctgctaatatttcatggaaggcatagttgaccatcaagtcacaagatttgcttgtcagtctttatgctaaacatgcactaccatattcttattgctcttgtgtcttgcttctcttacaaacaaaaattggtcatatttagcccccatacttttgtcttattgtctattgctatgttttgctcggatgtagccagtgaggagttttaacttggttttacctaacaagacttactcttctcaaaataagttgtggagagcctatgctttaagatttggagtttcttcttcttcttctttcctttttggtgctggcactgttttggttctgatcatacttgcattataacactacctccgttctcaaaatgatgtcattttggacacattgacatactacctccgtcccaaaaaacttgacgttctaccgcctagccgatgtcccaaaaaacaagtcgttttggatatttaatcagagaaagtggggcccatgtttctgtttttttttcttccggtcgatggaatcctcgcgtaacagcacagaaaccttatcctctcgccgtctcgcgtcctgaaaccttatctcttctgttctctcacctcctctgtcgctcctcatcctcctcacctctcctctcctctgcactaccggcgttggtgacggtgaggcgggcacgctccgagtcgcggctacggaggtcgcggcgcagccggtacgcatcgattcgctggccggcgtagcggctgtggaggtcacggcgcagcgaacacgcgctgagtcgctggtcgtatacggagccgcaggcgcgctgagtcgacgggtatcacggctgcggaggtcacggcgcggcccgcacccgccgagtcgccggtcgtcgcggctgcggaggtcacggcatggcgggcacaccgagtcgtcgccggtcatggcgtggcggccagggccggacgcatgtgtagggtggcggaaacggaccttcactcaccgcaggcaactggaggaaggcgaagaggatgcaggcggcatggtgatgggggctcagcgtcgaatcaaatcctagggacaatttggtcattttaccctgatactaattttggctgtcaaccttaaaacgtcaacttttttgggacggaggaagtagtctctaatgcaaatgttctatcattactttctcaaactatatatttataaaaaaatattaacaatataactacatgaaagagtttttcatgacaaatctactaatataatttttcatattttaaatcctaataatttttcatattttaagtcataatctactaatacaagaagtagcatctattaatgatttaagattttgaggtttgattgcacgcattctaggatttcatcttttcaagtttcaagaacggaggtagtactatatctttatatattgagcattcttgcgagagctttattggtagcaaaagatatcagcaaattgttttgacacgatttaatgtttgcctactgattagtgaaatttcaacttgtttactgattctatctttgttatgtttttctttgaaagacagtcgcaaagaatgtgcattttatctggtcagcttacctgtgcctttccgttatgaatacctgatggctgagaccatattttcacaggtactttttaatcttcagtgtttgatttttgattttagttgatttagtagtgtagtttgtatagagaacttcactatgaaaaacaacccttcatgcaacgcattctaaccagcttcaatgtgacatagttttggtttaaaaacccaaaaaatcttggactaagttatattccactctatgcaaactggctcaaatcagtatatgcgcatagctaggatactacctgctaacggtatttatgcatgttgcacattaactagtcaagaaaagcatatgtttttgtgtgtttaatcatgtattatattgatattttgcagctactgttattgccgaatccccctttcaggccaatttactataccttggttattatcgacctttgcaaggtactattttcatgcttttgatcttgtgagctaacactgtttgttgtgactgcgttactgtgtgataccaatatattgttgagactaatatgccccccttagcaatatgttgtctagatcatggctgttttgatggtttactcaacttgccaaacttctatgccacaagtgtggcttgccacagtttttgtggtgccaaaaaagctagctacacttgtggcaaattttggcttgcaagtgagtctgacttgtggggcataagaatagtgaagtgtggcacaccataactttggcttgcaaccaaacgcttgcctcaaaaagtcaaacttccctaacttgagttgacagtttggcaatgaatcaaacaccacctattgtttcattttggtaaacaaccagcttctgtgaaaaaatgttagtagcattgtgttgtacatctctgaactatattcaagaacagctgttgatacaaaaatgtagcatattggcctaatgtaagattgttttggtgagctgaggttatcagaaaaaaacaatcagttctctgtactgttgcaaagctaattcgacctatattgatctttcatgaacttctggatacggggaacgcatgctgccgttttttttttaacttctgggtattcaattaaaagcattctttgggtattcaattatgcttttaatgcataagtacaacgcccaaagaataattcagcttctggcacttttagtattctttgggatgatacactgagttaattgtctaaattccaggcattgccaggtgcatttccttcagttgtggtaggagcagtacatgctctttttgacagaattagcaacatggatatggagtgccgcacccgacttatcctatggttttcacatcacttgtaagttgattgttctactgtttactgtctgacctgctatacatattttttctgttgtttactatctatacgtctttttcttgggaatttcttgtggaccattacatgagatattccaaaacctttaaaaaaatcgtcgccttctttctcatatcaccctcaagacaaacttcaagtcttattgctgccaaattgtgatcgatattgttctgctttggcaggtcaaattttcagttcatttggccttggcaggagtgggcttacgtcaaggaccttccaaaatgggctccacagcgtgtttttgtccaagaagtattagaaagggaaattcgcttgtcctactttgacaaaattaagcaggttagtgatatgcaaggaagcatattccttctcactgtttctactgatggaccaacagtcatttgaattggatcttgtctcttatttctttcccagagcatagaggatgctgttgaattggaagaactgttacccccaaaagctgggcctaacttcagatatcatagtgatgaaggcaaagaaagcactgatggccacagactctccaaggaacttgttgccatggttagaggaaggaagacacaaggtgatattatttcatgggtagacgaaaaaataattcctgtaaatggtgccaaatttgcacttgatgtagttagccagacacttctggacattggctcaaaaagtttcacccatcttatcactgttttggagagatatggtcaaataatatcaaagctgtgcccgaatgaagaaatgcagttattgttgatggatgaagtcagtgcttattggaagaacagtacccagatgattgccatagctattgataggatgatgggttatcgcctactttccaatctggctatagtcaaatgggttttttctcctgctaatgttgatcaatttcatgtttcagatcgtccatgggaggtacatcctttatcctcatcgaataaccaaacctattctgcatttaaaacaaacctatactgcttgtgagtgatggcgcactgtaggagctttctgctttcagtgctttgtgcatgcatgtttagttacttttattgaatggtgaaatactcaagccatctagaactgccaagacaatccttcattaattttctgtattataatatagctcaatattttaattaaatctttctgatctacattcccttatgcagattcttagaaatgctgttagtaaaacatacaatcggatttttgacctccggaaagaaattcagacactcaggaaaggtcttcaagctgctaaagaggccagtgaaaaggccgccagagagttggaggaggctaaatctattattgagattgtagatggccaacctgtgccatctgaaaatccaggaaggctaagacgacttcaagcgcgtgctgacaaagcgaaagaaggagaagtaaccactgaagaatctttagaagcaaaggaggccctccttgctcgagggcttgaagaaagcaaggtgctccgttgcttttattatcaccttaattttgtactgttgcttggtactttgccccataataatagagttgagcatcctttcttcatgtggttttgcaggaattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgataggtcagtttattattttgtttgcaatgctattactaggataactacttttacaggatggacaactatttttcatgggcggttcattctgaaacgagctttttgtggaaagcttgcatgaactctagtagactaggattttgtattagtcctgcatatatctataagagtaatttactcttaaaatgtagaaaaaaaattcagtagagattgctagataccagtcaagacaaacaggttcttggatggattaatatcagctgaccatgatttaattgcagtattcacctatgtcttgaagtgccaggaacccatatttactgttcagtataaatatgttcgtgcctgcattaggggcttggctgtcattattcggctgctaacttgtcttcatgctttagcagtcagctgaatggtcaaaacaagaaaatcagtcacaatgttggagagcttgagcaatggtgtctctgcacattgggctatctcaagtcgttttctcgtcaatatgctactgaggtgaggacctgtggggagttagagttatcatgctgtaatatggatacctgttagatcaaattcctttttataaatgattaggccaaactggatttctccagtgtagttaaactatctgtctgacaatttctgtatactctctttgattccaaatgtaaatcattttatacttgtgcaccgtagttaagaaaaaagctcaaatgattctgttacccttaatttacactgttctggaaaaaagaatagtcatttatttgtgagaggtgtagtagtatttatttttttcaagggcaaacatgaaagaaaagaaacaaatggcctagaagttccaaacagcttacagtcaggagaaagttgagaagcctaatgtgttagcatttgaaatatccaggctacggtgtactagagccaaatatcacaggctgcatgttaaaattgttttattattacaaaagaactcaaggtcttagtaaatgactgatttttctgcagtacgttttaagtagttttcttttccatggcctccatagcttctactaattggatattacacatattttgcagatctggtcccatattgccatgttggatcaggagattttcgttgggaatattcaccctcttatccggaaagctgctttctccggtttgtgcagacctaccagtgaagggtctcacctttgattttgacccttccagtgagttggagtttacctgtattatacgcgacaaatttttcatcatgcttcactaactggacatgcccaaaagtactctgatgtgtactcaggaactccatcgattctcctgtaatcctggccccgaggaacacccttggtggaaagcactgtaacgactttaggtgattaaattatcagttaggtttatttgaattgtagtggactaattttcttgggtgagtaattgctatggtctagctttcttaattccctctgcctgtgttaggacaacgccgtgtttattgataagctgatctgaagccgtcattactttacatgttgagctgtcgcattggtgggtttgttacttggtccaaattccaatggaacttgcttgcaacactggtccttgcaacgtcttctgagcttctactgagcatgcactgtcaaagctgtttttttacctgccatggagtctggagctgccataacgaaaatcttggtaatgctatgctttgtacactagcgactattttatctctgggttagggtagatcggaaaaaggatcacgagctaggtccaagaggggtctcttcacgctttcctgtctttaatttgttgtttctatgcaattgcaaagaatcattacggagtaaaacggaagattctgtgccacaaacaaaacagcatagctactacaactggaatgggacgtttaccaactgaagccgaactatacttcttgtttatccctaggatgcaacggaatatttattcactaatcaggtggatgaaaattaaggcgcttgatttgaaaaatgacagatgaatcatccagcgaaaaatggacggtttttttagggtgccgaagtcaccaattagtgtgttaaacaagggcaacaaaacgaatgtttcggataatgattatactcatttgatcgggcacataattagtgcgtaaaatatttacgcggcaaagcgtactcagcctaatccttacatatcataatccataaactatgtttaggagctgacaaaaattgcaagcaaataatatctacaggtttatggctttgttttgcagagaaacacgtggaaaaaatctctttggtttcgggtaaatgacaatgcgcaggtgctggttctgtttactgtaatgaacaaacaggttaatctctactgtacatgagatttacagggttatagaattcattgcccaccatgcttccaaaccgttccatttcgtaagacctggaaacaaacaatccataatcagcaggagatttcgtataagtacaaaaacttcaccattttaatgcatttattcaacacagtgaatttcagaagctatgcgcatgtaaggggcaattcatgactactccctctgtctcaaaatataagaatctgtgtccagataagacatcctaatactatgattctggacaagactcaattctagaatcttatattttgggggagggagtaattaataggtggagtatcaccattttccagtatgctcaatagggtttcacacttcgtggcaaatgcgaagcaggacaaatcaatcaagtataaggttggctaaagcttgttagaggatttctgttatgagccaagttcaatcttaacctgtactaagaaaactgtactagggggaggcttccaagaggtaggtctacataagtgcaattcagcaccaattaatgagcatagatacctttttatattattttatctgcaggcatatgttgctcacaaataagtggaaattcaggcagcatctccaaacagggaaaatagttagctttcaaataacgggtcagtctacgatagttttgtgggcaattataaggtcggaatgaaatgaaaaatatatgctttgcttaaagcaggagacatgaactgatgatgataatattgtaattgctaattcaaaaataccaatacctgcttgaggagacggagaatacttatcttggttagcacagctcatttctctcatcccccctgctcaagactgtaccaaatgtcatggaaagacgagaaggactaaccatttagccttcagaattttatactcaggtggaacttaccaattaccaattacaaaattgttcttgagtgctggcacatcatcagtgccccacagtaacaccaataaaaggtattatgctgcttcgaagttagtataagtaagcgtcagtcaaagattcacctaatctatagaaccatggcaggggaatgcttgatatggagcccatatgttcccgataaaacacatttgcctacctacagcagaatggttgccagagttcaaaccatcacgcatgaaaatccggttctacctcagctggatccgttcacacagtaattgcgtaccaactgccaagaagatgctctaaactgtacaatatgcttccaaaaggaacaggttaatcgaagatgctccaaactgtacccaaaaaaaaaaaaaaacactgaatgcctccaaaacgtataagattaatccgaagtggtgatcctatttgtatgaaaaagcgctggatgcctctaaatgtacataaaccaggcaagccggtcccagttcctatggagctcacgcagacttagtagacccatctcttttgcaccgtgtaaatatgctgaggtaactgcagccaggcattccaacaatagctattcatggggtgccatttcatgcaattctgaacatatcaggtgttgattaactccatagaaagccggacaagtctcagtagctcattgacattgttgaagttaaaatctaaaactgttcttactgaagcaagaccatcgtccacagtttttcccctttcctgactgctagcagcagaagcaatagcaacctgtgatttccgagttgcatcgaatgcacaattgacatcatttgtctaaagatcagaaaaaacaaacataagttagattccgaatatcattattcgatggcaaagcactgaagtttcattatgctaactcattaattactacaatcacagtcagttattgatgatgataaataaatattcaattcaattaaaaattggttccatgctatctgcttcctgtggaccaatgtggaagcatatttgccaagcacaggatggtgtccaaaacagggacaacaatgtttaggtaccagtaccactctcgattgttttttaagttgcatattcactttatgtacatctgacccaattatcaccaaaccaaaagtaattttggtagacatttgaccaaactatcatttacattttctatggtcaaagtgtaaacaactcctgtcatcaaagcggatgctgttcatattactgtattaaattgcaatatttatggtattcatggtttcgctactaaccaaaattacggatgtaagtggctaacccgtgaacccgcttataggtcaaaataagcgagttcgcggcttattttgatctataagtggattcgcgggtagccacttacaccttacccaaaatgttaatgagttaaatgccattttgaccattgataatgtaatttcaatttagctattgagaactgcctgattttaggccctgtttggcaatgcagtgacttttcaaaagcactcattatctatatttttttattaaaatattagttgatttttttagctttaacagcaaagccttactggaatcactaaagatttccctcactaaatagattccaaagcacaggatagcagtagcaccatagcacaaataaccactactgcctgtactaattgagctaaagaaaatgttactgcatcaaactcctactaattcatttccaatttgaagggtatagtcgttaatatacattgttcaaatccccaaaagagattatgtattaaattgcaattggttctgcctgtacgaaacaagcctccacagcacagagacataaaccatagactagaaacagttcacaatggaacagcttgcatatccatatctataaacatgttttcatgaagggacagatgaaggaacctagtaataaaaagattgtaccaggctaaaggtaaatagcttgattgaaagtaacaattaattgggacatgtgcaataaggtacttacataggcaagtaacctcaataagtgtgcttggttacgaacggccagtggcaaatggttgccagccacttggggtgagtttccacccttggttgaaagggcctttgacaatccatggctatttaaattatcgatatctgaggcagacgatgatggagattcacctatataaagataagaaataatatacacataaagctccatacactgccataaaatacttaatacaaataaaattttcagagtatactatgaagtctgagaattgataacaatgcaatagtatagaaaacaaaattggtagaaaccagattacatcatgaaaaaaaaactaagtacctatcaattttcaaatggttagattgcagaatgcaccaagcataatttgattactccctccagttctatattaaggtggtgtttgaatctccttaagatgaagatgaagatgaagattaagttttttacgcaaaacgagatggtattaacgtgtgattaattgagttttaattatttcaaacttattttagaacaaatttcatatagaaagttttcgtacgaaacacaccgtttagcagtttgaaaagcgtgccactttaatccaaaacttcatccaagttttgttggacattcgaacacggcctaactggcgttatgggttaatgctgtttggatggcaaaaactgacgttttagctttctccacaactctctcccttttatttctccagaatacccctcatgcatgcatgcaaacagtaaatgctgttgcttcgtctccatccagcggaaaaggctatatgggtatttaataagggtataacaggaaatatggtgactaattaataagtcattggtatttgcaatgctgtccaaaatgtcagttaatatagaattggagggagtacagtttatagtgaccagatagccatatcagcaaaatggatttaccaagaatcgtataaaccaaattagatattcggtaatgccaggtcaatataatccatatatccacatgcaggcatgcggcactctctaggccaacaaatccattactagtatatgcctgtaactgtattttttgtataatttggtttatctagtaaaccatttgtagttacataatacaaaactatgattactatgattacataaatacaagttgcatagccatttgtgatgtgatgaaggaaggatgcaaactgttggagaaaactgtcgtgcacttctttggtaaagatcgatggaacatgagaaagcggttaagggggtaatgtggtcgttggtttgtttggaaggtctttttcgctttgaaaggctttggagtctttgtgctcttttagttttatgtaaggtgcttgagcctctgtgctccttttgtttgtaaacttgtgtaagaactgagcttgttcactcggaatttctgtggctgtatacacccctgttggtgtagaagccgggttttataaattcccattatctaaaaaaaatagctgagccctgtgcctggacttccaaaattctacccattcttgatgcacaacataggaaaacgacgaacaatttggtcccacaacttacattcaaatcttactttagtctgtgagcttttaaaatagtcaatttcgtccatcaacttatacatttggatcaaatggtccttttactgatgtggcgtacaagtagcactgacttgggatttagatgactcagaatgccatgagaagacaaaatataccattcccttacatatcacacacacaatcaatgttctctttcaacaaagaatgcaattcattattctctatgaataccaaatccagtccctacatgtttggatgcacacagacctcgcataaacaagtcaagaagcagcaagcggttattttcatcttaatcatttagtgtaaggcaactgaattgatggtcaaaattggtccttttgatgagctaagtgagaaagttggggaccaaattgctcatcatcctaaataaataaattggtaatactcgaactccagtgagtgacacagtgcggaacaaaggatagtagaagcagcctccaactcccagaaaagctcagcaggaataaaaaggattcaaatatttcaaattaaagtttacaagctagaacaaacatttttttagacatcaattacctggagctatctgtacaaccgactgtagttcttgtcgatccttgcttgcactagggtgtttgtaatacgctgctttgaggtaagccacttctacacatttatatgctaaagcggcagaagccattttattgcatcgttcataggcatgagcacaaaagctggacagtcaaataaaaaaaaaagcattttagtatactgcatttaaaaagcttagttcatatagtttcaaagttagacatagctaaccatacgtgaagaaaactctgatcaatttaatatggatgagtattcactacgtgattagatgcaaccatccaattcgtcatcattcagtgtagtttaattaaaacagccagatttatcttcaatttgtttgaaaaaaagtccactttactacctcaaactattttcacagtccaacctaccctctaaacattatttaggctcacttaatcccttagtttatttgtgcagacatatgtttgcaccctaacctggtactaggtggtattgccagtgtcgagtagtttttaccggtaaacctagccacgccacacatatgtgctgaggtggagtataagggtcatggcaggcgccaggcggagcaaaggtaggatagatcatgacattcatgcttcgcgtggctttctgatttctgcttccagatagttgcatttgctcacgtggcgaggctgtggtcaaggttcctgcccaccgtcaaccgtctccaattctccatcctagcgatcgcagccactaccgcatccttagtaactaataatccattgcagcaacatcagatacagaagatggatgttaaatccagttttaaagaatagtcagatcagatggatgttgctgcgtaacagaattttggttgccatagctgcaccagcgctgtgcgatgcagccgatgctgtgggcctgttactgtgacatcatccatcctacacttttcggcatgctgccaactgtccctctaaattacaggtgaccacaaccacgacgaagtccaagtgagaaaccaacaggcaacagctcattgaagaagacgcagttgctgcccttcaagcttcaaccacagcaaggacatagccaggctgcgtctggcgcacaagacgtgacttgactgatcaaaaccactccacgctggcaataccacctaacaaaactgggttagggtgctaagtgggctggtattaatagattagggggttaagtgagcctacaatgagggcacactatggtgtatggcgggagcttctaacctccaagagctgttggccaaggcaatacttgtgccctaggagggggcgaatgtgggtgggtcttttttgtgttttcagcgggtgtgatggcgtgtttttgttttgtaagtccgaccttttattccttgcttaatgaaatgatacacagatctcctgcgtgtttgggaaaaaaaagtgagcctacaatatgtttagggggtgaagtggacttatgaaatagtttgaggtagtaaagtggactttttcgtatttttaaatacctagactgttttcatcccttggtgaatcgtggtgtgtctttcttttgtacctatgacaactttatataaacttttgctgaaacgaagtatataaactttatagacttattcaatggacatcacaggtagctcacctgcagagttttgcagtttcagaatacatcttcattgactgagcaacatcgcctgatctcgaattgtccagattaggagtttcccaaagagatgcaacatgcagaaacttcaaagccgcttcaaagtacaggcccatactttcaagttcaagtcctttttcctgcagggaaaattgtcattagatacttccaagcaaaattgacagcacaattatgctgcctgagacaacatttaacacaattggtgtcaccaaccttcaaatgattagccttgtgttttagatcccgagcttccttgagtgcaaatgcaatcatattaccatccctcctaattggactcgcagaatctccattttcaacattggaccttaattgtgtgtggttttttgaagcacctggttttactctagtggtgtgaacctctgatttgccttctttcatatgagaatgattatcttgaccaatagacttttgcatatcttgattatcaatactaggacgtaatttctcttttctggatgacatctctatctgcttatttccctctgaaatcaagttactggatccatttctaccttggcgtgaaggagcactatttttacttttatgtccagtggaatcagctgtagccctcgggttaaaacaatcctgctgatcaggttgtagtgtagggccatgcatatccaagatctttttatcaccagggtacaattgattatctactctccccataccggagttatttgtagaaccacgcagaatggcttcacccacagcttgctgcccagtatgtagtaaaccaacttcgtgggttggatatttcattggggtatgcaagatgcttgaatcagcattcaattctccatcttttccagttttcctggccttagaaatcttatcagtgtttgaatttttcagtggtgatgaagatactgattcaacgggagagccctttgcttctcgagaatttttgtttctccgagagcttgagacctttgaagagcttgaagttgcaaccgtagaagactgaagacaggcaacatccctcctagtgggttccgccaagttcaagacctgtctgggaggttgattatcccatagttctgatggaccttctttacaagtaacaaatttgttgtcagcaactagctcattatcttgacgccttccagcagaagaaaataatgcatttgcatcctgaacttcttcaggcctagcttcggacttctttatctttgataatctctcgttcaaattctcattatcgccccctttgcttgtgtggtccattgaactgagccggttatcctcccattccttcactgtcttctttttgccagacaaatctaatgtttctatgcctgcacgatgttctttcatcttctcatgaaaggccacatcatcatcattaattctctttgttttttccaaaatatcaaaccttgaagctttttccttgcgtaaagaaaactcatcttgttcacatgagtcctttgacatttttgcttttgcagataaagctttggtttcatcacgaactttgttgccagctaaatcgtattcatttttccaatctttgttaaagtaatgtcgatcctctttttttgtcttcttagatgttttgtgctcatctcgatcaattcctctcctgttttttgattttgaatgcttcttcgatttttctgtaagatctcctgtatttaaataggaattatatgtcagtaaacaatttaaataactaaacacagtatttactgaaaaatatcagaagataatacatatcagctaaatataagcaataaacatgaaagagagcagaacctccatctgagtggctactgcgactcttgtgcttagacttatgcctttcagaagctgatttgctctgtggcaccagatcatgtgtgcttacaggatctctgtcattagtataatgttcactatcaacaacttctctattttttgcaggggcttgttgattgctcgtgagagtcatttttgcaggggcttgttgatcatgctcgtaacagttttcgtctttcagagcatttttccttttcctactctgtcccagttgtccacttatattgtaggtgctagatgctgctacacttgcatgcgcagtgtgagggccacctgaagaaacaccagcggcagggatttgagtgacataaagtgcatttagagcatttgttgtttcatcctcactaatgtcgcatttgttcatcccaggtctgcaaagacaaatttggattgtatttttcagtaatggaattttttcttccccaattgtcagaccactcagagaaagaaaactgcatgacccttgaattagagtgctacctcaatgttgaatttgcacagcttatggaccacttaaaaatacttttttttttgtttaaggcggggtggatgggtgttcggggggagatatcagaatctagtcaaattacctgtctaatcagaaatcgtttaaggtgtacaaagaaattccagatcaaataactatatttaacaacgtttaaccatgtactaaggacaacttaacatatgtaaggtgccaattgaagcaagcatgtatggtgaggcataacactggataaatgcaattctaatcaaactgaactagaacttacagccagtcaagcatgctgcatatccacttttttggaagcatggaagtgtttgtcccgtaggggaggagacgccatttatgacacatgtcacagcatacccaattatcctctatcaaaacaggtgcaggaagagaagctgcatttgcaggtccaggtataatcccgccatttgacggcatatgcaactgctgttcctctgaacctggaaatgtgccatgctttacactggaagggatctccttttttgctggcccagttatatgaagttccttctcattatcactgttcatcatcttctctttccgttgaccctgaacacttacactctccaatgaagccccttccttgtttcctatagatctcttaggcagattttcactaaggtctttatgagatttttctttcgatttattttcaaaatgattagacttcaaatgagaatcagttgccccatcattaactagtacagaagaatgggtaaaattaccatcctctaagaaactagatggtgctacaaaattagctttgtgttccttctgcattcgtttgacctccgttctagagttatcttccacagttctctcactggcaaaggtttctttaccatgaattgtcttcaaatcatctgatgacccagcaccccagtccttgtccacattgccttcaaaatcatccatggcaggctcaaatgttctcataggttttactttgctttctttcttcctatcatacggagaaaatttgtgactacttatattcatgtcttctgaagtcctgtccactttactcgccttaagttttactttcccccgtggtgctaaacaaccatttcctgaactgtcaaaactactgttttcttctatatgctttgttacttctgttttgactgcttcgcttttaactgttcccaggtcattgcagcccatctgttgtttcggtcgagcatctttagttgattcttctgtgaattgacttacaccttttaactctgtggttggggcgccagaagaacaggttatatcatgtgtgtctgataaaatcactcggctgccaggtatttctacattagcctccttgcccaatattgcactagtattatttgcatcttttctagtctttgtatctatggacttctttttcttgccatcaggcttcattttcttagccacatgggctttgacatgcccagacgaaagagaaagttctgaatggccatcaactgctctaggtacattttttaagtccagattagtttcccatttgttaaccaatggggtgaccttattcgtcaatttcagaatgtttccatgcagaggtgacagcaagaatcctccaggaactgaaaagtacgtcatgatctgattgatcatgcagataaaaatataagctattataaccattgtttgactatgcttaatgacatagaagtgataattcagtggttataaagcatttatacctgcaggatggtccgaggagattcatatggcacattactacacactggagattgaccctcatgaccatcaggacttccttccatggatgaagaagaagaaatatcaaggcccaggccactgtagatagatgcattctttcttgccaaagtattagtggaaccaactttgatccgaactttgagtgtcttctggtcactaccattaaatgagctgtccaaggaatcagaacaagcaacagagtccttctcaccgtttgtgcttgagcatatttctcttttacataaatcaccagatgacggtgcagtggaaccattatttcgggagatagattcatttgccacagttgaagggtattgacccatgctctgcatttgtaatcatgacacatgaacatacgccagaatatacattggttaacagcacaaggaaaactaataaagcacctcagcagattgttgataaggtgatcttgaagtgccaacgtttgcaaccttgggtgggcttctgctttgaggcaaaggtggaggtgagcgctggtatgtgggcaaaaacgaaccatatccaccgtattttgatcctgtcaaaaagtttttcccacttaatatgactgaaatgcaatgaacaaaagcgacaagtacagcaactactagctctttacctaggttatctgcggatactcctccttcaaagtctttctgaaaatgtccaagaacatgttgaatcttttcatcctgagaaaaaaaaaacatggaaagcaattaatgaggaccagagataaatgctttgatcacagaaacggacatatcacacacaagcaaacataaaggtttctgggtttcctcaaaataaatgctctcagttcgtttttacttgtaatttacgacatcaacacagtctccaattcatatgttttatcattgccttctccaaccatacatttattaaaagaaatttgaaatataacaatatgaaagcaccattcgttacaaatctagtaataacatttttacatttcaaatcttagtatgtttgcaaattagggtttatgttttcaagatttcattgcacgcattccataacggcatctatttgtgaatggagggagtaactggtctcggaggcaataactgcagcaatcacctaaaaacactaaaaagaccatgtgtgtgtgtgtgtgtgtgtgcctgcctttaacagaatttcaacatcttttagttagggtgtccaagcaaaccaaacacccttttgaccataagtcagaactttggataccagatggggtcaatcaacaagaaatgaatgccccaaaaatggataacaattcttataagtcggtaaagacttgcgcatttaattaaaagggaattattacaatttaatgtttattaatgggtcgtttagtcagttggcttttaccgcacaccaaaagtggattagtagtaaactcaacacatcacagataaccgaaacaacgaggcaagctagcatcgcttcacttgtgaggacagcgcaatgaaagaagcttggactaaattgatcattgcgcttacacgaatcacctaaacgagcagagttcaccattcatcctccaaataattcgaatggaacgaaggcgcttcctcaccctaccgagacaaagacgaaactgagatgttgatggtaaccacttaatttaactaaaccaacatcctgcctaccaatcaacgaactgcgaaatcgtgcaaaagctgccgcgcatctcctcccaaaaccataccgatccagcagtcccccgcgctgaacggcgccgaaatcaacacattcattcgttcattcattcatttccgcgaggccacgcgagagagagggaggcaacaaggatgggtgggggcgctcacgatgtaggagaaggcgacttcgggatcgaggcagagcgcgccgccgccgccgtcgtcgtcggggaaggcctccccctcctccagctcgacgtcgccgtggcccatcacacggaacccctcctcctgccgcccccgcaccgacagcatccgccgccgccgccgccgccacccagctccaaatcgcccgctccctcgctagggtttgaaggggatcacgcgattcggcggctccccgtcgacgctggctgtggccgccccgcccccctcctccggcttcgacctcgccgcagatattttttaccgcggggcccctccgattatctctatttctgtttctatccctctccctcctgtctctctctcaggctcagcttagctagagctactcctagtactaggctactactactagctgtgtatgtgcgtgttgcgtttggttggttggatggttggttggttgggttgggttgggtggcggcgcgtgaccgggtcgtttcgtttccttgtgtggccgccgacttggggcccatcacctgacacctgcgggtcggtttggtttgagatatgcggacccatcgtttatttacggaaaaaaaagtaatttatgattaatatatatatatatatatgtatatatatatatatatatatattattagcgattaaaagacttaaaaataaaatttgataaagaaaacttcaaatcagctttaaatttaatgttgaaaattcaaattttatctaagggtgtgtttaatttttttggtgtaaagtttttgaaatacacggacacacatttgaagtattaaacgtgcactaataacaaaagaaattacatattccacatgtaaattacgagacgaatttattaagcctaattaatctttcattagcaaatgtttacttataacatcacattgtcaaatcatggcgtagttaggttcaagagattcgtctcgtaatttacatgcaaactgtgtaattgttttttttatatatttagtatcatatgtatgtgtccaaatatttgatgtgatatttttattcaaaattttttgatctaaacccggcctgataagcataaacgaaaaaagatgtgacccgttatgcgatgcgtttcggttccgacacgggagcgggcaggccgggggtcacgccaacggtgtttgcgttgtgggcgtcacgtccgcggtacgcggcctcgttcgatctcctgtgggcctttcttcgtgggcctccgccacagccacaccctacagcagtatagcccgataggcgagagcgcgtgaagtgaattgattgtcttgggtgcaacgggagcacccacaacaacatcagagtggcgcagcggaagcgtggtgggcccataacccacaggtcccaggatcgaaacctggctctgatacacgattttttttcatctcaattactactctccaattaatttttattttctcttactactctcgaattactctccaattaatttttattttctcttattactctcgatttttttaatgtcttctcaattactactctccaattaatttttattttattttgtattttgtcatctcaattactgctctccaattaatttttattttattttgtattttctcttctcagttagtactactcttgaattttcttctcaattactccctcaaactcctaatataagctccaattaatttttattttctcttactactctcgaattactctccaattaatttttattttctcttattactctcgattttttttaattttgtcttctcaattactgctctccaattaatttttattttattttgtattttctcttctcaattagtactactcttgaattttcttctcaattactccctcaaactcctaatataagagattttactttcactgtttgaccattcgttttattcaaaaaaatttggaattattattatttttgacttaatttattatccaaagtattttaagcataacttttcattttttatatttacacaaattttttaaataagatgagtggtcaaacaatgcaagcaaaatgtcaaaattccttatattatagtacggagggagtaccactctcaatttttaattctattttattttgtattttgtcttcttaattagtagtactactcttgaatttttcttctcaattactactctccaattaatgtttatttggtcttaccactgtcgatttttttcttattttgtcttctcaattactacactctccaattaatttttattttattttttcttatcagttagtactactcttggattttattctcaattgctactctcgattttgttatgttgacttctcaattactactcttgatttttttttagtctcctcttttatttctttttgttttctgaattactactattgatgtgcgacagatatcgtcatcagggatgcatgactgccaatttttttcaatctattaaacttcatatgttttgcctttcatcttgctaacgatcatgccgtatatcaccggtcgaacgatgcttccccgattcatctgcatgccaatgccattttgcctccgcccgaccggcgacgccaaaactgaccagttcaagaagatatcaaagcaacaaattctactgtacggtaaataatcgaactcgatcgaatcaatagtcaatctaatctggaaaacacaagtttacatgcatactaagcttaacgagcagtactaaaggacagagctcctctgacataaagtcagagggacgtgaatatccctaacaggtaggtcctatctttatggacacacgtgtcagtgatcatgtctctttacgtcagagaagcctcttccgtattaagaaagtggtagttacacagagcacattagtaattactccgtaaatttcccaaaataaattactccgtaaaatcgaagagacgaaacaattgatacatgggcttttattgattggagagcagtacagtgtctagctagtaccataaactgagatgccacgtactagcatgcagatgcagtacacgtgtccccaatcatacacgtacggcgatacacgcatcgaccagcagctgatagatgatcatgtgcatacatgtacttagcccactagcaaaattctaatcatcctacaactcagaataaagaacgcggcaacagatacatacagtcacatatatatcgcgacttaattaattaagcatgcagatatatataataattaattagctaagatgcatgcgattcagctagaatgagctgcagctaacacacagtaattaggtcactctggtcagtcgtggtcatcacgcgtgcagtacaagcagctcaatacgtcaccctctcactgatcgatcaggccacctccccggccggcagcgccggcggcggctgcggcggcggcgggatgtcgacgacgacgctcctgtggtcgatggcgtcatcgtcagctggccgctgcggggtggccggcgccgccgcctccaagtcggcgtcggcgtcggcgtcgacgtcgagcggcgccaccgccggcgacgcctggagctgcatctgcagctgctgctggtccttgacctcaacctgctgggcggcggccgcctccgacacggcggagttcttcttggggttcttgtacaccacgtacagccccttttgggccagcccaaccagcaatcccagcacgttgggcgtctgcatataaatgcgatattaataatttaagggagtatttaaacccctcccgctaaaaagttgttataatataattaaaatgtaattacttcctccgtccgtttcacaatgtaagtcattctagtatttaccatattcattagcattaatatgaatgtggaaaatgttagaatgacttacattatgaaacggagggagtacatggtaactacgatataacttacaacactataaaacttgcattcaactagtattgaaattttacacgtaacatgtgtgaaattttatttttattaatttttttcttcatgcacaagcctcgagaaaagttttgagctagggaaaaaaacttgtgaaaattttctagcaaatccgtaatttaatcaatatatatagcttaatttattgttctaattaattactactggaatatatgcggggatgcatgcagctggctacaacaaaaatctcctggttaaatataatcgtgtgtgatgagtacgtttacgtagtttaatcagggctttttaggcttgcgagagtacgtaagctctgctttggcgaaagataggttatacaagtgatgaatagtggcggtgatcttttgtgctgtgctctcgcctctcggcagaaaacatctggctcatgggcggtgacacaagcgacacgcactagctcacatcactatccatgcatgattaattaattattactacctaataaaagcacaacaattaacagttgcttagagcacccgcaatggtaaagtaaggtgctatctataaaacatgtacatctcagcaatagactagattaatagtaaactacttcaatggtatgtctacatgggtatctatagctgtctaatccattgcctcgtttttctctatagactatctccaggttagtagatagctttgctctctctcttcatttaatctcttccaagtagtaaaatatgctgacatggatctcttgtagagagcctatagatagccattgtgggtgcccttaagctggctagctagctacttcctccgttttataatgtaagtcattctaacattctccacatttatattgatgttaataaatttagacatatatatctatctagattcattaacatcaatataaatacggaaaatcttaaaatgatttacattgtgaaacggagggagtagcttgcatggctggatggactccttgcttgctactagctagagatgttgagaaagaacgggacaaaaacaagtaaaaaagagaaaataataggacgtacggcaacgaagaagtctttcatgaggaggccgtagaagaaccagacgacggcgctgagggtgaggaagaaggagagccagaagggcatgaactccacgctcttggtcctgatcacttgcctctgcaaaaccaaatttaatcaaacttgatgttagttcttgttaatatgctaattaattaattatcttataatcaaattaatgaaacagatatatagttagatgaagctatggtattttttaatagataatatcgtatacatatttgatcatttgtgtaattaaaaattatataattatcatctattttattatgagttgttttataacttaaaaatatttaaagcatgatttatatcttatatattttatgtttaaaagttaatggtagcctctattaacaaacggaggtattatgtatgtgactatgtgaggaatgaattaatgcgcttacgatgatggtgagcggggcgacgaagacggcgagggcgaaggaggcgccgatgccgccggcgagcgtgacgcggcggtcggtggccttgacgaggagctggagggcggcgacgacggcggcgaagagggcgaggttcatggcgcagacgagcttgagggtgaaggccatggcctgcctgggggcgtagaggaggtagacggtgaggtagagggactcgacgaggcagccgatggagttgatggagaggaggaggaggtcggaggtgaggagggcgtagtagagccacagcattgcgctcagcagcgccaccgcgtacggcaccgactggaacgactccgtcgacttcttcttgtacacccgataaaacgtcggcctgcattaatttgcattgcattcacatcatatatatccattaattagcttaacatgttctctctctttttttttcaagatgcatgcaaattattaacagatcatggacttaattagctcaatgctcatgaagctagtaggtacttacactggtgcaaggatgaccaagaacgacaatatgttgcctgcaaaaatcatttaccagcaataaggaaaattagttagttcgagtggcaaattgaagtataatgcatgcatgcatggatgcatactatacttgttgtggaaaccactaatactactgcatgctagatgtggttagttgttatagaagtgtgtaatctcgaattagctagtgtgtgcatgtgtgttacctacgatccccacagcaaagaccaatgcctgaaccatcttggaggatatgagatgctagcttaattagagtttgatcagaggatgatctcctctcctgctctacacaccagtattaatccaagagcaatttaggagatcaaccctctagctagctgtgtgtgtgtttgctactaccacctgaactgacacaggttgctcttcctgggcatcgtccctggtatttatagggccaagaaaggagagcccaacatttatattattagtagctcgctcgatcgccggatcaactcaagattagctagctaaattaaagaggccggagagatgatcgagttccatttgcttgtttgatcgagctttgccagtgaatgcatacgtgtggccgggcgcactcacttttgcttgcattgatccccggcctaatctcccctggaccctctctactgttcatgcctttgactggcctatgtgtcggtcatccgttcatgacatgttacattaggctagggcacttcgactgacacatggaaattcaccctctacatgtgtcgatggaagtcccaataatggaagcatgatgataatatatatgcatatgtagctatatgtatgtatagcttggtgacagcttggcatgcatagatcgattcaatacatacattcttgatcactcagaaaaaaattatgagggtttgaaccaaactatgtacatggcagagtctcgacgtttaatttgttcctcagatattgaatttggattgcaaacaaatgttagtttcaaacccctagctagctaaaatttcatgtaggcggtaatttcagcattaaaaaactcttaactatccaaacttggcacgcaaattggggagctagctcaaaatttgtttgaaagtagtcttatatttgatggataactcttgtttgtttttctatacattcaattgttgtttctaagtgaatatattgaacatctataacaaaccaattaatctagctagctacaccagttgattaattaaaggtatatattttcttctccctatttaattatcatggcaatttcttagcttgagagcagatgttgttgctaaaacgagatgaacgagtgatcaggtgctttgacctttgtttctatggttgacttttcctttttacattgatggagattcaactttgagtaggtctgcatttagccttcctcttaataatatgtgagatgttttttttaaaaaaaacaataatatgtgagattgaaagagtgataatatatatatgtaaacagccaggggcggttgtgttagcgtcggtgtcagacgacaccgacgactttcagcaaaacctatggttaaactgcttatccatatattataacactatagtttaagtataattagtatgctatgataccaatgaatcaattttatggatccaccacggtaattaaacagccaccaaatagtttggtgtttggaattaatcaccagtcacaaaatccaggtttgatttttttccccaaaacacaattttggctattaatctgatgatttgttttatatcatatataccggtgtgattaattgtaatactatgaaataaatttctgaaaaaatatgcatattttctttcttttctatatgcacctatacaatttatattactacaatacactttgactttttctcaaagttaatctttttaaaataactaaatttacagaaagtacaacaatattttcaatacaaaataacatattatcaaaatatatttaatattatatttaatacaactaatctggtcttataggagttgctatattcctataagaagtttgttttttaaaaaaatcaaagcaacttataatataaaacggagggagtattcagtactctatcataaataattgtgtcttctgtcacttttaaaatttggagtacagaattactaaaatgttttaattggacgtatgaaaatcatacggatagatatgctcaaaaactacaatcacaaattagtatgcacagtttattgccccctttttttttttccggttttgctaaaaaactgttgacagttttttgtttggaaaactttcgattttctagccattagatgtgctctaggattcgtgcaacatatacacctagaataaaaaaaatcgcatgggcaaggcagtcatcgaacatgatgcacacgttaagctaagccatgcaccttcttattagcaataactcttttttattatatatcacttacaccctagttatatatcacttacatcttaattatagagtagttacataacacttacaccctagttacatagcacttacacactagttacagagtagttacacgatagttatagggtagttacattgtataaaattatgatttgcaatttttttaggagcgcatattacttttgaatttgaaagtttttttcccttctacatgtagaccaatttcttgttgttcaatcagcttagacactaaaattcatggtttgtactagtgtggattgttcccctataaccattgatgacaaattctgtagtcaaaaaatttgaaagttttggactaaaaaactgtcgacaactcccagctagtcccatatagaaattagcgcgataaaagttgcaacgacgcggagagagtaccttatcgatcgatcgacatccaaaacacaacaggtatcgtctgtgacccgaccgaaacttcgcttaattatcgaaagtgcttttcaattcgatcgttttctttaacatcaaactaacacactaacgcgaccaaaagttaaaaagagggttgggcacttctgcatgcatgtggataccccatatctttgctttgaagttcccattggagataaatgggttaactaataagaaagcgttttaggccagctatagtctcaagcttagctgcatgcttaattagttaattaggaggacaaattaaaactgttgcaatcgcacgcagcacgtaaacaaaaaaaaaaaaacccctagtccaatcctgtcctctttttttttacccatccgtgtgctgtaaaaatccgtaccggcaaagtggattagcttaatttggacccgcggtgaaagtgtgttacgacgcgcagcttagccctatagctactagctagtagtaagcttttgtctcccccgcgtaggcgcgtacgcgcgcgtcaaaaagcaaaagcatgcagcagcctacgcgcggttaggcctgggtgtgccggcgcgagatccgcaccgtccacgtggggcgacctacgttacgccttacgtggggtaatctcagccgttgacgtgtttctccggcgaaatatgttgtggttttttttttgttactaaacggcggctaattactagtgtctgcatgcaaaactaaaaaatatatattacaaaacgatatgagtgacaaattaacaacacactgctttacagtcaaaacaaaattttatggtcaggtcagtcgtcccacctatgaccaaatgcatgtaaaattaatcaattttgcaggcggttcaacgcccgcctgcgaaaatggcgatgccctaatagatccacgtatgaaaatcgattttcgcaaacggcacccttcagaccttgtaaaaaaaatttgttaaaaagaaaccaattttcacaccatgtagacacctatttaaatacacattcagagcatgacggtagaacatggcatgtaagaattttcaacaacagtagaacaatatcaacattgtcgtcgcagccagaagcaacacacttctggtcgtcatcattccatcacccgcgttgtggaatccgccttcttgcccacacgtcgctagatttgcccttccacttgcctgccattgagggatatgtggccgtcccaaggactaccgccgttgtggacgagctcgcctaagagggggagtggatgcaatggatgatgatgctgccaccagatattctctgtacactaaagtttaaatcatagtgcttatatttacgcgtatgatgtgaaaaaccattagtcatataatgacttgctgctggtgtaactatatagaattgcccctcaaaaagccacagattatttaagggaaagtagacgaactaataaatatgacgttttttatcattcaaaatgagcaacatgaaaagaatgggcaactaaatatatcattaatactaaaatcatttaaaacttataagggatgagatatttgtggccatgaacgacagggatagtggtatctggcactttgcatgagaagggcaggccataggctggccaaattagtaacttccttcctcaatccttttcctaccctcaccttattcttcccaaaatagttgggccatcttcaaaaatgccgaaatttcgattaatgtgggaatcgaaatctacaaaagtggcgcctataaaaatgccagaaaatcatttatctacaaagttcttgtgttttaacattgatttcgacaaatatatctattaattagttatagttttatatatctgtgaatattagttgaccatcaatagatgtttccaatagactatactgcatgtaaaaattttctagcgtgtgtattagacaagcacaatctaaataggtctcgtaaaactgcccgagagcagatcagtacatggttagcatagtactccttagactaagtagttattttcagagaccggattgtagaaacaaattatttccttcacgtttcgattttttttaaaaaataaacttttgtatttattgcttagaattaagtaacttgtgaagtttatttatcacaatatttaatttgtttctataattaagtagagctaatctcgctcaataatatgtatgtttcaaactagatcggtctagtgctactccaaattaagttttcttttaaaatgttgtgtattaataaatatagttaagcacctactaatggaaacctagttggtcgctcactcatttcgcttttctggccatgggcgcatgctcatgcgccagatggcatgttttcaggaggcgattgggcctagagagagatagataaccaatccggttgctcgatcggccacttcggcagcttaaatagtctcacatttgctcgcttaattggcagagcactagacgatgatgaggctagctatctagcataacgtcatgcgtgtgcatatagtatccatgcatggaccgatcgatcaggtttccgatatgagatgatatgcttaacaacgaaagaaagctagcatctcacttactagatgcataaacgctcgtatcagatcaggctatatgttgcatgcatatactgtacccaattgcccatggtatatatgaagtgcatctaattatttatgggtgttacaagtggcatgcggccatagctagtgaagacaggtgcccatggacagaatccagcgaccacttcgcctgacagatcatctgccccctgactcctcagccagccaccagatctggatgaatcaaagtagtggacaagcagtcaaattaacaatatcttgggatcctataataactaggagccaacatgacgataataacatgggtgcaagacggctcaagggtgaaaaaaataggcttacttttctcatgagttcccatgttgttctcgaaagagtcaaactattctctcttttcttctctcctccacacatttgttacatatctatacagtggttatataagaccgatcattcgttagatctttacatcctgtcgtgccacacgcaattgaatttttctacgaggcaatatattttatttattgcacacactaccacatgacctgcaataaaatgtaacgcgccctattagtgccggttaaacaaaaatcgatattataaggcatttctcgctcctagacctgcgtgtataagggtagacaaaaacctaactaatgatcccagttagtgctgatttttaatgaacaagtagaactatatgagcaagtcgccctagcgctccaagtgaaataagttcacattatccatctctaccttctattgctctctttatgccctttctcctttctctccccactcaccgaccccaacgagcgatggccatcactacctttcacgattgttccgtatccgtatccctccgggtcaccggatccaaccaccataagcttagatgcggcgatgacatgtcggttgctccaccatggcgaccataagccggagcagctatgactaagatatagaggtgactaggattaggacaacaaagctagtttttttaataatagaaatggtttacatcttcaatctctaccgacatgcacaaatctagtttagcgggagtagtgtgtaggcatatgtatggctatgccgagcgagctgtagcagagggcatcgagtagaaggagcggaactagcacgatggtgtgagaggctaccacacttcatattaattcctcaacgggcttagatcagatccagatctagtaacaattgtaagtatcaaagacatactccctccgtcccattttaagtatagcaatggttttccatgcccaactttaatcgttcgtcttatttaaaatatttttgaaaaaaaaacataagtcacgattaaaatattattcatgttttatcatcttataacaacaaaaatactaattataaaagaatttgaagtaaaacggactatcaaagttaggcacgaaaactcatggttacacttaaaatgggacggagggagtaatgctttacaattgttgagtaaatacattcagtcttaaaattccgcgtccaccacgagaaattagtgtaaccagctgaaattaaaatgactaaattatatctgattgcatgcactgcagcacatcaattaaactatcttaattagtcatcagcttaattcgtcgtgattagaaacgccggcctttcctcctaactgatcaactgagattgggactatatctcttggtgggtgcgcgtatgttctcctagttaaagaactgaagaaaccgctagcttttccatggaaaagaactaaacaaccgcaaagtgcaacgaattaacgatcgatatcctcgttacctcgtagtgtgcatcgatcatgcatgtatgagctagcggacgcgtgctttaattttcaacaatttttggatcgattctgcccactacaccagaatttgttaattgatactccctccgtttctaaatatttaatactgttaactttttagcacatatttaaccgttcgtctcattcagaaacttttgtgaaatatgtaaaactatatgtatacatataagtatatttaacgatgaatcaaatgatcataggaaaagaattaataattacttatttttaaaataagacgaacggtcaaacatatttaaaaaagtcaacggcgtcgaatatttagaaacggagggagtataagaatagggaccacctatacatttgccgataaattttctcctaaaaatttgacaaatgtaattacactgtaacttacgtgtaattacattataacttgcatataactatagtgtaacttgtatgtaactttcacgtaattttaaatcgttagattgttataagatttgtacaagtggggaagaaaaaaatcacagcagacacacatgtgagaggattagttcccacaacctccattttactgaaataacatgttacggagagatttttgaaagttacgttatagttacagtgtaattatatatgtcaaatttttgggagaaaatttgtcaagaaatatatagcaaaattgtaagaataagatggcaaacgaagtgcttgctatcttacgatttgttggtaattaatatccatctttgtatcttacagcatataacttttaatgtttgtcattaaaccaaatacagctttaccatcttactctatgccaaactttggcgggcaatgtatggttggtaccaagtataatcaaatatccagacaactttgactacggtctctccacatttcattgtttttccattcaattatttttgatagaatcggcgagccgtcaatttcatttagtagagaaggggtaaactctataaagcgaaaggaaagagaaaaaaggatttcaggatcttcggtccgaggtaactaaaagaaagccaattatgaagatttctcactcttgctaaggtccaagttttaacctctttcttaattttggctagtagggctttttccattcaatagaaaaagctattaaactgccaactcaatgagctagctagctagtagtaaaaccaaatggaggttaatattgttatctaataattaaggtgagatccttaaaatcaaattaataatcaataatggcttatatcgtttctaccaatagtattactggcgctagttgcatgtagagccaaattaaatctgtattgttgctgattggctagtgagcatttactgctggtttcccggtggtaagtacacatatgctcatcaaacatgctccaaccacacaagtctaacaaattttagtagctctcaaaacttccactcttagaacaacaccaaattttgataaaaacacaaatcaaatattacatatccacattcttcatcttaatgtttattttgacaatgaacgattaaacacgtcctaactattagcatgcctttaattaattactttttatattagtatcaattttattgagtagtgaaattgcacatagtctccacatccatcaaggatgtgcataacaaaaggaggaaaaacaaaagaaaaataaaagacaacataggcatatcgatcatgtcgtcgtcttgtgatgacaccaatatcttcaacagtccagaccatacaacacaactattttgtctaaaaggaacataaggttagcaagcaacctaattaaggatgtgtataacaaaaagaagaaaaacaaaagaaacaaatttaacatagatcatgtcgtcgtcttgtgatgacatcaatatcttcaacggtcgagaccacaacaaaactatatattttctccaaaagaaacacaaggtagcaagcaacctaacagatagatcaatcgtgcaaggccacattgtattttcttttagatgaaagtcacatcgtatacagtactagccaatgcaactatgcaaagcatcttaggcatatagcttagctagttcgatgatcattaagttaataaatatagaagaagaggaataacaaaagggcaccaactcagcatatatattatccatccatgcatcatgcatgtcatttcggtagcagtacgagcaaaaatgaaattgacatgtacgtgtgctacgagtaggggcttttcagaccttgacacgtcccccctctcggctacccaaagtggcatggttaattaaaatttttaataatttaaactaggcattaattaatcacagaaaggctaaacgtttagggacatacgtgttgatgatgtttacacatataggtgcaggtaattaaacgaccgagctaaggaagccaaagcgcacacacaaggggacagctaacgtacggtgattaataggatggtctaactacaagatgagtgttctggaatgttctgcaactgttgtaccttccagtcttattgggaaaccccgatgttaattaacgtggtagggttatagatatgcatatactattaattatgtgtatctctagttagtgtaggatcaagaaaccattaagcttaattagttaccaggattttatggtaacctaatttttaggtggagtaaaacttttttcatgaattgtacataaaactattattgtttcatgatgatacataggtagattggtttgagctaagaaatataaacatatatgttttcatgctatggaaactagaaaagtaataaaagaaccccagtccccaatcagggccggccaccaaagcaggtatgcaaaactggataatatcgtacctaattttatgaaaatacaataaagtcagtatctttttttaacctttaacccaaacataataaaatagtgccactgtgcatgggagactgtttggtttaaacggaacggcttccattttcttctctcccttttccatactttagcacgccctcatggagcggaagctatctatcgaacttgaacactaggatctcatcaccatcaaagagatatacctccatgggcatcaaatctcataaccaattgtcacctgccacggtgagacctcaatgcggtgagaagattaaagggcagaggtcatgaggtgacgagtgagcaagcatgagctagcgtacctggaagtggattgaggcatggtcgatggtgagatcggtagcgttgaggatgtggaagagatggacaggggatgatatcgatggcgtcgggcacgatgctagactaggtgcagtgacgaggtcgacaaaggcgaagctcgaaccgccgaaccactaggaacttatcatgttgaagaataaatacatatgagttataaggcaaatgctccgactgaccgactattaaggtgaaatgacactagtgggacaacccatatatgatgttagtatattttagtacaaaatcattataatgtggtcattgatatatgggttcacagaatatcaatagcaatatcacacaatgtacacttccattagagggactatttcccaacccagttacctcctcttcatcgaccactaagtcaaatattacgggcttattcactttgctaccattttcaaccttaccaagttttggcattgccaaattttggtaaggttgccaaaattttggcaaggttgtcaaattttggcaagatttcatatgtactccctccatccctaaatgtttgacgccgttgactttttaaaacatgtttgaccgttcgttttattcaaaaaatttaagtaattattaattctttttctatcatttgattcattgttaaatatgcttttatgtatacatatagttttacatatttcacaaaaaattttaaataagacgaatagtcaaacatgtttaaaaaaagtcaacggtgtcaaacatttaaggaaggaaggagtacatactaaaatttggaaacaaactaaatgtagccattttttaaagtaactttaccaaagataaggttgaaaatggtagcaaaatgaacaagccccacgatttacgagccacctcctcttcatcaacctagaagtcaaatattcttcatcaacctagaagtcaaatattatgcgtctcatgttttttaccgtggatgtggttagctagcatatttaagcttctagcatatattagaaggtttgagatgcccatgatgctcaatgtacgtgcccggccgaccagactcacgctatcttaactttgtgggctacgtacctagctagctagctagctaagctgctccgtgtttgctgcgaggtggccgaaagcttccatgattcatgcattgcattagcttggtgaattcattccatcatcatacatgagtgatgcagcgtactcctttcgtctcgcaataaatcaatatacgatcggatgagacatttaatagtaaaataaattaagatagatccaaatttatttttcttttgtctaaatttattttactattagatgttttattttagattgcttttacgattaaatttttcatttaatcatatattactatattatgggataaaaggagatacatccttttctttcttactttatcagtttctcctctccttttttttaaaccttttctgtgatgctgataataagtgaacctagctactcgccatcttgtagtttggttctttttgctgtttgactgcatgagtgcgacggtcagatctatcgtcctaccaccaattcaatgatgagagggagctttacctgcaggtctctcatcaacgacaaattggcatggaccatcgacgcacaatgtatctaagtcgttgattacgtggacaactgtatggtcaaagtttcaaagaagttttcgatcgaatctgcgttaaggccttttgttctgtagagaaaacataaaatagttggggattcaatccgaaccaaaaattcataggaaagtctttttaaaaaatgattcaatcatgtctttttttaaaaaaaaattctttttttagaatggattctgaaggaaagttagtaaagagctccaattaattaacctatatattgaagataaatcatttgggtcaatcttctcatctgatttctatatgtttcctactaaacaatcatttcacgcttcgcaattatatgtttttcttttactttatttttcaatctcgcatttcaaaagagcactaaatatttatgaccataggaaatatttggcacttaaggcatgaaccttacggtccaacttttaaaactttgttcatcaacttttactagaataaggagtttccaaagaaaaatattaaatacatttataaagttattggtactttatgtattgttatatttcttatgaaaggtttttgaaatctatgatagaatatttcgaagatatggaataattggctgaatattttatattttaagtatatcagataatttgccaattcccctaaagagtctaaacctacttgtggtgaatgacaaatcactgcaaaagataagctagccgtgctcttaggaatcactatgacacttagatcaatagaagacgcacaactctctagcaagcccgtgatgctgcagtattgtaaaaataaggatgaagccaaagttgagcctccctctccagcttctataaaagaggaagttggccgaactagaagaatacaaagaagcaagatcattcaactaaatcccagaagccactttctaattctagtagtaacatgttaagagtccaccttgctagtatgttggagtaaagattgtgacataatcagtgtaaggtaagcaaatcttatttgtattatccctcagagtttctgaaagggaaaatcagaagtacgatattttgtggatatgaagtagtgttgttaagcatcacttacttgatccttgaactatttatgtgagtttaagttctacgctaaggatcttgtagttctcacacatcatcctacgttcaaaacatgcaagaaaaacctttatctgttgaggaaatgtttcctttgggtagatctacctagggagataatagatttttttctctcatatatttagtcgcaaagcttaagccatttctaaagcaaaacagttagaaatatgatgagcaccaagtaagcttacacaactagtatcgcacaccccgttgtcccattggtctcgacaacctgtatagatccttaaaaatgaaagtaaaatgatattattaaaagtttggtatcagggtctggtcaccactgaaaaatatggtactacctactgttttttaatatatgacgttgttagctttttataaacgtttgatcatgcttaaaaaatatttaatgataaatcatgtcataataaaataaattatagttacataattgtttttaaataaggcgaatggctaaacgtatataaaaagtcaacggtgttatatatttaaaaaatagttacataattgtttttaaataaggcgaatggtaataatgttatttgcaagttgtcaaactttaaactttggttatcaatttttataagaaacttgagagtgcaaaacactgccctcctcttgaagcaccttgtaaagttttacaaagctgcagatttgccatgggttaaattgatttcagaatcatattatacttcaaaagtcccacatttaatcatgaataaaggatctttttggtggagggatattattgttctgacagatgtcttcaggggtatagccaagtgcacaatacagtcaggctcaactgtcctcttttggaatgatctttggaatgaggaattcaaatgcacaagcttcccacatttgtacaatgtggccaagtataaggaagattcggtcaaggatatgtgttctaggcaattggaagattctttcttactccccctatcgcctgaggcatatgctgagttcctacagctggaagaaaacttggatagcttaaaaatccaatctggaagaggtgacatctggagctttatatggaactctgatgtttacacaccaaagaggttttacaaaccaaacttcactgctttgcaaccccccagacctctcttgtggctatggaagacaaagtgtgtcatgaagataaaagtttttgcatggctcttgttctgcgatagactcaacacatgtgatatgttggacagacggcactgcgccaaagaagatgatgatcttacatgtgtcttgtgtgatactggccagagagagacaagactacatctttttttcacatgaccatttagtgcaacttgttggcaacacctagggatccaatagaaccgaaatttggaatttttttcagatggtggtcctggcaagatttcggtttgtacatcggggatttctggagatcttcttcttggctgcatggcatatctggaagcaaaggaatggacttatctttgaatatactcagcccaccttccaatcatggagattgctcttcaaaaaagttcttctgcatatgtgcaaaatgaaagatcctctcaaacaactagtttccgattggatacaaactatataggaatcctgtttttctttcacttttgttcttttccctgtaactttgtaaatattctctttcattttaaaattaaactgctaggcaaagccctggcagtattcctggatttttaatgaataataaattttcaagaaatatcttaaaataaatttataatatttaataattttattatattgtatttttaaatataataaatctatgtataacatttttattttttttaaactaaacaatatatgggaataaagtttgacctaatcatcctaaatgccaactatttattactgggatgaatacctttttcatttcctttttatatataaaaaataggtttaacaaaaaaaaaataggccttgtgaagcacatgttgggcttcaagtgctatgagcccaatcgaaaaggtcaatacagtttgaattagaagcttgcaacttttgttcttgtgagattgggtcagtttctgttcagaagtcggcccaacacagcccaagaaaggcaatgcaaatttgcaatgtaaatctagaaataggtctttttggcaaaattagttctatagcatcgaaagttcttgttttcgtttttatagcattgaaagtttgtggttcactttaatagtatatctccgctacttcttttagcactccgttagaacttccgtcacttattccccctgcccctacgtcttcttcatcctccatggcacagcggtaggcgaggtgtaggatggtgtagtcgatgaactcggcagcggcagacggcatggtctattgtggctgcgggagcgaactcgagggttgctgcaggggcatgttggagggcgacagtagtggtgctcaatctcagggagaaagagacgagggcggaaccatggtccgtggaggcgagatggcctggagccctggagcacggagctgttagattgagcatgccaagctggtggccttcctcgcacactaacatctagcgtggaggaaaaaggctgtgcttccgaccacggtcgattcaaatgatccagtgagagaatcaccggggggagagaatccccacctgaatatattaagaaaataggtaatttttgagaatctccttgcgtaatacataatgaaacactatactctcaggggtaatttatcgattcgtcgagcgaatttactctgttgatagtgcacctctgtcagaaaaaaaatataaaaataaggatagaaataaaaggacaggtagctggagtagctcagatggttagagcgtgtggctgttaaccacaaggtcgaaggttcaagcccttcctctagcgatatttttttaaattttttttagacttttctgctttgctgtttgaacaatttgtgtgagagaatttgaccatttgttgcattgctgtttgaacaatttatatatgtgataatttcaacaatttctgctttgttgatattttttataatttttttagacttttctgctttgctgtttgaacttttctgctttgctgtttgaacaatttgtgtgtgagagaatttgaccatttgttgcattgctgtgtgtgagagaatttgaccatttgttgcattgctgtttgaacaatttatatatgtgagaatttcaacaatttctactttgttgtttgaacaatttattttccgatttgctgtttgaacaatttttttgtgtgagaatttcaacagttagtatgcgtgacatgttttaaatgtgttagtagctttgtactctcagcaagaggaagaacaatcagccatcttatacatcacagaaacttagcatatgatccataatctgcacattaatttgtacacctacatcgaaatcatccatccatccatcaataacaatccccatattacaacaactgcaaattcgcatccaaatcccacaaaaattcacaacaacaacaacatccaaaaattcattaattgcaccatcaccatcgtcgtcaccatgatcaggagatggagtggcggcggcggcgctggaagaggaccttggcgtcggcggtggccttggcgccgagctgctggaggcccggctcggcggcggcgccccggaagtggaagagcgagccgagtcgccgcgcgaggccgcggaggaggcggttcgccgggccgacgcgcaccagctcccgccgcatgctcacctggtccttctccaggtccgtcagccgcatccgcatccgcgccacctccagcttcagctcccggttctcccgccgcaccgacgcgtagctgtcccgcggcgacatcgccccgctacccaccccgctccccgaccgcggcgccgcggcggcggcggcgcacccgaagaagagcgccgcgtcgtgcgcgccgccgatgctggtgttagtggttgtggtggtggtgccggtggcctggatcgcgctgcggaggcggagctgctcgaagtagagcacctgcacggccatctgcacggggaggcgctcgttctgcgccgcgtggctgcacgcgtccggggtcaggcgctggcagtcgatcgccttgcacatcctgtacctctccgcttccttgatgttcgggtgcacctgctcgatcaaaatcatcgagagttagtcgtatcggagaagaagattgcaatgtcgcttgcttgcttgcttgccttgaggaagatgtcgacggcgcggtagaggccgtcggtgacgaggcgggcgtggtcggggaggagctcggcgagggagatgaacttggaggggaggaggttggagtcgagggcgatctcggcgaggtagctgtcgagcagcttcgacgccttcacgaggaggctctgcttgggggacctcgggctgtcgtagtcgaacgcgccgcacccgccgccgacgacgacggcgtcctcgtcgttgctgtcgtcgtcgaggttgaggaacaccgcgaagatcctcgccaccacgtccgtgtcgtacagcgtgtgctccaccgccgccgccgccgccgcggcggagacgggcccggcggcgacgaggatgtcctccaggatggcctggtcgagctgcatcccgatccgcttctccaggtcggccctgcagatgctcgacgccgacgccgccatcgccgtcttgaggagccccgacaggaaggccatcggcacggggctcttcttcgactgcgccgggagcaaccccacgatggtctccaccacggcgcgctgcttcttgacggcgtcggtgtcgccgccgccgccgccgcatttggcggcggccgcgatgtccctcgccatgagcccgtggagcgagttctgggcgtagtttatgaggatgcgggtgaccgtctcctgcttgagccccttggacttgacggcggagagcagccgctggaagaagtcgagcccgaggccggcgactgacttgccccaccagtcccccggcgagtcgaggtcgccggcggcggcggcggccaccaccaccgcctgcggcggcggcggcggcttgagctggtccagcttggacagcccggaggtgagctgctccttgcagacgttgttggcgatggcggcgatgaggcgcgggacgaggttgacgtcctcggcggccgggagcagcgcctcgcagctgcggagcacggcgacggagccggcgatgctggggagcacggcgtcgcggaggaacgcctcggcgcggagctccaggttcttgtcggagaagtcctccgtcatctgcaggtagtgcgcggcgcaccggagcatggcgacgttgcccaccgtgacgtccacgcccacgccgtagcagaacttggcggcgagctcgaacgccgccgcgccgcccggcgtgccgtggagcccgaggcgcgccagcttgccgtccttggcctcggccaccgcccgccggatcttgccgctccgggacaccagcgggaactgcgcgagcagctatgccgtcgccattagcacaccattcttaatctcgatttcttcgtgcaaccaacaagaagaagaagaagatgaacctgctcttaccttgtgcagggcgaagctggacgtgccgacctcgacggtgaggtcgctggagacgtcggtcggaggcctgcatgcaagaacaagacggccaccatccatgtcacaatttagcatgcaaaatcatccataattcatctgattgtcatgcaaaatcttccataattcatggacaggtgacatgaacaatgatcaaaacaatggcgtactcaccattcattggcatggcggctggtgagggttggtcttaatgccctcttcccggagaagctctgcctcagctctgtcaccgtcgccacgcccatctctctctctctctctctctctctctctctccctctctctctccacaaatcacaatggagtactaacagtaagtgtgatcagtgcaaaaggatggcttgtttggttgtctcctagttcagctgcaagcgtgtgctaagcttcttctgtgctttgcagacttgcagttgggtgtcaagaaacttgtagggagagagtagagagagagagagagagagagagagagagagagagagaggtgaagtgaagagaaaggtcttaaatcttataattaggatttaagggctaactggcgagtgtgcggtgtgggagtgcgtgcgtaaagctagagctacatgcatgcattacaactatacaagctgtgactctgcatgagtgagtatctgaaattctgaatatctgatgggctaagctagctctgttcaaaagttgctactagtagtagtagtagtagtagtacaaaataacaaaaacactgctgctattgcaatttgcatagtcattttggctatcttgatgatgatgatgatggtgagggcacacaagctgctgctgcagagtcattttggctaggaaggattgatgagccatgagttacaatctgaaaaaaggagttggggggggggggggggggagtgcgcatcatgtaggctttcctgcagttgcttcttgtctctcctaatgaccactctgatgatgcagggtaagaactgccggaagggaaaatggttagctccaatcatgccgattcatgccaaatgtgtcatggaaaaagattaatcatatatatatatatatatatggatcaaagtggcacaagaacaatgaacagggaaaaatacagggaatgttgccaaattccatcgcctaaattgctgtttctgtcgagtgccgtcactactccatcaggacgtgacagcagctaggtatcaattataagctctagagttgcaaataataagagcaattatccctcaagtgataaaacggtttttcttctaataatgtctcctttggaacacaggagttttataggaactgaactattctcacatctgagcttaatgtacggttttacactcggtcatttccatgagtagaacattaatcagcttcaattaataaactgagtgtaaaactccagaaatgcttatcgtcgatcgaccttgttattcttgctaacctcaagcggcattttgtgatgaacaatgtgatgctcttgttgtcaccttatctcagcatggttgaatctaaactttggtctgatatctcatcataccgctggcctcaagattatctcccaattttgaagtatgtgtgtggggatcccagggcgaacaaactttctgccataaaaatttgcacgggcaatggctttctgttattcttctggtctaaaagctgccccctgctggttgaattggtgccatgtgaggtgcaaatcatttgtggcactgactctgtataagatatggttcacaatgtttatatcttaaattaccatgtggagtactccaaagcaggcttatcatcagcagggtagtttgcataatgcacattaagtcatgagaaatgttaattttaaggcaaatcttgatgtgctattcttttgcttgttgagttttgtagtcttaaagttttgtaatttccttttgctaccaacagaggatcttgattccatattgagaatagcctgctacaaagtgaaggggaataattgtatttaatatacttgattgatatcttagtttcttttgagatgagactactagtatcttaaattatgtttgatcataaaacaaaacaacaaagattgatatcttagttgttgcatgcaattactcgctggattcccgtggaccagcattggcgtttaacaagaaagtgaaaattccatgatggtgcatgactaagccctgggttttttataagccaaaaggaggatcaaaagagggggcttaaggcaaaagagaagcaaaggcaaaggccaaggcttagttaaacaaaagggtaggtattctttggcacccaaattgcctggaaagcttagcatgccagcatatgcattagctcctctctgtcatgtgggccatgcaacctaattaaattgccaatctatatactctatgtagtaggttgtcaccaaccggtttattttaataaactacctaatggctatattggctaagtacatttctttagtgtgtgagtgtaaagcattttgtcagagtcagactggaaatcataaggagggtggcaaagagcagaagaatcttgttgttatttgaaaaaatgacagagccgacactgaagcttgcttgctcccattcgattgtgttcagcctttcttcttcagaaatagagactattattattatcctcatcctaatgctactctttgcactgttaagtaggagtattactaaacaagctaggacacacatgcaggtatcatgaaaagcagcactgctagtactgcagttaaatatacactcactagcttaaagtttactgaattctaagatgatctctctcgttgtttcaagtactggctcgtagtataactttgatgcttgatcacattcgtaggctatcaatcattgagtagcagaatttcactttgtgaacagcaacctccactaaccattctctctctctattttttttagtaaaaaagaacttttacacaaatcatccttcacattttgttccctctctccatttattttctctctgatcgatcgagctttgagcttcaggcgtttattgccagacacagacaacgtttgagttcccccaaatgccggactgctccccatgaccagcaatgcagggatatatagcaacttgtccgggagaagatttcagagctaatctgaaacgacctgacgtgagagagaggacgaacggaacacatgacgaacacgcgagagagggagaaaacctgcgtctcgccactggcgcatcgatggggactgcgactctctcgcttggaatcattaggcgttagcgggttagcgtaggccacaggcgccaattggtcatgtactcctatgcagtactatgctcatggtcatggcaggccgaaaggaaggcgtctcatcatcatcaccatctttaatttgcttagactcatcactgaactactcgatctcttttggctaaacctatcatgcattgttcgtgatcaaagctagttagttaattagttaatctgatcactagagatgatcgatctgtacatgtgtgtacaaccgctgcctgattcgctacgcggacaaaagtactccctccatttcaaaatatttaacactgttgattttttaagtacgtgtttgaccattcgttttattcaaaaaatttaagtaattatttattcttttcatatcatttgattcatggttaaatatacttttatgtgcacatatagttttacatatttcatatttttttaataagatgaacggtcaaacgtgtgctaaaaattcaacggtgtcaaatattttgaaatggagggagtattatttactacttgatgatgatgatctgtgctgctgggtacgtagtaggagtacgcatttacgcaatgcggttgccggcggaaaggggcgcagtcggccgcgcgagctgcagtgcaccgcattgcttgatggagcaaaaaagggcacggcggttcggcgctttgggggctctttttataatctccccggagctaagctaagagagaggctaataatcgtcgccggcgccgcccggctgtgcttgtgcatgcacatgaacgaatgatatgatgcaacttttggccagcacaagcctttggaaattggagtttggaacgtgggggatttacatatcctctggtttccatgaaaactcaactgatttttctgtaaatccccatgtatgaattttcggttaaaagtgatttgtttagggatgtcaaacgagctcgacgtaaagttgagggataataaggccctctttgtttgggcttaggcttattagcttagacttttaagtcagtttattggcttatatgatttataagccggtggatttaatgttctaagtttaatggtggagtcatgcatctatctcacataagccaaaaaagcttctccaacctagcttttggcttaatagtgttagagtggcttatggcttaaaaaaaccaaacaaaaaagctgtttgtttgtttaggtttatactttttgacttataagttggcttataagtctaaacaaagagggcctaagtggacttattccaaaagtaaaatatactggtccaaatcggcccaaacccagggagaaattgcaccatagcccacagggcccaacatcctcgccggtcgccgccactctcgtccctctcccttccccgagcgccgccgcctccctcgcttccagctccgaaagcgccttccccccaagcccagcggcgtcgctgcctccctcctcggcgatcgccgcctccatttctcgcgctcgaggtccgcctcctttgcgccggcggcttgctggctggttgcttccccgccgcgtgcctcggaggggaccggccgtttcttgttgccctccttgcttgcttgcttgcttcctccccctcgtcgccgctcactccgcagcgggggtccccgccatatgtaagcagcatctcgacgatcttgtgtcgcgtagcctctaaacctgtgtgatttacaaggattagggcgtcgaattagacttccccgtgtaggtgtgcatcagagctgttcgacgtaatgcccgtgccgcatggcgatggttagtggcgcgcttccttccatgattgccatgtgtattgccgtattggcgttgaatgagcgaggcttattaatagtccacatcattttgattgctatgtatactattgtttctgttgtgtgtccgaaagaataatctggtcttctgctgcagactgccgcatctgtttttggatctggtggatgtttggaattactaacgtcgagtaaagccatgcgaggaaagctttggacaagacttgcccctttcatatccaagcgtcatgcttcaacctctcagacctcattatcttcatcttcttcgtcatgctccgtgataaatccatggctctttgttggtctcggcaaccctggtgagaagtatcaatgcaccagacacaatgtaagctttgcatctcattcttgtcttggtcatttattttcagaatcctatgacaccctttttcgctgcaggttgggtttgatatgatagacatgtttgcacagtctcagggtatatctctaaccaggcatcccttcaaggcactatttggggaaggtctggttcattacatctgatcccatagagaatgtatttttatattttgagcaatatatactctgttctctcggttgaaagggctgaattgaaactgttgtcttgtctttccattgatgcaggaatggtcgaaggtgtacctgttttgcttgctaagcctcaaacatatatgaatctcagtggtgaatctgtaagcatcacttttagaagtctttccatgttttagtatctgatttctactattccttactatcttggaataagtctatttcgtgtcaactcttggcatggtttaatttttgtccctgaactctaaaacccaaccgttctggttcatggtttattgccactacttatcttccaacagttctgtctcctcttcaagccctcaacaaaatcaattatgtttttgatgaatgcatgaatgtttcttatggtgctaattgaatcacaatgatttgctaagaaccatttccccctaaaatcaattatgtctgagctttattttggttggtgcaaccaaaatcctatcagcaatcagatattttagttgctatgatttgaacttgaaatctcaatacagaataaaatacataccaatgtctgttttggttagttctgtgtcttatttatagaaaggtcgtgtataattcagcttgtagaaatttctttaactggaaataaaaaaatggttataatacactgagcctgatctgatgactattggtgataagtccctttttggcctattgcaggttgggccacttgctgcctattataaattaccacttaatcgcgtccttgtggttagtattgtaatatctaatctttatgagcgctaagttacatggcaatctgatttctctattgtgagttttaggcatttgatgacatggacctgccctgtggagttcttcgtttacaacctaaaggaggatatgggcgccataatgggtctgttgattttataatcatgtgttttaatgaagtaatttgttgaaattaatttgtcatttaaaagactgacctgataagcaactttctgacaacctcatcaggaagagacaacatattgttcccttctaatatttttacttaataaatttttctcgtttgtagtggcaatttctgcatgcacctttccattttccccatatggacatgttctttttttttcccttttacatagcctgagacagccatagttctcttgaaaggtctaccagatataatgacactcttattagtgttctcttattttactcatttattttactattagctatatgatcctattttctgtttgtaaataagttttttttttacattgacaaaatatttacctttctagcttatcagggtgaagagcttgatataccattttcgtaagaaccgagaatttggtcgattaaggattggtaggttcgacatctgtgttcatttccctcccttaatgtggataaatattcttatactttaacttattcaggaattggacggccacctggccaaatggaccccaaagcttttgtgctccagaagtttaataagaccggtcgagaacgggtaaatatctatatggctagtacttgttagcgtcatgcccttttctgagtttttgtacagtaaccattggatgatttactttcataattctcaccggatgatcgtgctcatttgctgggatatatccatatgaccaaaaccatggctatattctgcatggaagtgagccgcacctagatttattctacttcagttaaatctgaataaattttgttgtgctatacgcaaatgagagatgatttataggcttgcaacatgtctatgtttagaagattaccttctggtcaacttccatgtggtgtgccaagccaatcctgtgaagtttacagcccttgagatctcttaaatctcaaattgttttaggtaataatgtcaccatgtcctcaaaattgaactgctggggttcctgaaggtacttggaggacttgttatgacaatctctgtcactcattagcgtttttttccatggaatcattctggtacatcatatttctggaagcaccatatttgacataattatttcactgtcacagtttttattattctgtatgtagcgaccctgaagaattgtgctgtgacaggtagtcttacgctttgcatgttttgttttatcctagattgattcagccatagaagagggtgttgagattcttaagttggttgttaccaagggtttgacagaggctgcaagatcatcaaatgtggatcagaagtataagcatctgacaacacacgacatgcaactgtaaagatgatgacagacgctgcttgtccgagagcgatccactattacctgttgaatgcctgatgggagaacctggtaacatctaaactgcttgattcattgatttgccaaacttattacaagggctgtcagccgtctcctttgcattggatttgtaagttttgatgctctcaatcttttttttttatacttttgaacaactgattcaataaataaaaacttgacggttctgtcagcttcaagattctatctaccatgcgctttaaagataaagctgatcatttttctttaaaagaagatggatatccattttacgcccgtattcagacctattacttatacaaggtgctaaaactcttcagcttctaccccatggactgaatggacggagccgaagaaacagcaaaagtacacggaagaggatcctctaacttacttccctctgactttgagtcattgacatgtgtacccgataggtaaagagcccacatatcaatgacacaagttagaggaaaataagttagaggattttaatccaaagcacacaagagtaagtagtactttccgtaataccatacgttctctgaacaagctggtaatattaggaaaaccacatgagcactgagcacacatatacatgcgccaagcagccctagattattaactaattttatttgctcttcagtccaaactcagcgtcgaaaattgcaatttgatgaacagtgatgtattcaacgaaatgacacttactgtgaaaacagagatgaacacagatttttgtgctgcctcaacaagcgcatcttttctgatccatttgaactgaaatatagggagaattacacaagtcatggcaaacagtttgccacgcacgacaacaaaacaccccagcaaactgcaagcacaaacactttttttttcttttttcttttttgcgaggacacaaacacctaattatatgcgtgcacacaattattcaacactcacaaagaattaaagacgttgcatgatgacaagatcatctaggcatctcatgtttactataggaattcactgctggcacatggagtgtagtataatatctagattatggggataggcttgacgaacagctgcttgatgatattcatgctgagcttgttgaaggtgtaggcgtcttcgctgccttggtagaagaacattatgctcatcgctaagttggcgactcggttcacagccggcacaagcgaggaacgctcaaagcgtgcttgattgatagttttccatgcgtcttcgaccagattacttatcacagccgtggcttcctcaccagtgacattgtgctccttcatgtaggactcaacagaggtggccatatctagtttgcccttcccgtgctgtgaccaacaaacacttaattagttactccctccatttgaactgactaataatgtcaaataaaaaaaaacgaaggtactcagttcaaatggagtagtattttatagaggattatattatatcccatgcacatgtcaaaataacataaaagattttgctaaaataaaaggacaccgacagaggataacattaatgaatttgctgcagctttgctcatggaatagtataaacaccttgaatgcagccaagtcatcctggaagcgtccaatttcgccacaagccttgacagcatcggtgcaaccaaaggcccattcaagggcttcttttgttgctaaatcaccggcactaacaaatgacacaacagatagcattgaagagcccgaggagatgatggacacatccaaatgttcttgaaagcttggtatgtaattctgatgaaaccatacagcttcctggaggtaagacttgcataacctttgatactgcaggtgagaaggaaaaacaaatcttgatgaatgataataaaaattaatgcgacaccttgatccaagccgaatatataatatgctatgtttgttagtggttttttagctccaattatttcaacggccactaagtgaacaaggaaaatccacttcattggattaattagcattcaagtacttgaacattcaaccgatttatattttttttgtcagctcaagaaaagctaaatgtttgagactctgctaagtgtatcttgagcaacatggtcaagtggagcagataagtcactcatttttggcttacaccatggagtcacacccaggaaagggggtggaccctacactacggatatcgtgttgtaagaaccccttgtcatctcgttaagggccaagtggcattctcacatatagaagattggtggatgtttgtcaccacatcacccttgggagcgatgcgcaggctgcagagcccatccatcgcattaactatagattccttcaagttgcctctcagcaatgctaagcgatacggtgtattcaagacgaccaagcctctcttggaaaatggtttttaaagactgtagttggactcgacgtggagccccatgagatatttattgttacaatagatcatacgaggagttagctacttagctcaggcttatgattgtataataggatttttgtctctcgtagtcgtaggagagagagccgatagccgtagggtataaaaaacacatctttagatcctatagaggggtgaaatgcatgatatgggcaagaaacctagtttcctactatctcaagagctcctaattataacttttacgaatttgcttgatagtgatgaagaacaagactagggtcattatcctttgggaggcccaaacctgtattggtgatcatgtctttctcgctcccgggcacactcggacatgctgtttagcctatttgcactgagagctcctagttgatcccaaatacatgttttctcttgtctgccgatgctcggacgtctacactttttttttctttctctcccttcaaatccaaatatagcggaaagtactggtccttgggcttccgttagctttcattcaacatgttttgtaccaccaaaaattcgaagataattctcacaattagacattactaatagctttggtaaaattggtttgatttcaacaactaaaatttggcacgtcaaataaatcagtcaaaacagtcaaatttgaaaattaattaaaacctaattggggtgcatcaaactctacggaagtatgcacgttaaataatttattcaaatattagtttatttacggtggattaatgtaaatttttcataactttgtccatcaatataacccctttaaaaattaaagcaagttttaaccagtcctcttttatgtaaatttctggaagcaagtcaattcaattcaaatttcacattttcactttgacaaatggaaactataggtactctgtggatgcagaggcgtatccagaattttattttagggtggtccaatttgatatttagttttttgaattacccatttcatgtttccaactcttaattcttcattgcttataaatttttattcaattgtacaaatataattcctcagttgtttaataaatagaccttgggccaaggaatatttgggtggtcccctcatccaccccttggatacgccaatgtgtagatatcacaccacaatgcccatgccttggaaacttatataggttggtctattcaaattcaaatgagagggaagaagtatttggccctgtttagatcccacacaaaaattttacaccctgtcacatcgaacgtttgaacacctgcatgaagtattaaatataggctaaaaaataactaattgcacagattgcgactaatttgcgagacaaatcttttgagcctaattgcttcatgatttgacaatgtggtgctacagtgaatatttgctaatgacggattaattaggcttaataaatccgtctcatggtttactaatgtattctgtaattagtttttttattagtgcccaaacactccatgcgacatcctatataatatcctatatgacacgtctgaactttacacccctttgtatgaaatcatgaaatagtcgcaatgttttatgcacctaggtttctactctctcctcactatgtttggtgggtcccacacctcctggaccccattggacacacatgtggatagaaaaattagggctttagacttttgctttgtcatctagagtttatgctgtgagattagagagaattgcttttataattcagcttgattttattgatttgatttctttaaatttgttccagaacaatatacaaaaagagttatccattttttgtccttttctttttcggtgaaatttcaattgtacaagatttttttttctaccactaccattcatcctacctttggttggctcttgctatgtttcaatcctacattatacatagtgagtgttcttcaactttttgcctatgattttgtgcctgttatacttttgttggctcgatcacgatcacacatagcaagtgtccatatgactctgtttgcattaacgaggatgacatacatatggagtaaaaaggattgatgagtactagtattgtaccgcttttacagcataagtaatgtagtacttctcctctgatttcagttcatcctcaatctctttgaaggtactcattagcttggcatagtaattcttcaagtactccggcaaaacagaaatggcactctcatcccatctgtgcacaaccattttagtttacatacaagttaatcaattgcaagatggatgcgaccatatatattataatatcaataggatcggttctcacaagtagtttactcatattctagtgataaaaaagaattattccctccgatccatttcttttcacttcgttaggacatcaacacatcaatctttaatgcacatgtgtatcatttttttaaaaatgtatttttcataaaaatattaaaaatataattatatgaacgtagttttgtcatgaaaaaaaaacatgagatgtctagaatggtagaacttaaagtaaatggtcttctggaagggaaaaaaatcattaaaattctgtctagaagaacaaaaatgagcatggtttattccgttaattaagggatgaggaagagtaagcaaaaatactttcccacctctgtattgcttcattgagcttttggccctcttccaatatagcatgcatatcataagtgtcatctagtaaggttgctagcacgaatatcttggcaaggatgattcgtgcttgcgcatatttctgttcgtagtaaattgtataggaccaaaagtagcattcaactatacgatctcgagagtaggttagttccactgcaccgtatagattatttccccacctgaaaataatatgggatacttttagcttgttgtatcttcataaaatgtgtgctttgtgcaataaattaaatcataattgtctttattatttttttgaacgcacaaatagccttgcacatcaatatacatattattagaaggagagaaaattgtacatatttggatcgatcatatatctagcttgtgtgcatgcacagcttcatttcatggaattgtgatgatgtgatttgctaaatcaattagttgaacatctgattaatattccattgcatatctatactatctatatatagttgatatccactaactcctaagggcaagtacaaaggtagagaccggtatggtctctacgttaattagaggctatcacgttacaatagttaagacaatacggtatctaatcattaatataccaaaatactttcttactagtcatcttttctttattagactcaatgcaacaaagagagaccgctaataaagaccattgtacatgccctaaagcacaccatacaagtagtcacatcgtcaaccactatcaattattatctattattatctagagtattttaaagcatatgcaagtatgccacatcatgacccactagcaattattatctagaacattttaaatatcatgcaaacatgatatatcatttacaatttgttgtatttttagaacttaatatgcgtcaaattattatctctacgtcattttcatattatttaaacatacacatctatcatttctataatgtataacatgcatttattcacatatcccgctgcaaagcgttgggtatcaactagtaaatcatacaaagagaaaccacgtagaagtcagaataatagtgtggaatttattttttgaaagttggaaggcctttttatatatcctgcactagtagtacaaatctgagttcacgacaacttaaataatgaccacatccccgcaacgttattacaaagaataccatacccaactccgaaaatttaatgatatttgcctatatacttatgtgacaatttgagatgatgtcattgactagtatatattggaaaagaaattaatttatgatattgttagtgatacacaaacaaaatatatcgtggcatcctacactagaagggataccatcatcttaatcaggcggtaagccccatctcaatcgagcacggcgtccgtcacaggctagaagtcacagatgttcatctgtgacgggcaataaatttacctgagaagaacttcctgatcggttacccatcttaaaattgcttcaggccaagcacgcttaacaccaaagttctttggagatcggcttccggaaaagtagttgtaacttgttggtatgagtattctattaatcctattaagccctaggccaacatgtcaaattggggttattaaatgatttcaaatggaaaagtcaccaaaaccaaagttgtagaactcatcgaggtgcaaaatttttattttggtcatttctccatctgactctatttaaacaatttgaaatttgaaattcagtttgaaaaattcaaatagaattttagatcagtgaacgacttcaaccgaaaacgtcatcaacaacaaacttgtataactcatcaagatctataacttttattttgggtatttttctatataacattttttgaaccgtttgaatttgaatttgaaaatatgacaacttcatacaatattttcaaatactaaatgatatcaactgaaaaagtcatcaacaacaaagttgaataactcatcaagatttaaaccttttatttgggcatttcttcacacgacaaagtgacagtaacattgttcacaaaattaacatatctcccgtctggttttataaactataacacatatatgtaaaatttgtgaataatattgctaacattttatcggatgaagaaataacaaaaataaaagttctagatcttgatgagttattcaactttgttgttgatgactttttcaattgaaatcatttagtatttgaaaatgttgtttgaagttgtcatattttcaaattcaaattcaaactgttcaaaaaatgttatatagaaaaatgaccaaactaaaagttgtaaatcttgataagttatacaacattgttgttgacattttttccatttgaaatcatttactacccgtaaaattattttgactcatgaaataaattattattttgcacttaattattttgttatagttcaacttacaaatataaacacttcatatgaaaaatggaaaaatacttatcggtgacgggctttagttaatgcccgatagagattaagtatatagcccgtcactgatgagtcatctgtgacgggcctagttgttatctcaaacgggcctcaaattggtgcacgtcacggatgatggtcatctgtgacggaccctaacttgaggcccgtttgaaatatggaatgttatctcaatcgggactacagttggtgcccgtcacatggttatctgtgacgggctgcaactttaggcccgtttgagaaatgaaatgttatctcaatcgggcctaaactacggcttgtcactgatagttgtcatccgtgatgggcttaagttttatgcccatctaacatgtctgtatgaccatatctcaatcgggcacttttcggcccgattgagatgacttccttgtgacggcccgctatttctaggcatattagagcccgttatagatagaagaatctgtactagtgctagctatatggaagtagaggggattaatgtgtggcatgaaacaagtacttaggaaaattaaatataccgagaaaattccttgagctccctcaagtgaagaagttgcagaaggttaaaatccagccttgcaagttggagcacagagggattgcatgcttgctcttgattgtattctgctatataattaagcgcctctatcctcttcaaggtccgtggtaaaggtattcgaagggcccgtgttacttgttgagataatggtgacgacttgagatttcttgctattattgtttcgagttgatgccttgagagcaaaatagcgtcttccaattccacctcgccatgaattaataggtgagctgcattgtataagctcaacatgcccatgggatcatctattacttcagcgttgaatctcccatctgggcctttaaacttgttgaactcatctgcaaggaatcatgcgggatctttttatcacaagaatacaaaatcatcgatttcaatccaattcttttacatgttgaaaaaaaatgacccattgcatccagcctctccacttcatgagatacaaattaatttagagttaatgccaattatatatgttaggttaatttgcagtttacacacatactatacctggagaaacccatagcccatgctgccgaagcaaacggaatcgaagcgcgacatcatggaggctggagctgttgaattcagcaccatgaatgtcgcttaaagcaacggcaatacgtctctcgaagtgatggtctattcccaaatgttggagcacatccacaagtttcaatttttcctccacatccttgcaagtttcaaatagcaaagttacctcctccttcaattgatcagcctatccctcatccattcctccgacttctgcacacacactgactattattgactaacacacaaggggatcaaatcatatgaatttctagcatatttttttatgagggaaaagaagtccattgtactctcccgaactatttcactaaagtagttaaccccccttaactatttttttatcattttacctcataattaaactattaaaaatggttcacttcatttatctccttttttttactctttatacgagttgtattttaagctaaaactttttagagccatagatgatatcattatcaaagctaaaatattttcaaaatgtttcatgactatttgcttggattttaaatcttgatgtttaaataagtcttaagtgcttcttacctctctattaaactgtaagaaaaatcgaaaaaaaagttgagatgtatgttttaatgcatctgtcatcctaccagaattttagtgaaaaatgtcttatatatgtagagggaaacataaaggagaaatagtgttaaagcgtaaagtgaaatttttcaatagtttggggtgggaaacgagtaaaaaaatagtttagaggattaagtgttccgacgaaatagtttaatggattttttttcttcctacaacatactacttagttaattgtcaatcccgacgtatgtataattaatcatatccttggtaggatacagtaaatgaatataacacgaatggagactgctgcaaattaggaaatatggatgcttagattagttcagccttaatttaaatgtgctatataaattagtctaagttgcttacctataattgtcttacaaagtaatgtatatagcgaaaactaacattgtgcgtcaactgtggattcgtaggcggcgggcggcgggtgaaaaccttgctcagccttggcccggccggcaacgatggcgttttcgagcttctctttccctcttgagggcgttgtcgtgccgtctcatcttctccaatggggctgtcgggtgaaaacccaatctcgtctctctttgagaccttgacggatggcagcgccagtgtttttgtcactcctctccatggagacgtcgtcaaggcaacccccttgccaaaatcctcctagacaactggtgcaagcttactctctagatgcatgtcctcttgtgtcggcgccctagcgtatgctagttggccacgtcggagggcctaggggggagagcggttccattcttctctctcaccctctttccctcaatcccaaagaggtggctagagtgagggtttggtgtcggttgttagtgttaggttttgggagacatcggctgtagttcctttgttggcctagcggtggctggtttgatgctagctttctcccgggtatgtgtgttggtgctgtcgatgcgtgggggtggctattttttcttcgttttcctggttacaacctcctagggttgtaatcgtgtaattttttctgctctatcaatatgaacctcgcactgtctggtgcgtaccattaaaaaaagtaacatttatatgaactaattctttctttagtttatttccaaagtgaatactatgaaaaatgtactatatatatgatggggttatgctgtagcattaataactagataaaaccctgcatactactgtgagagttttgtataataactgtagaaataacataaatactttacataaattttatctttgatcgactattacaaaaagctacaaacaatcaatatgatgtggtttataacaatttcaattatatataaattacttattcaaaagcaaaactaatgtggtatgggtcaatgagagaaggaaaaggagggactttataagagaataaaagatggaagataatttggaccatagataatcattcaagggttagaaataactgaggcgatgtggcttaataagagaagagagactaccactaactacacttagggcttattcggatcacgggaatgtaaaaacgtaggaatagaaaaatcgtaggaatatgataggaatgtatgtgtaaaacggaggattggaaaacacaggaattctgtagataggattggtaaacatgtgtttggataggcagaggaaaaacataggaaatagaaaaaatgaggtaggagtggatggaaattttcctttgtttctctattgtttccacaggaaaggaatttttcctctgattttcctttgggttgatttctatgaaccgaatgacaggaaaggaaatattttctatctacagtattcccttgaaaatcctctaaaaatccctcaatccgaagaggtccttagtaatggatgcttagattagttcagccttaatttatatgtgatatataaattattctgggttgcttagttataatggtcttacaaagcaacgtatgtaactaaaactaacatttatatgaactaagtatttctttaatctatttccaaagtgagtactatgaacgtactatatatgtgttgggggttatgctgtagcattaattaaaaatactgaaattacatatatgtaagaaaacttatgtatattaagagctagagaatgtgtctacataaattttgtgagtagtacacataaacaataatataaacatgcctgtaacggttctggagtatagttcacaaagaagtcgccccacactgaggcatcgaaagcttctaccaacatgggagcagctgcactaatgttagaagccatgtaagattgcaaactctgctgcacacacacattgttaaaaacagttcaaacgccttatatagaaactggacagcggctcatgggccatggctgccacaaagtgaaaggtcagttcgtggacgttaattaagatatgcatgtgtatcattgtaatgtgctgcaatttttgttatttcactattttattttctgaatcaattaattaagcctaaacagaatacaatatctatacttatctttttttttgatcgttctaaatttatgcagaacgtaccaagcttattacttgcattttggactaaaataatagaagtagttgcatggattatcatcgaattctaaatttagaggtgtaatcagtgtaagcttatgcctcatcctggttgggaaggttatagtagctttaggctgtgtttcgatatcaggcgttcccaactccccctctcgttttccgcatgcatgcttttcaaactactaaacggtttattttttttttacaaaagtttataaacgaaagttgcttaaaaaatcatattgatatatatattttttaaaaaattagctaatgcttaattaatcacgtgctaatataatggaccgtcctgttttctatgtgcactgtttcgtgttgggaactagctggaatgaactcagcttagtcattggagttactccatctgtcccaaaataaacgcagccatgagttttagtgtccaattttgattgtcgatcttattgaattttttatgattaatatttttattgctgttagattataaaatatgaatagtacttgatgcgtcacttatgttttttagtttttttaaaaaaataaataatacggacgattaaagttggacacggaaactcatggctgtgcttattttggaacggagggagtactctatttctatatataggccttatcctttttgttattgcgttatggtaggggaaaagagaaaagaaagaagagaattaatataatctacccttagctagtatcagtcagatacacagatccaggggtgatccaacgtggggacggtggggtctcgatcgagcccccagtactggcgcgagtactatgaagcccccataaagtccccgctaaaattttttgatatatgtagttgagaatgagggctgtagcttttagctactttattcagaccctcctgctatctctttctagatccgccactgcatagatcataacgcttgtaatgttcaaaagaaaaaaaacgcttgttagctagatgagacatggcaccacatttttaaaacacatgcgcacttcatgcataaaagacaccacagtggtggttcacctatacccactgtcatatagggctcacatatatagcgaatgacctgataatacaaaacataaagaaatttgtttggactatatgataaaaagatatacattgatctttgtccattctttgttagaagcaacgatcgtacttatacttattaggcacaattttaagaatgaggaatgaaaacaaagaaattaactagccccttccactctccaaaattatttttttaaaaatatattcctgcacgcataaaatctctaatcttattggttgcatgtattatatttatattaggatcattcaaaaacaaagtgataataattattttctggtctttgaaattactaactagctagttgtgccttatatttgggatgaagagagagtataatagtgtgcgagtgttcatagagatgaatgtgcacacgttatgagcatctgcatttgtattgtgtatctaaaaagaaaaaaattactcatatatacattggtttatgtcactagtggaaaaaggatctttgctcccggttcgtaacccccatgtactcctgcttttacaagcaggagtacgaatccgggactaaagatggatatctttagttctgggtaaaataaccgggactaaaagatggatatatagggccacgtcctgattgatttttttcttttatttttttatgcttgtatatatattcccccacccaaatccatgcaaatcgtgcacaataaaattatccaaaaatcatgcacaacaaaatcaatcctccacaatacgtacacatctacaatctacaaatcaatcacaaattcatcctcatcaacaaaaataaaaaaactccaacaaaattaatatagaaatcattcactatcgccagtcgccgtcgactggccacctcctgccggcgcgtggagggggaggagaggggtgagaggagaggaggaggagatggggaagaaggagaagaagatggaatgagggggtgaggaggagaagagagtagagataaggttgggggaggggaggatgaggcgggtcgctgatttttttcccaattgttacaactgggactaaagatagtggaggggtctgacacagcttcccttcttttaaactgggactaaaaatgatcaccaaccaggactaaagataaaaattaaagtgacatcaggtcttttaaccgggactaaagatgggactaaagaatagatattgactaaagatatattctttagtcccatctttagtcccagttcctattcaaatcaggattattgctgaatttggacaaccgattaaagatggtttctccagtaatgtgtgtttccataggcataatacacagaagtaatacaaaacgggcaaaacatgtgggggcctgatcgattcttatctaatgggaagtagacaactagtatacagtaaaccctgactcttaagcaggcccgatcagtttagttcttatccctatgagaaatgatctactataattggacaactccgatttccttgttctagctagcctgatcaagtaatcagtacatgacgcaaccatatgaaggccccttgtcgatccgttcctatctgatgggaactattcgaagcttgatgtgtgtgtgtatgcacggcaatacatgtgggtaatgcaggcccttatccaaatgagaaattatatactccctccgtaactaaatatttaacgccgttgacatttttaaacatgtttagtcgttcgtcttattcaaaaaatttaaataatttttaattcttttcctatcttttgattcattgttaaatatactttttttatatatatagttttacatatttcacagaagttttaaataaaacgaacggtcaaatatatctttaaaaagtcaacggcgttaaatatttagggacggagagagtcggttgtacagctcatatttgttgcagtacctgtcactgcatgacaccaccactgacatcgttatacgtgtgtatattattgatgccgtggatcgattggatcaccgatccagaacagcagaccattgtttggtagctgtcgcaaattccaactcttgcactgatcgcaaaagcaacatatcggacaaatctcacaaataatgtaacataaagtggacattttgtccacaaccaaaactcttgcatgcatgttgattggatcttaataattaatcatagaagaattaagctgtcgatctctcgcgtacgcgctgcttcagctttgtcgtcctgagcccggagaaggatgcaggcgtgttgaggcactggaccgcgcgcccgcataccaccgctggcaaggtgggggcagagagatgaagaccgccggagcacgtgatttcaccttcactgactgtttgggaggagttttagattctgagaagcagctgtttgatagtcagtttctgagaatctggaaaaactcaaacccagcttctccagtttctggcttcttagttcatttttcagaatatgtaactatagattctcagaagctgtgaactgtttgggatagctttttccaaaagctgcagctgggacaagctcccccaaacagggtttccaaaaactgcagttgggacaagctcccccaaataggacccaagtatccagatcgatcgatcgatggatcgcgtgcgcgaacccgcatgcgtgagaagtgcggacgctcccggccgtttgctagcaaagatgctttctcgttacatatggcccgatttgcggagaccaagatcgatttgatctacgtccacgatattactctcgttacggggtcttacggccgaatttgcggagatggatcgatttgatctacggttgagatgttaacctccattgaatcgacgatcagatttttctaattaacatggaagctcataaaaagtaaccgattaatatagatatagatatagatatagataaatagatagattgatatattgcagcccacttctattccacgctagaagcttgagtaggcctcgcgtgaaggagagtgttggaaaataaagtgaattgtccgtcttttctcatcagattaagcttttaggttaaactgctcaataatgtcgccgccaacgccaacttcgattccgccaccaccgttggaatttaatcttgttgccactgccgattcgatcaatttctccgctctgctcgattttgatttcttcgctggccactgcctgattcagcctaccactgcggcactgcctctagcagtctagctacctctggattttggccccaacatagtagtatctccgttcgatttgattttatcgccactgtctgattttgattctgcccgggatgttggagatagagggtagattgaggaatgttagactatatttggcatgtaccttgattggctcccttcaataaacctctcgatactgtttctataaattggttgagtgtgctatggaaggttgaggcctatatgtactgatctccgcatatcaatatgattatcgtgttgattcatattcactctcatggtatcagactactgatcactcgcttccgctctctaacctcccctccccgccggcgaacatcaccggccattcttccttctccggcgacatgtcgtccgcctcctccaccccaccgacaacttggagaagataacatatgatcatgatatcatgcgggatgcttagcctaaagaacagtgcacgtggttggtgagaattccatatggcatacgatagatatattgtgtgcatactggatacgtagtcgaatttggagagagtccaaatttggtacgatttgagtttgtaaagtttgtttcttgtatgggaaggtttcctaggggattatgacttcgtgtacaagattggtttgtggctttaggctacttatcatggatataaatagagagggagggtatgtcctcccagtatcaatttagatagagttgagtttagagaaaagttagggtttcgagtttggtcaagatttttgtaaatgctattgttgcactttatagatacagagaggtaataaagttttaatctactttgagagatctttgatttgtgtttgctcgggttcgacggtctatctgacgggacaccaacggacagatcagtggcatcgcactggtcagaccggctgggacacgacggtcagaccggaggcggcgacaggcgatagcgacgtaatgggcggtcagaccgaaggtcttcaagcggtcagatcggcacatctactccagtcagaccgatccactattagagaactcatcttttatccaataccccaaaccacaaatgtactggatgtattaagaaccgatactaataactttttagtacctgttctaaaagtgcaagtctccaaaatatgtttagtcctggttggtcttaccaaccggtgttaaaaatgtatttttaagtaccggttagtatcactaaagatatttttaataacggttggtgttaccaactggtgctaaagatgtcttcggggttagttcaaaaagaaagcatctctatccaagttagatgtgtggagttggtgggatggttaataggctaaggtgagagatgttgagttcaaatccaacatcccacatatttttttgactttaatatgccacatattttttttgacttaatatgcatatttagtactaaaggtcacaaactttagtctcggtttccttatctcggttgctacaaccaatactaagagggtttattaaccgatagtaaagatcatttctctactagtgatcgtcatcgaattgagtgtaaattttaattccgctaaaagttttggttttggggttttataactattcacctctctggttggcttgattcttactattcgatccaacaatactagtatatttgtgttcgcatcgaaaagcaccaacacacggttcatcataaacaaattaataaaaagatgaccatcacgctcttgcgacgacgagcgactggtcatttgcaaataaaactagactaatatactcctagccataaagaagaaaaagaagaaacaagaacgtagaatgaatttatatcgattgaggtagggaaatccttgccgccgccatgccgtaacttcatagcactcgaacggtgaatcctcatcagccgacgagtctgtttcactttcccttgtgtgcagccaaacctttccatctccttgctcagccttgattcgcatatagcatgctttccatttgtgtcgcatgaagcagcaaagtttttcattcgcatctctgagcctcccaaggtaatgttgccgctaattaatctccattaaacagactgctatcaaagtgcatgtgcatatccattcaatgatccctccaaacgacctgatcatgcatgcaaacaaatacgagcactacatgcaaaactcataggcagctacccccatggctactaattaaagtgcatgcacaatcaaacaggtgccaaatttcactatcaacaatttctttgtgtacaatcccttatctgcttgcaaccagctagcctaaaagccatggtgtgaaatggcaagattctctagatatatagtaataatgtaagacgggcacaaaatctagcttctacacaagccacgctcttttaggctgcattcaatagaacttattggttacactactagataaaaggtatttgtaggcgggccaaatccgtcttcccatacggataggcgttccgcttgcaagcaaagacttgcggcaatcatttttacaggcggcaactatttttgctatttttgcaggtggtagatcctccccctcccctcgatggctctcctcctccgaccgccgccaccggcggccggctcccctcttcctgcggcggccgttgtcgtcctgtggtagtcattgttgcggccggcggcggaggagagtagagctgagggagagaagagggaggggagccgcacctcccctccgacagcgccaccaccaatgcccctcccctctgccggatctgggagggcagggaagggaaggggcagcgatgcggccggcggtagtcatcatcgtcgcgtgcagtaggcgctgtcgtcgttgcgcggctgacgccctccgcttgcgccgctgcccacgaccccctccgcctgcgcagccaccgatgcccctcccctttgccagatctgggaggggaaggaaggaaggggaggggagggagccagaaaagtgagagagaagggtgagggaaatgagtggtgctggacaggataagttgtggaggagaagacaaggatgggataggacttagattttttttctgtaggcattatttttgtaggcggaccacataaggttccgcttgcaaaaatcatatttttctatgcggaccacttaagaggtctgccagcgaaaacaaaggtatttttgcaggcggatctcttaagtggtccgtctggaaaaattgattttcgcaggaggacgacgagcttcaccccggtttatatttttataggcatccatttggctccgaaagtcatacccacctggaaaaaaaaacccttacatctgcgaaagtgctttttctagtagtgttagctaattagtcctatgcaaaatgagataagccataagtatataactaactaaatgatcatcacgactacagaaaccctaatcggtgctggttgggatacccccttaggtgccggttttcccaaccggcaccacggaggtggcacaatgactttggtcatcggtgccggtttcaaaactggcatctatctgtgtaatagatgccggtttgtatgttagaaccggcacctattaggggagaaaggtgccggttccatataggtgttggttttagcaccaaaggaacacgtggcaagcacataaggtggctggttgtaatgaaaaatcggcacctatatgttgggtaaaaaaaaatagcagtacctgtcaatttcacatacagatcacacatacaattccaatatgctttatattcacatccacatcatcacaaaaacatcattcacttacatatttcaattttcacatccacatcatccaaatcacacaattcacatacattcaccaagaaagagccacattcacattcacattcacattcatattcataggcaatatattccccaaacatattcacataggttttccatcacacattcacataagcagcagcagcagcagcaagcagcaacagtagcagcaagctgacgggagcgtgggcgggaaaggcactatgaatgcatgttttacctactttcggcacctatagtgccgacttatattagctattatgtagtagtggatgcactgcgctttgctgtgggatatatgttagaaattgtagaaatgattaaatgacttagattgaaatattatgaaaatagtttgagaatgatgatttagcatgtgtatgtttagttttagaatgaaataaattatagatataattactatatgcttaatgttgagctttgtgtgtttagtgtgttaatatgccatgcttgcatgttgattttaggagtgctaataaatactatgtttgcatgttaagcttcaggtatttagtgaatattagttttatagaaagaaaatattaagtacaactcctttataaacttgaaaagtgaaaatttcatcctttatcccaaatactcgtagatgaatatatatacggtcacaatcctatttggcataatatattgagattacctaaaagtttgaatttatatatgaaggattgtaaatgttcgttgagttttccaacgggacaaaattatggtgagtaaaacaatagtaaaatacaaatggatttctttttttacaatcccttatctgtagggatggcaacgggtcgggtcgggcatgggtagagcaaaaccatgcccgaacccatgcccgtcgtcgcccgtccaaaccctacccactagggttagcgggcaaaactttgtatctgtacccatgcccgacgggcacggatataccggcgggtacccaatggatctcacattaatagtaactcaaaaatacataatttaacaaagagaagtaaaatcaataatttaccaaattatcagttatcaacaataatttgaattacatcacaacttattattagttagtatcacaaatgaaccaagagaaaggggtataagaattaagagataagtcgaaattagctaatacatatgtatcgggtcgggcatgggttacccacgggcaaaaaatgaaacccggttgttgcccacgatgtctacgggtttcgggcgggcgtgcccacggataaaaaatcacacccacgctcgtgcccattgggtcgggtatccgcggatatccagacccatggacaaaattgcctttccctatttatctgcctgcaagattctctctctagacatatgctaacaccacaagacgggcacacaaaatctaatttctacacgagccacgctcttttaggctgcattcagtagctaattagtcctatgcaaaacgagacagagtatgattaattaattaattaagtactaaccattatatacctgaaaagtgatgttttgtggagaaaacttttatatcctttttacgaaacccacaatttaaccgtttagaaagcatgcacaccatacacaagaaaaacagccgagccgataaactgagagctgcacataccaaacttcagaaactttgaacaccgaagcactctcagccactggtccgacataacgacatgggtcccattcgtttctccaacaaaagttacatgaagatgaagatttttatggcacgcttttcagactgctaaacaatgtgtttcgtgcgaaaactttatatataaaagttgttctattaatttatttttcaaatttataataattaaaactcaattaatcacacgttattaccacctcgttttgcgtgaaacactttaacctttatctttatctttaatctcagaagattcaaataccttcctgatcaagaagtttagggtcgattgtcgtcatttgtacaataattaatacagggcctcctgctcaacagtagtattagcaatcatgcattggacgaaaagcgacaggtatccccgtccatctcaaaatgcccagtgcacatcagccactagcaatggagtactctcctcttcagttccatattgttttgagtagacttttaaagctttgattatcaataacttgaaaacaatatagcaatgtatatatagattaaaattagaaagtgctacaacaaaaaataaatatttatttatgtcttgtatatgttataataaaacacatagtcaaaatatgttttgaagatcatgcctctattcaaacagccccaccatatactatctccgtctcaaaatattgctacttagtactgcattagatgcatcatagtaatacaaatctgagcagatgggacgcatcctaatactatgttgacggttcttaagtaccaaattcgaccttcaattcctacataaaagcaaatgaaagaatacaaaatggaatatcaaacttagagataatggttattactaaccatttccgcaagtcttggtgaatatttgtatgcatgtgaattttggatgaaaaccacctgacatgtctggccaatcagatgcgagtacacggattggaaggcccacaaaccaaagtaaaatcaacatatttgaagccaaccaccatgcaccatcatgagaacccaccaggcagtgtcccaggcaaaaggcgacgtgaggggctcgaccagggttcggtagaagcagcttggctccccttgcgctcagcttccacgtggcgacagatatcgttgtcctaaagtcggtggtgcaaggctcaaggtaggaaacctccatccaatgatggttggaggaatgcggaggatagttattaaaatcggaccggacagcgggctgatcggaataaaccgaaaccaaaatgtcggtacgcaattggaccggtaaacactcgatcaaaccggccagttttctgtatcttttgggccggctataagccggtgactgcccatgtaggcctatcaggcggagtggggcttgtgagtaataaaaaattggagtggggcttgtgagccatgctcgtgcgtaatagaacattgaggaaaaaagagtggaggctgagatttgaacctgtgaccccgtgaccaagtgttcaacaccaaaatacccgaccgttgagctatgaaagctattgtgattttaatgcatcatttatctatttaaaccaggttaaaccgatggtctaaccggttagaccagtaaactagtgaaccaagtccctcaacggttcaattatcggtccaatcttaataactatgatgtggaggcttgagaggagttggaggagaatattcccttagcatctctactctctcaagtcatcttcacactataaatatcccttctactcctcattctcaacacataacaagtggagtacaactcacttatacatttgggctactctctagtagagttataatataggaaaagagaggagggaagctttgaaaggagtgcccctaatatcggaattctctccggtgaagttccggagacgtgcaggagatattgacattcttccatgggagttccggaggaatgccggagatgtcagcactttctctgattttgtaccttgacggatgtctcttttatataagtattggtgattacctttggtatttacttttcttatttaagtaagatatattttcattgttatgggttcatcgctctgcttaggtagagtaccttaatcttctagcgtgacatcgagattagcgtagtaatcaatagcatagatgcgatgtctaggctgaaggttacctttgtttgttgtgtgctccatgggttgtagaggtaggcggcaagtggtaacagccatgtccgtcctttgtaatccttcacgtttgggagcatcatagagctataggccggagtctccttggcagaccaggggtaagccaatgcctgaatcaatagatagagttttaccataacttatttaagaattttaacccataagaatcttctctatcccaagcctaccatttagtcgttgtccttggaagaatcatgttcttagattatacacacacgttccctgtggatacaataccctggaatactcttgggtgaaagctacaacggtacctgtgagcttgcagattattctgtgctcgtaataaataccagcgtactacgaatctagacaggatgattcatggtactagaatgtgtcacataaaaaactaggtagcaacaatttaggacggtagtttgcgttgtagagtcatatgatgattaatcttggtgatgaagaaattatcaaaggtaatgtttattgaaatacgatgaatagtattttcggattgcaaatggagttatcagctcagggaggccagttagaccagtagtgttgaagcggtctgactgggtagctcgacagttagaccagcaaactccggaagagagtcggtttcaggttgttttcctggattttctagattgcttcatggttgtgacttctagatggtttctattcgtatatgataatattttgtgctgatgtgacttgtgagtcaagttggtgcaaactttataaaacattaacaaagtaactaagaaacaaattagtgatagatcaatataactataacatctgaggattagtagcactcgaaaagttgatctcttgttccaacttacactaaattaaggaacaaacctggtattctactcattagaagttacaactcacaagaatacaatattttgagaggcaaaataactaacaaactcgccgtttgttataggttagtgattatataaatttgctcatgctatagtggctcgctaagtaaaaatagcggccgctaagttccaacatgctatttccagtctgctacatcgtagcggtagcggtaggaggccgctactgctatagcacccgctatgaacgctatttattaccttgatcacatgtcactgtggtgttcggggtccaagatggcttgaagaaagcatacatagtaatgacctcacctattcctaggaagggatagagaaaaggttggttttacttcttcatcgataccagttcttgccacctcaaattctcaaccaccaagcctgcccgatagaaaacgtggtcctctactcgattggaatccaaatccctttatcgagataactcgagagttaagggagtattctgatagcgcatgaggttatcagcgatttcatgcgtcatcggaaccatcctttataagagcatgatcaccatgtgcacgagtacatagctaacctggatgatcttgcggagtacggttatttttcctcttcaaatatctacattgtattagttgaaatataaaacctaaactgaacttcaatgtgcagatattttcaaggacatggtatgtcagagaagtaggaccggaggttcccactccatcagcaacatggggaactgtggagcccacaatggtcaaagcgagaactaaaacagggacccaagtagtgcccctggccgaagaaggtgacccgaggacaactgcttctcggggccgagctagcgtcaacttagggccaccacggtcactgcacgtgggccagggccccgaggtctgttacgagcgagtttgtctttgggtagatgtgactcagtcctgccggctgcctgaccccgtcattcagcattaattacggtatcatgtgcacaaccttgccccgttattccacattaattaccatgtgatatggttcctggggagagatcacgggcggcgtgggagatgtggcggtgcatgtctctcctcgttgcccatgtcgccccggagaaaaagtaagtgacccagcgtgtgctccatgctcacctggctataagggcccacttttctcctcctctgtggttgatatacaggcccaatgactgctggggtgatggcttgggtgactctgctccacgcatcaaccagtaggtagaccctttgcatccagccggtcctcttagagggacaatgagaagactaagcataccaacttcctgtgggctgggtcccacatatgtatacttgcatgggcactgtagtatccccttggcatgtaaaaggaggaccaattccacagagaaaagggttcaattcagaaatttggtttagttggtctaagttagattctagacacaagaaagtgaagaagggttcatcatctcccacttagaacaacatccacccaataacacattgtaatattgatcgcatatagcaagaacacaatagtagggtattgtgctttcaaacatcatgaacctgtatatatcttttatctacatcctttcatgcgatccaaacacaacctcggtacctgcaccctggccgaacttccaaagggggtcagggtactttgccttcctgctagaggagcttcctactttgacacggtcgaaagactgtaccaagaaggtggtggctgttgacggctattaaatgccaattttatatcgccaatacatgcataaatcaaggaaataaaacatccaacatagtgaaagggttaaattcttacatattccacaaatattggtgaatatttgaatacaggtgacaaaccgccaatgttggatgaactatagacttaagtgaaggagaattcctatccatatcacaagcgggccaagaattacactaaaataccatcaaatgggccttccactcgcagaaatggatagaagaggaggaggagagacaacaggccaaaacctgggcctgttggaccaggcctgggttcggccgaaccactcccgcaaccgtccgatgtagggtttggcagggacagtctggatgagctcatgaatgacggttggatggcaaaatggacttttcgtgttttacaaccgttatacctgcccctatataatgacttcacttcactcacttcaacacacactccaagcttgagctgaattataagaggctctattgtactttattgtatactagattagggagagagtagagtagaagaagttggaggagttccggagttgtcggtaatccacttcttatttcttttgctctgttaattactctgattattatagaaatatcttttgagtaatttagttttgcttagtgagatttacttcttgattagttcctaattagcatacaggatcatcgttcattataatcaattaaaatatagtgattgctttagtgtgtagctaacattaaagtaagttattaactacttagacgcggtgtctaggtagttgatttccagtgtttgctctgcatcccacagtaggtgtgaggtggtgacagccctcaagatcactaaagtcctcccagtccggatgcgtagtagagcgatatttcagagcaacaggctggccagtgcccgaagtatcgcgttaggattaaagttaagctttccgtagacactgtttctcacaggtgaatcctctctatccttagcctatctttagctttgtgtccttggacgaaactggtgaagagctgacacacacattccctgtggaaatcgatacctgagaatactcccgggtgaagtgctacatcgttttattccgtgcgcttgcagattttatctgtgaggttaagaattaccaacagtggccaacaagctgagcattgctgaagatatccccagccccttgtgcaacctagcccaagttgattgggacaagatcatgaatgtaagtattcaacattcctttcttaccaccttattgatgccataggattttaatgcaaatacttctaggaacgatccctcatcaattttgtcgagccccttgtcaatcaccaggaagctcctggcaacagcggcagcgccttgctgctaatcggtggcggtagcattttgctgctcctcgaggtcagcatggtccagttatatggaaatattgaacacacaattgacccactttggaccgctcaaaccggcgggttgttaggtgaaccagtagtaaaccgtcttcagtcaggccaggactaagacatgtcactgctttaaataggctagaaaaaggcccggctaactcgtgggtccacaagcacttgattttgaaaatgggcatggtggggagtcaacccgaggtggttgagctaggggtaaactcccataaccatccgaccactgcgttatttgtgattgtattggaacataaaatttatctctacgttagtgaattgcggttcgattggctagatagtcggataggtgaaccgagaggttgaccaagtcacccaccagtctagtattttcaactatgatgaaggtgagatcaactttagttcatgcgctccccattcttttccgcaaggaataattagtgtgtatcatatatatatgctggaattaatgccaccaaactgcacacaaatacaactcttaacaaggttcaaatagatggaaaccaacggcgaatctcttacgtaccccacttaattttattaaaccatatttgcatgcctgtgatatttgttgggaccaggatttgaaccctggtggtaggtggagtgactcccactgcatcgacttcccaacttaggaatatggttgcggaagtaataagaaaagaaaatcaatcatagtgcacatatgatgaatgatttcgaagcgcatgatataactcgttatatacacaatccaaacgcttacacgctagtacgtacatggacctacatgatgacaatacatagtgctgcatatgtatcaacgcaagttgagaggttcaataatgaatctctcatatgatcaaaacaggcatcttaattatcattattgtcatatttaactaatatcccaatacataataattaaagtagttcacacttctacgtgcggtacctaaaggggaataggtttgacaaaatggctctccatcgtccttttgaaatccttactgtatgtgtatgcatctcttttgtcaagaaacaaaatagccatgctccttgataggttggtgacccgatgtacaaatggcaacagttcacggcgatcaatatgagcttggtttatggttttccatgcatcttcgaccaaagaacctatcttggctagggcaacctcactggtaacattgtactccttgatgtagcactccacggagctggctacatccaatttgttccttccattctatgaagaaaaatgacagatttagcaatgtgcatgtgtatcaatataccatggtaaagttagatttgatatttacaagagagatcctgatctctagcactgctgttgcaatacgacatattgacacatggatctgacatgctctaggatctatatgtcagtgactcctactataaaagcaatacagtagaggagtaagttctatttacaaagcttaaactcataccttaaatgcagccatgtcatccatgaaacgtgccacctcaccgccagccctaacggcatcattgttgccaatggcccactcaagtgtctcctcggttactatatttcccatgccgacaagtatacatacacttagtgcttgaatacctgcagacatcaccgacacttctatttgctctttgaaacttggtacgtagttatgatggaaccattctgcctcctggagataatacccagataacaattgaaactgcataggagaaaacagaacaatgctaagatctatgaggtaggggtgtgtgtgtatcacatagtaagtgcatgctgatactacctctgttctttacttgtccaaacattgatatatatggctgtgttctttttagatgtttgaaacagtaattagccgcacgtaaaacgagaaatgatattagcatatgattaattaagtattaatatataaaaatttgatgaataaatttattagatttttttaaacaacttacacacacacatatatatatatatatatatacacatatacatatacatatacatatacatatacacatatatgtatgtatacatatatataagttttcacgtaaaatacaccgtttaacagtttgaaaagcgtgccaacgaaaatagaggaatagctaagccgccatagtctccaatgtagttgtctcatcattaatattttttaatatttctaaaatatatttaaaaaaaaccatataaaatattttttttctcatcacagatctatcaatgctatcttcacatattaaatcttaatatttttatccagtaatgatttaagaaatcaaggtattataggacgatgtccttaacggaggtagcgtttcattttttgttttatgtgcgtttagtcccattacaaggatcggcaaactttttttttaataggatacgatgactctatgggggacggggtagagaggagaaagagcaaagggggagaccaagatgattgacatgtaagaccatattgtttttattttttttctcactgacaagtaggtcatatgagcattacataggatgagactgctatccaaacggtcgagggaactgattggctctagtttttaaagattggggagacgttatactcggtatgagggaggatcaagacttgaaggatccacaatagactaattccttttctggatgacgaggagttgctgccttgctgggccatggcccaagaggcccatgggctactgccactccgatccagccctacttagcggagtaaattatctgaaacggaaaaaaaaagaaagaaaaaaaaggggcgcacgaggccgaggcggcaccggcgtacggtggcaagcggcaggagccaggaaggatggggaggctggcccgggaagcgcggctcggtcgacgccgcctcgacggcggagaccgccgacgaccagactggaaaagcgagcgagccaacttcttctctgatttctcagctcatctgacattctgactgcgatcgatttgacttgagaagatggagagaagctgtataaaggaaaaggcaacggcatctctctcgaagaggtgtagatattgggaattcgaggacattgcaaatgtgtgtgttgtgcgcggacttaaggacagatttgagcggccggcacatatataattaattggttaagattgattgctcgtttgtttgtttgtttaatcataatcttgggggtctagtgagaaatgttgcggcagaggtggaagagctaggcgaatggaagatgtggaggtgccattgggttatgttatattgtcatttatctcaaatatcgttctactaattttttttccttggttccttttttgtttggcagattgtacctatttgtatgctctacaaatcaatatattcaataagttagtcatcttttgtggtggatattcagtttttgaggtatttttcagtgccctactttttcaagcaactttatatgtggcgggtctatttaatctcacattgtggttaggcaaacattgtttttgctttattgtctttactatccattccaacagtccgcaacacctctctttttctttttaaagtccttcaccaatccatccacctatttgttaaatattgtcttaattttcagttacaaatagtaatttcatttcaaacacctagtcaattaattcaaagtttgaagtatccgtggatttttaaatatttacattttgactcatgaaagtttgatcacatactttagtagtttccttgaaaattactccataatattataacttaaattgttacaaataatataaattagtgattgattaaaaaaatagcatttggaacaccatgtcaatatccaaaattatatatacttgtaactggatcaaaggagtaatatgtaagcaccatgaagcatgtagggtttcaaaaattacaactgtccaaataccaaaaggagactggttccaacttttatcaccgatttgctttagggaaactaaaattttgtttataaattagttcacgaaatataagcaataggaaggtgagccaaaaatggtggggtccttgccagttttttggaaccagcataccattccaagttaaaaacttgggccagaagatgttacttaatttatctttggtttcagttacatcagtggtccttgcctgtttttgggggacctttcttttaacttaattccaaaattgggttcctgttacatgtaataaaatatggttgatgtttttaaggaaaaatatcgtagcaccatgaaagatgatggcatgtttacttgatcaattagctatagtgcgaattttacatgaatattagggaaatgaacatacttgctatttaatttgtaaaatcaataatacaaacggaggtaaacgtaaaaaggtgtcataccactttcctattgtaagcattgcggtgcctaatatgtggttccaattcattctcgaactccacgaaattgctcatcaccttgagaaagaatttcttcagataatctggtagaacagaaatatcactctcatcccagctgcatggtcattttttgcacgaattagttagtcaaatttcacctcattgattatacccatgttttgttctctagatgaaagttaatcaaaaataatagtataacctttgtatggccacattgagatttcgacattcctccaaagtagcatgcgtatcataagtgtcatctaacaatgatgttaacatgaaaaacttggcaaggatcatccgggcacgtgtgtactcctcctcaaagtacatagaatatgaccaaaagtagcattcaacaatgcgatcccttatgtagtctagtcctatgtcatttgaaagatcctcccaccacctgaaattaagaaaggatatgtgtatgttgttgtaagtgatagtaaaaaagttctagtcattgtcaaattccatttatattagggctcatagatattgagtttgatatatttagagcatgctccgaaaaattactgagtaattgtcttgagctccctttggtgaatatgttgaagaaggttaaagtctagcttggcaagctccagtattgaggggttgtatgtttgctcgtgtacattgtactctaatatataagatagggcctcaaccctcttcaagtttctggacaatggtatctgaagagcacgtgaaacttgctcagctaatggggacttcaggttacttttcattaactccaaatgatgccttgaaaataagatagcttcctggagggcttcctcgttgtgggtgagaaggttggcagcattgtataagcttaagagaccttttgggtcatttgttatgtcaatgataaagcttccatctctgtgtttgaatttgttgaaaacatctgcaaagtacacacatgcatgttaaaatcataatatttgttatataatattctttttgttaccagctcttttcagttattactaagcctgggaattttgttaacattaactttcaaaaagtagagttgcctagttgaacctaacttccggggtggaaggcaatcgaatttggcctagagcttcttaagaaaggcattatctagaggattgataatggccagtcagtttgcatttggcgagatccatggatcccgagagacctctctcggaggccgattaccacgaagggacactatcgtttgaaatgggtttctgatcttttgagcccaaatggttcttgggatgctcttaaggtgtctcagaccttcctgccgattgacactgaagagatccttagaatccgtacttcagtgcgtctggaggaggattttcctgcgtggcacccggataagttaggtcgattctcggtgaggagtgcttacaagttggtgctctccttagcaactactgatgaaagctcaagttcttcaggacaaaactctaaggcggcttgggatatgatttggaaatgtgaagtgccacaaaaggtgaagatatttgattggcgggctgcaactaatagcctggcaactcaagccaacaagaaaaagagaaacatggagcgagttgatgtttgctgcatctgtgggaatgaaaaagaagatgttgaacatgccctttgtcgctgtcctcatgctgttcatctttgggcagctctggagaattcagggtatttgtccatgggcgtagtcggaaatggtacaggaagttactggtttctcaaccaagttgaaaaaacaccaaaggaggagagaatgatgctgctaatgcttctatggcggatctagttcgtccgtaatgagttatatcatggtaaaattcctccgcctattgatgtgtcaaaaagattcctggaaagttactgcagttctctgcttgaagttagacagtttccccttgtcgatgtggttaaagggaaacatgtggttcagtctggtttacagaattgtgtagcggcaagaccagagaaaagatcagttccatgccgttgggagcgtccgcagccaggctggatgaagttaaatgttgatggttcctttgattcgagctctagtacaggaggcataggggcggtgcttagggacaggttaggaactgttattttttcagcctgtggctttatagagagatgttgcaaccctcttgaagctgaacttctagcttgcaaagagggaattaatctggctttgcaatggaccttgctgccgatcattgttgagtcagattgtttggttgcagtcgatatgatccaatctaagaagaaggagtggtctcagcttgcctaccttgttagagacataggagagatgctgtctgaaggaagggaagttagaattcggaaaattcagcgtagtcagaacaatatcagacattacttagctaatagaggccggactaatgctcgttcggagttttggccggatggaagttgtaatttaatctcacaagctgtttgtaaggaggctttagctgagtaatatatctgtcttttccccaccaaaaaaaaaagtatttgcaagcggatagcatatatttccttcgtattttaatgtttgacgttgttgacttttttaaccaaaatttgaccattcgttctattcaaaatttttgtgcaaatataaaaatatttatgtcatgcttaaagaacatttgatgatgaatcaagtcacagtaaaataaatgataattgtatatattattttaataagacaaatgatcaaacgttgattaaaaagttaacggcatcatacattaaaatacaaagggagtattagcatataaatatttcacttttacagcatacctgatgaaacccataacccttgctgcctcagcaagcgaaaccggagggcaacgtcatgaaggctagggctgtcaaattcagcaccatgaatggtattcaaggtggtggctatctcttcctcaaagagatgatctatccccaggcgttggagcgtgtcaactagattcattttttctgccacaccatcgaaagcgtcgaacagctgacttacgtcctttcttaactgatcggatctctctctcatccatttctctggccgctgctaacacgaattaatacatatgttaggtaaaaatatgtggaaaggagaagcaatttgatgacaatttatttatctctcatggtacatgagaaaaggtattatactgcaagcatcatgcatatcgatccatgaaaaatttatggtttcagcagatcactttttaagcaaatcatgcatgcatggtaacctgtacgaatcgctaaagaatgctatatatgtgtggaaagagcttgttgacatgtagaaatactggaacaggagaacatgttcatgaattcgaatataaatgagatgaagtgctagtttaagtactttaaggaagaagttatgccacctttattgaaaaaaaaagggaaagggtttaaaattgatcatgcatatggatcttatttgttttatcatttttatatttaataaatattataagttgtcccttgtcatggtgaaatgtctaacatgctcgatttttatgcattataatccacttggatttgtagattgcgaattcagaaatttgaagtaaagtacttgaggcatttccaaaaattttgacgaagtacttgatttagttaatcttggttaattagcatatccaatactcaactggttaagaacatgaagcccctagctaaacaaaaaagatgaaaagcagcccagtgtgtttgtgtaatggcgagactacgtgtgtattctcttgtaattataaaacagaaaaatattagaaagggaagatttagatacaaaaccatttggcttcaatttgagataagtgtactctgcactaggtaagggaatagagtgtacgagcatgcatgcctgcaagggttgtggttcatagttgataaagaagtcaccccaaactgtggggtgaaactcaggtgctgccttgggagctgtacaacttgaagaggccatgaatttgtgtgtgtggtttgtctgcagctaactggtttctgttttagttgtgactgacctgcaactacagaaactgtgtgtgcactgcagatggacaccatggagaggtttatataggcaccagagaagctaagttaaatgagaatcacgatggacacaggttatgtctgggattttcccaaaaaaaaaaaggttatgtcttgttatgagacatgcatctttcgttctcttcttttcttttctttttttttgttttttgttttcggcgaggattctctttttgtttttccaaactcaaaggtttccatcttttacaaataaatatatattaccaactactaattaatctccgaaagtgattgataggtcaatgtatggtgtatagcatggttcagttatgccttgcaacggtaaaagacacaagctatcttttcatctcgcttttggcacgtgtcactacattggtttgtgaagaccgatgagaagtagaatctggcttttgtgaagaaaaaataccacattgtagagctgaaatcaatttatttactcaccatttgccacaatcgtaagcatgtatagttctcaacccctcaccatgttgtctcgtccttccctccgatttgttctctgtactatgccaacgcctctgcttggagggatcatccatgtcgatcgtctctttctctcacatggatcttttgtgattcataatggaactcaattttgaggttttgggagacatttcttttgataagttatttacctcgttgaataatcttgctagcaagaaaaatgtcgtgttggccaatgtgttcacaaacgtactacttgatgtctcctttagaaaagccctaattggagataatcgggtgactttatatgatagggcaattgcgttttttaccctactttgaagactaaccactgatttggtcatttgactctcttttttagaaacgaaaatggggcttgaccctattctgtgaaggcaacatgacggtgttaactcaagacaaaaatttcatttatacccttgtgaatttaacctagtttctcaaagttttttattcagttttgtgcaattagtatatattaaactgaatcaaacaaaatttcatggcacaaatttatgtccaccaaaaacaaaaagaaaaagaaaaagaaaaaaaacatgtcaagcagcaggacaccacgtcgccgacggcaaactcccgagcccatccgtgcggagcagcagccaccaccactccctccgccctccggctccactgctcccaccctccacgagccattgtcgcctcactgtgcgctgatgctccctttctctgtgagccgccgccgccggtgctccctccctccccgcagcaccaccgcctccccactaaggcccgccaccgctgcgtgcgtgcctcggcgccactagatccgtagccgagcctccgccaaatccaccctaacactgttgcccctcctcctcctcatcgtcaagccatcgccactgctcctcttcgtcaagccaccactcctcgtcaagccaccgttgtccctcctcctcctcgtcgagctgccgccaccactcctcctcctcgtctagccatcatcgcccctcctcctccttgtcgagccgccgctgccgctcctccatctcatcaagccgctgccagccttcctcctcgtaaagccgccgccatctgtggacctctccatttgcccccatctgtggacctctcctaattcttgttgacagtcaatgtcaagaaagtggggtaataactaggtgtgtaggtaagaaggtgcttcatgtgggtaaaatttccgtttaactttatatattcatttcattcttaaaatatagcaatttagaatccagattagaatattctagtactacgaatttagacagacgattgtttactagtggtatgaaattgcatgctgcaaatagaagaatatatgccaatactatcatatttgatagactaatttctctctaggcttacatattttctggttcctgccataattaatcctttttaataccacaattaacttgtaaaggaacttttaacaaaaggcattaattaattgtgtgtgtatataaacctaaagaaaatatcaaaacggtgatactacccctatgtcttagaattattatttttaagagaaatactattagacctgcctagtagttatatttaatttactcatttgcctcagacatttatttgctttgcatgcaaccaacttggcaccctaaattccgttaaaatgtgctgccaaacagcaagattattcgctagacatctgctcggaaagataaattaactaataatgcttctacacaagccatatgatctagttgaatatctattatattattaaaggaatagaaaaaggagcctccacattcgctcacatggcctagaaattttcacattaatcgggaaaaaagaaaaaacagagtccatatagaaatacaatttagaaatagcagaaattcgaaattaaaaaataaggaatattagaaaaggagactagagtccatatagaaatacaatttagaaatagttgaaattcggaattaaaaaataaggaacattagaagcaaggttgtcagtatcccgattcgtatcctagtatcttacgatactacgatcctaccaagccgaaacgatactgatcccacatagtatcctaattttcatagtatctcgatcctactattcattactacacgatcctacgaaatcttaggtgtatcccgattctacgatcccaacaatactacaaaatatgatttaaaataacatgatttgaaaataatgtaaataaatatgctcaaatttaaaatcagttaaatatatcaaaaccaacatggattctcttgataagtctccatttgcacggcatatatcattactatattttttaatatagaatggctatatataattaatataaatataaattaaacttaaaaaaagaaaatctcacagtatcccgatactacgatacgatcctatgatacgatattactttgagcaaaacgatactacctagtatcctgatcctgacaaccttgattagaagaggtgactagagtctatatagaaatacaattaggaaatatctgaaattcggaattaaaaataaggaatattagaagtagagtatagagtccatatagaaatacaattaggagataatataaattcggaattaaaaatacggaatattagaagtagagtatagagttcatacagaaatacaattaagaaaaaaaatagaaattcggaattaaaatataaggaatattagaagtagagtatagaatccatataggaatttaaaactaactaaaattcagaataaacataataaaattaaaagtagagttttgagtccgtataaaaatacaatttacaaataactaaaattcgaaattaagaaaaacatgggaataagagtttaaagtcaatataggaatacaat

SEQ ID NO: 73611 - DNA, 4250 bp, Oryza sativa
tacagggtgagggtggtggtggtcgtcgcgacggcgagcctcgcgctggcggcgttcggcgcggcaggggcgcggctgggccgggctcccggtggccgggccgggcttagggcgtggtcggagggttgctggccatggccgccacctatggcgtcatgaagctcttcagaacacatggcgtttgatgaagctgaatcatgattaagttgacatgatgtaaaattatccaaatgcatagagacacggttttttttttaaaaaaaaaaaagcttcggctaaacatggtgagacttaccgattagtgatgcaacatgcgttcttgcatttcacaggtaaaaattgcttctgcataagaagaccagatatgaactggttaccaagtttgtccatggatctgaatgctccccaataaacagaggaagattgcaaattcatacattttccactgttccacaccataatctcatttcttgccagaaaaaaaggaaacgtcagactgtaccagaatggaaacaacgaaattctactgaaccaacatggttgaactgaaccatttgattgcatctcactgcctgcatgcgctgcagataatcatttcagctttacaaaatcccacagcctcagatcatctcagagcagctgcatggatggatatatatgtcatcccgtaaatatatatagagttggtaacatcctagtagctactagcttgcttaaggtatagatagtcagctaacgcgcgctacatatataatatatacaaaacgaaaactttcgtcatcatactatatatgctaaggttctccatctgtgagtttctctcctagattggtgccgctgacctgtgttttgccgcgatttagtattgattctttaacctccctgtatttcttcagctcctcaagggcgtcagttgccgtcaccggtgtagaacttgatgcgatgctgccatgttcctcagtcacgaccttctgaactgacgaaggttcttgaggaaccacagcagctgcatctgactgtaggccttctctgaggcttggtgcagtcttcagcagatgcacaagagcaccaatggctgcagctggagaccttgtggacgagccaccagcatcttggttcttctgttcctccctgtctgagatatcagccctggaaaattgaggaggttccagttttgcttatacgaagacttatatagaccccaaaaggtaattgaaaaatcagacaagcagtaaatccacaatatagactctttcactaccaaatttctttgagcatgtactggccattatgctcttctttaaaaaagaaaacaccatcttgctcattgctaagccttataatagctggatataatgggatacaatcaaatatgtaatttgataaatttattcctaacattagtaggctagcacaggaatattgaagtatctggttcaagaggtaagctatgatgacctgttttagattgttgagttagaataagttgcaatttctggaacattgtagataaatagttataaaaaaaagctaaaagtagttaatagacacagattgtcctgtacagggtaaatggagggtgggctaagataattattacatgataaaaggataatttgtgcagtgacattataaagtaacaggctagagattgtcagctcctcagttgaagctatatcagtttagtagaattaagaccgtaagctgcaaataagttaggtgcaggaaacaagtagaggattttaagacaactgaccttcattttgaatatttgatttatatctacaaaatcatctcagttccatgcctaaatattaaaattgatgtacatttctatcaattatctttcctaaaaaaaccactctggtttgggttccagttcatagtttgcactgtacattgaaatctagcctgtaatgcaattcatattcttatattaatttttcaatgtaaattactattctcattagtcaccagaacatacacgtgaacaggaaaaatataaaattaagcaaatgtcggaaataagaaactaaggaataacataaattaatgaatagtagttcaagagtacaataaaggaagaaacattatattgccaattagtatgagaaatagatttttttttctggttcaggtaacattgagacaagaaattatgtgactattgagcatctaatctagaatcttgaagcaagcatagtgcctcttcagttctcattaagaagagcccactttgaattaatgaataaatttttaactataatcaaatgcaacaataaggttcacaggccttaatgagcattacaaaaatatagcataaccgtctttaatttgaagaaaactacatagaacacatttctgcattgcctgaaattaaataaccctttcttggagcatgtgcatattaagggcatcattctggaaatactcaggtgtcaggcatagtctcacaaactacatactatttcaattaggtgactaggaaagaatacctgttaagctgatcaattatggtgtctctatcttcccatgcaaaaaccaattcatgttcatccagttcatccataataaaaagtttacttgatgtccgagtcaatttcagtccatgaaagtatcccaaatcatatttactgtaagataatacctagggcagaaagcagaacaagaaaatcatcagccaaaaatcagatccaattatcctagggtaggaatctcataataaaattattgttattggctcattgcaaatttcacatgttgcttgaacaaataacagatatcaattaccttttgcaaggccatgtccttttcaaattcacccaacctgactagatccttccttacatttgagttatgatcaggggaatgtgccaggttgtcattgtgagatgagaactggtgcttacccttcgaacatggagaaggaggcaacccgctacctcctcctccgcctgacttcaatgtgggaatagtaactggtgcactctcatatcggaacaaagggtttttagggtagttagctgaaggggattgggatggtgatggtgacaatggtggtgatggatagcattcttcaaatggtgtatatttcttctgcccagaggatgatgcattttgtggatgtgagcatgtttttagagaaacatgcagaggaacgcctagctgtgggcttccacgggattgtgccttagtgggagaaggagatggcgacactgacgttccagctccatgctcaatactccaactgtgcctcctggtcattgcagcacatgcaggtgcaatgccagctgaagggagggaattgaatttctttagaaagtcagttgtggggctcccaacgtaatccgttatgatctctggtggcattggtgatgtaggttctgaagctgccaccacctccaacactggcacataagaaactgacaagctcaatcggccaaacagagtttcaattggagcaaatgcatagtgtttcatctctgcatcctctgcccgggtgaatggctcaacaaatgaagatatcttgtgtgacaggttgagaggacggattctcccagatgagttcagttccctgaagagactgtatgctggcaagagcctgacgagcagatgcaatgaccggagtaacactgtcgatccctggtaggtagccctgtacaagctatgatcctcagccgagctgttcctagacttcctgccattgttcttgctgccattaccattgccaccgccagacttgcgagcttcatactgtatcacccacctctctattatcttcccactcccagcagctgtgttgctggtgctgtcccggcataagaggacaatgtcaatgaccaacggctcaaggttgctctgccgccacaggtcaaagttctcgagcacagccgggcagtcccggagcgcaaggttgaaccaccggtcgcgtggctggctcccggacagcggcgaggacggtggcgagggccgcgtgaagttgcgcgacgactcgtacggagagcgcgactccagtatgatgtggaggctcttggcgaaaaactcggtgatcacttgctccaccatgggtggctccgcggcagcagccatggtatcaaacacctagtgtgggtgcatctgggttcagctaattttgctttctttgggaaaaaaaactatgctattaattcgagctgcgtctccaatcttcgccacgccggtggcggagggagaagaagaacgagtaataccttatccggagccaatctcgc

SEQ ID NO: 73612 - DNA, 5818 bp, Oryza sativa
ggccgacggcccatctagagaaaaaggaaggaaaagaaaagaaaaagaggggaaggattttcctgggattaaaattgcactttggtgatttttaattggttaaaattatttccaaggctctgaaaattccactaaaaatcttgttaatgcattggagcatggggaactcaagaaaaattccaccacgccgaattcaattattaattgcatttattaattagggaattagctctaggttaaataagataatttcttcggacgatttatttagccaatttttaaagcaaggagagggggaaacttcagggtgtgacaaacttcagggtgtgacagtgtgaccgtcctttgtgcgattgtggggatggatgcatactcaagtcttccctcatgatacaaactcggggcaggagattcttccaatgcgtgaactttgatcaggtatgcttcatctattcgaagttcaaatggataaaaaaactaacttcttcgtacacaattgtaacatcttacgcagacatatcgtccaatgtgcaacttcatcgagtaggtagacatggagaacccacaaaacgacggaacccgtgcttacccacgtagtgaaacaagatcggactacctaaggcggaaggatgagcatgaacgtcgaattgctgctgaggctttagaatggcacgtaaatccccttggactccccacgtggcgtgagcgtccgaagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatagattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactaaataacattactatttttacagggcaatccaatgatgggtggatttactcgatggatcgacaatgtcactccatcatatcatggccagaagataacagagtcagaaacacaagtagagtatcaacgattgaaggaccacgagaatgcaatgcattctaaccgacctagaaggggccgataggttactgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccaagagcgaacggccgtctgccacgtcactttcgctgccctctgggatggcgatttttaaaaatcgccctcccagagagcggtaggcgaccacttctgtcaattttcaaaatgaaaaattatttttgtaaaacttttaataaaaaaaattaaaaataaaaaaatttccttcccctcggccttccctcgtctagggcttctcgtcctccgacgacgacgacgcgagcacggcgatcggtggtccggcgcggcaaggttcgaccaccgcctcctgccccctacctccctaccttctccgttctggttttgatttttctgctatctctcgtctgcgcgccctgtgtgaattggctagatctagtgaaaatggctcgctcggttgaatcgagttagaacggccagatttgttggtgagtatgcactgcgggttgaaaatactggtaatttttcgttagaaattttgcccaaccatcccttccttggatcaacctgctactcgaacccaaacccttgaggtacagtttgttctttcatttcggacttctccatctacattcactaatttgttatgagctttatgatcattgcggtaaatagcaataggaagatacataacgtcacatgttttacgagggcaagtagtagatttagcactaataatgtgagcttatgactggacattcatccgcatatttctgcgtcacagataactgcctgcaccgaatatttccacttcagctctcttccttttttgatattgattgagtttctctgttctggagtttatcttgtttatctgtatagttgtgttcatgtgaatctgatgttatagggtgaggcaatggtttctgcaattagtgggggacttattttctatttagcctgccatgttattcaatcttttgttcaaatgagaaactttctgtaacacttgggagtatttatcagtcttgatgaatttgttccatttcatggttgtgcagcaacaatgacggctggatacattgccggttccctggttggatcatttgccattgcttacctgtgtgacacatttgtttcggacaagaaggcatttggaggtgactgtcctcttacggaaatgcctgtgcttaacctcttgtctgtatctaaagctgcattattttttttgtaaacaggtagcattccaaagactgtttctgagaaggagtggtggctagccaccgacaccaagttccaggcctggcctcggaccgctggaccaccggtcatcatgaatcccatcagccgccagaacttcatcgtcaagtccgctgaataggcgaaaccgtgagagaagctggttcagcgtcttgtttccatcacggagctgaaggttattttctaggtcttaaaactgtaataagacatttttgcagtttcagtcatatcggtgagcaaattttggggcttacagcttacttaacatttgatgagttctgttcgtttgtgaaaattacctcctaggagcaaagaattgtattgttctcctattttgctgtgttcttttgccaatctgctgcttaagctcattttgtggcgtttccttgccttctgtttccgcactttggaccagtgtttgtgcatgatttatgcttgaaccagtattggtgaaaccgtgaaagcgattttgtcagaccctgtaataatgtcatatatcctgttgtgcaagggtctcacaatgcttcgatgctcactgaagactttgatgaaaacctcattttcacccgtatgcttgcatatgcatatgatctgatcagttggttgcgagaactctatgccaaaaaaatgttactacaaaaatgttctgcgtctgctagcttctctgcccgtttctacaacaagctgtggctcaggaggaaagcaaaccaaaacaattcaacaagctgtgctcaggaaaacacaaggctatgttttcggcaggaccaaacttcatttgatggagacttataattctctattatcaccagagaactgttgtacatgttcagtccatattctaccaaagtcttctctctccatcatcctggcttagcatcagagatttcatttacaatttgttctaaaagccagctccccgtggaagtatttccttgtttatctccttttctccaaaattaaccagtttattttgcagaaagcaggtaaacaactaaacaccatcctacaaattttgccgctaagcgggtaaaaggagacgacgggtcaatgcttttatcatgaaccctaccatccatttatccacccaagagcaaagttagaattgttcttaccgcctaccagataaaatagacacatgcgaaaagaacttgcaaacaataattggatacattatgtgagtaaaatccacacgaccaagaatttgtgtgaacatgtcagggtttggaataaaatacaaaagcattttttttcgccgggcaaaatacaaaagcatttgccttcagcctgtcaacaaggagtacgtagtgtggcaatattccacaaaagtcagtcttccttgtggtaacctcagaagtctcaacacaacatctatttggaagacgtctgaaaaaaatataaattatttgcttggatttcaaatcaaaacaagatcttaatagccgaaaattttggctaagcgaggattgtcataccacgtgacctctaagctttgcaaccaacatgaaagactagtatgcatattcttcggcaaaatttgcccttatgcccaggaagtttggacattgtttttaaggtggtaaattgcaaaatcatggagagagcccagccaaaactcgttgacagtttcgcaagctggtggcatgaagcaatgtcctagcataccaaaaagagatggacaagaagttcaacagccctgttgatgtacacatgttggaatatttgaatggagaggaaataaacgagtcctccaaaatgaacaccagaatttgcgagatgtccacttcaagatctaggacatcaagcaaaaagagagatccccagtttcttagtttcttggttgctggccttaggagctgctgtgggtttggttttggcctttgtccattgagtttgtgatggagctgctgctggaggaacattccttagtttgtgatggtgtggatctttaggacactcatcagcttctcaaggtcctcctttattgtctgaactctgcaaggagatgaaatggctgacatgatcacttttgcaactacagagatgagcatgtcctcttcgaatttgcgagaccaaaccaggaagaaattaatcgaaacgaattcctgtaaacaaacatatcattaaagtagttggaatatagaaaggaaggagcagtgactatgatggaaccaaccgatggaaggcactgaaactacatatattgttgtacattaaattggccatacacaggacatcaaagtcagaattcagaaacagaaagtagcttcttttgtgaactatattgtcagacacatgacgctagtagggtagcaatagtaactaacagaattttacatactcaaactagtaaaaacagatacaatagcggttccctaagaaagaagacatccatgaacctgcaatagcatgacatatgctcctttcacctaaactgactgaataatcagtagtagctagaatctgtgaaaggcatacccagccttctaaactatattgtcgaagcgtagacaatgtaatttctttctagaaatttttcccccagattaa

SEQ ID NO: 73613 - DNA, 7429 bp, Oryza sativa
atgaaccggctgataagatcagttgccacagcagaaatcagaatctccatgctcaccagagctctgcttggaagcaaatggtcaaaatgggagtttgcaaagtgacccaggcttctagaatctagaaggttacaaagaagtaggccaagagaccaagacaagtcaacaagaaattaaagtctattattatcaccagagaagggttctacatgttcagtctatctcctaccaaagtagcttctccctccatcatcctcgtttagcatcaaagctttcatttacaatttgttctagtagccagggccccatgaaagtatttctttgtttgtccccttttctgcaaaataaaccaattctgcaaaaggagacgacaggtcaatgcttttatcatgaaccccatcatccatttatccacccagaacaaagttattgttcttaccggttaccagataaaatagagtaataggcccatgcggaaagaacttgcaaacaataattggatatattatgtgaggaaaatccgcacgacccagaatttgtgtgaacaaggagtatgtagtgtggctttggaataaaatacaaaaccatttgccttcagcctgtcaacaaggagtacgggtggcaatattgcacaaaagtcagtcttccttgtggaattcaaaggttacctcagaaatctcaacacaacatctatttggaagacgtctgaaaacaaatgtaaattatttgcttggaattcaaatcaaaacaaaatcttaaaagccgataatcttggctaaacaaggatggtcaaaccatgtgatctctaagctttgcaaccaacatggaaggctaacgtgcattttcttattctttgtccttatgccaaggaagtttggacattgttctaaggtggtaaattgcaaaatcatggagagagcccagccaaaactttttgacagttttgcgagctggtggcatgaaagcaaaaaagagatgggagaggaagttcaacagccctggtggtgtacacatgttggaatatttgaaaggagaggaaataaatgagccctccaaaatgaacaccggattttgcgagatgtccacttcaagatctaggagatcaagcaaaaaagagagatacccagtttcttagtttcttagttgctggccttaggggctgctgtgggtttggttttggcctttgtccattgagtttatcaaacctcagcatgtagtgtgccttgtaaccacatttagtctttgctatctttcttctataatgcatcacggcagagctcctgcccttttctctaaagaagaattgatctcactgagaacaaagtcacttgtgacaatgattttcaactacagcctcttcaacaggctgcaactttgatgtgtaagaataatacccagggtacatacctaccataggccccttgaactggaaaaacattcctcagtttgtgatggtggtggatctttaggacactcatcatcttctcaaggtcctccttattgtctgaattctgcaaggagatgaaatggctgacatgatcaattttgcaactacagagatgagcatgtcctcttcgaatttgcgagaccaaatcaggaagaaattaatctaaccgaattcctgtaaacaaacatatcattaaagtagttggaatatagaaaggaaagagcagtgactatgatggaaccaaccgatggaaggcactgaaactacatatattgttgtacattaaattggtcatacacaggacatcaaagtcagaattcagaaacagaaagtagcttcttttgtgaactattctgtcacacacatgacgctagcagggtagcaatagtaactaactgaattatacatacccaaactagtaagaacagatacaatagcagttctccaagaatgaagacatccatgaaactacaatagtatgacatatgctcctttcacctaaactgtctgaataatcagtagtagctagaatctgtgaaggcatacccagccttctaaactatattgtcaaagcgtagacaatgtattctttctagaaaattttcccccagattaagatttgtgtctgtgtattctcagaggtagatcgtgttcctcttacgaaccatgcgtcgcggttttcgtttctcatacgtaactatgtagttacagtagggtggaatgcgagatctccagaccagcacatcaaacttatcttcgacaggaatatcacaacccagtagcatgtctcgtgatgtcagttttggtagctcaccatctgcagggccagcgaccctaacatcataaagcaggcaaccttgaacttgaccatccacaacggctatcctgctcatatcgacagggatatttctttcgaaaagatcgtcagggtgtagaccagaggaagtcaagtgcttccgtgcaagctctcttacgaataataagattctcttccagaattgagtgttaggattagctcttaatagttcaccatatatagttgcagaaagaaatgatccattcacctcagtagctagctgcatgaccagagatgctagtttcggatgttcatcaggatccatacttccaaaagcaagtgccttgaagtagtaccaaaactcttcttcggatggcctcttcaccctgatgggttgggttgtcccaaacttagcaatgtcctctgttgtacctatcactacaaccttaattccaataccgggcatattctgcaaatatgattggaattttgtccaagctgcctcatccacatcccaaatgaactcaataacaaacaaatatttcccttgagaagccttggagttaagcgagagctctccggtcttcagatcgtcttctttaaagaaaaatatatgggagaagcagttgcgcaccctctcatccaggcaagcatgttgcacaagagttttctttccaatccttggtgggccaataataggaagaatgctaacatacggatcatgaggatcattgcaaagcaagaaattgatgacttgctccttctcaatacggctgccaaacatacaattctctatgtatagatatgtactgtaaggctgacgtggtagacgagggtggctaccaaggagaatgacaaattccctcatatctgcaatcttagtttctaaaccatcaacaacatctttcaggtttgttctgctcctgctaccaaaggctattggtgtgtgttttcttatggcatcagcaaaacgaaagcgcttgcgagagttacaggctgacaaggcaaatgactgaatctcatgactcacctcatcttcgatgctttcttcttcagggggttggaacttgatcttgtcgagcacgtagtatccgaggtagaatccctcaataaatccctttagctgcaggagcattccttgatttgtgatgtggcgcccctctgcttcctcaacaacacagtgcatcctcagcaagatgcgttccagcctcctacgatcatcctccttacgtatatggtttctgtaattttgtgctaccgaagagatgaaccggctgataagatcacctgccacagcagaaatcataatctccatgctaaccagagctctgttggaggtcaaaatgggagtttgcaaagtgatcaggcttctagaggttacaaagaagtaggcaaagagaacaatacaagtctacaagaaattagtaacaagtactggaagcagttcacacgagatggctcttcctgagccagaattttctcttcaaaaagtaagacaatgcattttcaggtttacattaggcactaacagatatcattgtacgttgaattgttcgtatgaggacaccactgtcagaactcagaagcataaagtagtttcttttcaaatggtttttttcatgaatatagtgctagtcagagcagcaatagtaactgactgtttttaactatccaaattaataaaagcagatacaacggaacttttttttcaaaaatcaaacacttattagatacagacatagaggacagacacatataccagtttgacctgaactatctgaatagcttgcagtagtggtgagaattggtgaataggttatctgagagagagagagagagagagagagagagagaaagaattggtgaaaggcacatccagccttttgcagtatgaggtccgtcaattgtcaaagctgtaattccttcatttacgaaaaggtaaattagatatgatttaacagctatgttccttactttcctgtgaaatagacatgaatttacatgcattcaggtgtaaaatagtttgtgctcaaccttccaagaggaagatatttttcaatgtgcttacaaacagtaccatttgtagtgaggttcaaagtgcttacaccttgagtaaattccttaactttgtaacagagtaaatggtaataactccttaagttgttcaagccaccttatcaagaacgaaggaataatggaataatgcgtttaaatcctgatccagccaaagaagatgaacagagcgagatccaaagctccagaggtgtcgactcacctgggggcgcggcggcgattgaccggagcgaacactgaatccggcggcctccgatgagaatcccagggaacgccgagaaatgcagccaccgtgctcgcctccgtcaaaccaccttcttcctctccggccatccatctctctctacgttctccactgattttttttttacgccggtttcttcttgatccagcactctattaaaattctggggcgaccagtggaggaaacctcgccgccgccgccgcccggcgaccggcggcggcgggatgaagggaagcgagggctaaacgtacaaaaagcgccatctatagtaggataatttgtagaaatgatagggacctttccgcaaagctccggatcggtgccatagcgaattaacgatcgtaaaagggatcattttgtgtaattccatcaagaggggtatatttgtaaaactactgaggtaccattggtagacggtagtaagagcatccccggtagctcatataaatttcattctctatattcacatttagatggtcatctaaaaagattctcactccatatttttcttcgctccaacagatcatccatattacatccttcatatatattttaatgtatatttcaactaccatacatttacatttcctctcatcctctcttctattctattctactgctacttcgatgggggaggaagaggttgggcgacgggagctcgttgggcggaggaacagcggggagtcgccgggcggaggaggaccggtggcgcggtgctcaccgagcggaggaggcgcggcacgggcggtcggggcggaggagccgcggcatcggcggcggggtcgcggggggaggagccacggcaccggtggcggggtcatgggcggggagcggcgcgggcggtcggtcgctgagcggaggagccacggcatcggcggtggggtcgcggtgcagaggagccgcggcaccgtcgacagggtcgcgggcggtcgcggcgtggaggagttgagaagcggtggggacggccaggcggcgttggtccttcgagcggtgggggcggccgggcggcgtcggtccgaggagcggccgggcggagaggaggcgcggtcggaggagcagcggggcgacgcggtcagaggagcggcggcgcgggtggacactccggtgctctccccctccagatccaccacctctccgcctctactccggtatgcacttcctctttacctctactctcccgccggttcttgtccaaatggtgacgcgagtttgattgggaggtgagcagtttaggattgcgtgaggagagagacccgccatatttggcttgggaatggctcggtttggaggacctccaaaaatagcgtgtgcaatggaggctctgctggagcactgtttttctcctccatgcgccaaacactggatagatgactagatagaggagctgctggggatgctctaatatgaccggctcatcgtttgccttacatgaattcagcaaccgtcaaactttaaattttaaaacatatttttttctaacgcagttttttttcaccattggttttaagttactaagtacacatatataaatgttttactcctaataccgagctagctaatcgatggaatccttatagatatgtcaaaaaaaaatctatttacataggtcatatcattggattcaaatggactggactcttttagacaattagttatagacctacgcattgtaacgtctttttattcagtttagtggaaaggtttggatcgagtgggatgtttgttttttataagatggttagtttttcaggtgaaatttttttatgggaggaagagattttcaagtggaagtggaggacagatgggaccaaaggacaacatctccctttattaagagcgagatcaatagtacagcctactgacagtgataaatatcatctacatcagctatagtagacgtagcagctagtttttacaataattgattctaacatgtttcccaactctgaaagttcattaatttattttcattaatttattgcttttggctaactgcctcttttctctctttgccatgtttctctccaagactcccatctactgcaaacagaccaataaaatcttctttgtacccaattttgccttggggacatcaaggctgaccaacaacgctgtgctcataggccccatcgttctccactttattaagagcgagatcaatagttaatgccaaaatttaaattttaaaagttaattttgaagttttttcatcaaagtttatatttcaagattggtgtttaagtcgctaaaaacatatatataaaagttttacctacaaattattattattttgctaatacgccatatggcatattatctgtatttggccaaacgatgggggcaagcgagcagctcgacgattaatctaccaccgacttttctctctcttcatgttctctctcttccaaccctgctttaatctggtatggattttggtgcagcctactgactagacttattatagtagctctaagtagtggagacataggtatcctccatatctccgctacacatcaccaccactggccaccatggccaccgctgacttacctatatttggtgtcaacaatgtaaacatatattatgtttttagcatggatgataataaacgtgccataaggctaaagtggcaactttgatatgaaattaagttagttcacaatattatttcaatatacacattgtttacagtttatttacacgtgtaattgtgctttgtgttctctgtgcgataaattaatgatttgatcacggtacatatccttcctatgattattatcatttggataatacatgtagtgtgttcatgattcatgaacagatttgtgcaatagaatgacaaactttgttcacatcataaatttttaat

SEQ ID NO: 73614 - DNA, 1313 bp, Oryza sativa
attcgcccatccatcttgctggcgccgatcaagaccaccttgaagtggcaggaccggaagccgccgccgtgcacgtggccgtcgtcgccggcggcacaaagcaccgcgccgttcatgacggatctctccccaccgtcgagctcctgcggaacggccacgcggcggcgatcgccggaaacgggatcccacacgaggaactcgcaggtgttgtagttgaagatgaggacgaggccgtggcggcagccgaggaggctcgcggcgcggtagtcgtcgagccgcagcgcgaagcggtcgggcgggatgagatccggcgggtcgaggacggatctgaagacggggtggtggagctcgtccttgaagacgccgaggagggggggatcccggtggcgggcgcggaagcggcggaggaaggcggggtcggagacgaggcggcgccactgcttgcagacgagggaggcgcgggggagggaggagggatgcgaggggaggcggaggaggatctcctggatgaggtcgtcgttgtccggcggaagcaccggcggcggcgccggcgccgccggggatgtccgccgccgccgccgctgccggcggcaggtcatttcgtcgccatggtcactcatgggaatctctgtctcgtttgttcactctggtttagtttttctcccacaaattcgggtaaaatttaaaaactcggatgaaatatgtctctcaacttaaaaaatggacgtgtcaacagagaccgttctctgtatggtcataaccaactacctcaatctcatatctagttgctactagtatacttccttcgtcccaaaaaaagataaacactgggtttccgtgtccaacatttgaccgtccgtcttatttgaaaaaattatgaaaaattaaaaagacaagtcacgcataaagtattaatcatgttttatcatctaacaacaacgaaaatactaattataaaaaaatttcatataagacggacagtcaaacgttggacatagaaacctagggtttgtcttttttttgacggagggagtactcaaaagtgcatgtatttttttttcttcttatggaattttatcttagattacttatccgatttacgatccgattacaccattatgttcataacaattaaatatttataacaagatctcatatgactatatttttatgaaaaaaatataaattacttttataatatatctaagagtaaatttcagaaaactgcaactttagtgacaaaactatcagtttgatgcaacattagcgatatgtttcagtttgctacaacaatagcgtgaaaaattatcaca

SEQ ID NO: 73615 - DNA, 36528 bp, Oryza sativa
aaatttaaacccaaaagataaataattttggttcttaatttttgacttaaactcttatatggatttaataaaaaaattcaaaaacttaaattttgtttttcaaattttacatcaaataattatgtcccattgattttgttgtaacttacagtacaatttttcacactgtgatttatgaagtaggtagcatgtaagtatgagaaaggggcaatatagttatttttgaaaaaaaaaaagtccaatagtcaactaatggaacgaaggtagaggagatcaagatgaaaactcgaggacacgtaggggataaggcagaacttacggatatgtagggaattttctctttactggccaaaagggccttcccgtaatctcatatatctctttacttgattaggccaaaagggccttcccataatctcatatatgagtgcatgcattttgttctacatgtttggttcatcttctaccaaagttttcttccatcaatccatcatcatcttccaccaaagtctcctccctccatcatctcccactaaagacttattgttagacatcctaccagcatgcatgtgagaagttttcatttttacgactttgtctagtagaatgaaagtgtttctttgtctaactatctccttatctgcaaatagaacaataaatgagtcagcaacatattttgtaaaccagcccagtcattcctggttatgtacattgaccacagcatgattgtcaaacaaggcatctggcatgatatatggagaatccagccagacattaaaaaagttgagtcactgtgagttggggtggaagagaaattacaagccacactaaccaccctacatgcaaattttgccagagaacaggagatgaaatggctgacatgatcacttttgcaactacagagatgagcatgtcctcttcgaatttgcgagaccaaaccaggaagaaatcaatctaaaggaatgtctgtaaacaaacatataattaaagtagttggaatatacaaaggaaggagcagtgactatgatggaaccaaccgatggaaggcactgaaactacagatattgttgtacattaaattggtcatacacaggacatcatggtcagaattcaggaacagaaagttagcttcttttgtgaactatattctgtcacacacatgacgctagtagggtagcaatagtaactaacagaattttacatacccaaactagtaaaaacagatacaatagcagttctctaagaaagaaggcatccgaacctacaatagcatcacatatactcctttcacctaaactgactaaataatcagtagtagctagaatctgtgaaaggcatacccagccttctaaactatattgtcgaagcgtagacaatgtaatttctttctagaaatttttcccccagattaagatttgtgtctgtctattctcagaggtagatcgtgttcctcttaccaaccatgcgtcgcggtttttgtttctcatacgtaactatgtagttacagtagggtggaatgcgagatctccagaccagcacatcaaacttatcttcaacaggaatatcaccacccagtagtatgtctcgtgacgtcagctttggtagctcaccttctgcagggccagccaccctaacatcataaaccatgaaatcttgaacttgaccatccacaacggctatcctgctcaaatcaacagggatatttctttcgaaaagatcctcagggtgtagaccagaggaagtcaagtgctttcgtgccagctctcttaagaataataagattctcttccagaattgagtgttaggattagctcttaatagttcaccaaacatagttgcaccaagaaatgatccattcatctcagtagatagctgcatggccagagatgctagttttggatgctcatcaggatccatacttccaaaagcaagtgccttgaagtagtaccaaaactcttcttcagatagcctcttcaccctgatgggttgggttgtcccaaacttagcaatgtcctctgttgtacctatcactacaaccttaattccagtaccgggcatattctgcaaatatgattggaattttgtccaagctgcctcatccacatcccaaatgaactcaataacaaacaaatatttcccttgagaagccttggagttaagcgagagctctccggtcttcagatcgtcttctttaaagaaaaatatatgggagaagcagtcgcgcaccctctcatccaggcaagcatgttgcacaagagtttttttcccaatcctttgagggccaataataggaagaatgctaacatatggatcatgaggatcattgcaaagcaagaaattgatgacttgctccttctcaatacggcgaccgaacatacagttatctatgtatagatatgtactgtaaggctggcgtggtagacgagggtggctaccaaggagaatgacaaattccctcatatctgcaatcttagtttctaaaccatcaacaacatctttcaggtttgttctgctcctgctaccaaaggctactggtgtgcgtttgcttatggcatcagcaaaacgaaagcgcttggcagagttacaggcagacaaggcaaatgactgaatctcatgactcacctcatattcggggggttggaacttgattttgtcgagcatgtagtatccgaggtagaatccctcaacaagtccctttagctgcaggatcattccttgatttgtgatatggcgtccccctgcttcctcaacaacagagtgcatcctcagcaagatgcgttccagcctcctacgatcatcctccttatgtatatggtttctgtaattttgtgttaccgaagagatgaaccggctgataagatcagttgccacagcagaaatcagaatctccatgctcaccagagctctgcttggaagcaaatggtcaaaatgggagtttgcaaagtgacccaggcttctagaatctagaaggttacaaagaagtaggcaaagagaccaagacaagtctacaagaaaatagtaacaggtactggaagcatttaacacgagatggctcttcctgagccagaattttctcttccaaaagtaagacaaagaaagaactcggaactataaagtatttagtttcttttcaaaaggttcctttcatgaatatggtactagacagagcagcaatagtaactgtctaactgactgctttcaaatattcaaattaacaagagcagatacaaaagaatatgttttcaaaagaaacacttattctatatagagatggtgtagagacatataccagtttgacatgaatataacatgaaaaaaagtcaaaatgacttataatatgaaatggaggtagtagcttgcagtagttgtgagaattggacaattggtgaatagatcacagccttttgatgtatgaggtcaattgtcaaagctgtaattccttcctttacgaagaggtaattagatatgatttaacagctatgttcctttctttcctttgaaatagacatgaatttacatgcattcaggtgtaaaatagtttgtgctcagccttccaagaggaagatattttcaatgtgcttacaaacagtaccatttgtagtgaggttgacagtgtttacaccccaggtaaattccttgtaacatagtaagtggcaactcactaagttgttctcgccgccttatcaagagcgaaggactaatggaatgatgggtttaaatcatttaattaagcaaaagtggctactataccatactactatccagccgaagaagatgaacattgccaatagaaaaaaaaactgacaaatcctgactcaattgtatactttctagagggattagttcaagcagattaaaccataatgaccagcatgatcgtagccaaagaagatgaacattgccaatcagattagttgtagatctcgcacgaaactgtacacaagctatctatcgatactatcaccagattagttgcaaaatcccgatgcatgcacacagccagatccaaagctctaaaggtgtcgactcaccggggcgcgcggcggcgagtgaccggagcaaacctcgaatccggtggcctccgacgagaatcccaggccacgcacacctccgtcaaaccaccttcctctctatgttttcctctgatatttttttacgccgatttcctcttgttccagcgctctattgaaattctggggcggccaatggcgaaaacctcacctccgcctccgcctccgccgccgccgccgcccgcgctgcatcccggcgaccgaccggaggcggcggcggcgggatgatttgcaaaaacggtagggaccttttcgcaaaactccgtttcgctgccattgtgattgtagaaaggggtcattttgtgtaattccatccattccataggggtatatttataaaaatactgatagctaccagtagcgaactagcgatcacacattgggttcaaatgggctgagctccttcagacgatatgggccgtccgccgtcgttttcttctgtttgcaccatatcgccgacaccggttgccgtctacttcctccatcccataaaaaactaacttaatataagggattttgagtttttcttacaatttttgatcactcgtcttatttaaacttttttaaaattattatttattttatttgtgacttactttattatctacagtattttaaccacaactttttgttttttatatttgcaaaaaaaatttaaataagacgagtggtcaaacgttgcaatcaaaaactcaaaatcccttatattgtggaacggagggagtatgacacatcctattactacgaatttatgacactaaagacatttttgttagatattctacagcatgtgaattgttgatctccaattatccatcatcttcacttaccatcaaagaaatcgtttttacgacttggtctagtagaatgaaagtgtttctgactatctccttatctgcaaatggaataataaatgagtaatcaacatattttataaagaataaattacacccacgatacaggaactttgataggtgggtgtgatctagtgtaagaacttgaaaaataagtagactggtacatgaatttggcaatcatggaattttagtttaaaaacactgatacatacctttgattaatcctaatattttaaggttaactgctaaatcgttggctcatggattcaattttgtgttttgccattttcgtcacccgagacaatgaatatattgattagtcgaatcgctcgaaaattatattaattagtttgcatgcagttacttttgatatcatatattttttagtttcaaatcaatagattattttattattataactaagcaattcaaagcaatacataatacatgtagattcttgtggagatagcttgagtggctggttttttatatagcataaaaagtatggtatggaatattgatattttaaccaaaatacacgcactagccaagttattgcacctatatgcttattttttaagttcttgcattagactatactctgctaccaagtttatgtactgtagacacagtttactcttttataaaccagtctagtcatccattgggtttactaatcaacttgtttatgatgaattattcctggctttgtacattgaatacagcgtgattgtcaaacaagacatctggcatgatatggtgaatcctgcgagacaataaaaaaaagttgatcagtgtggaagagaacttagaagccacaccctaaccatccttcctacaaattttgccgtagaaacaggtaaaaggaaacagtcaatgatttcatcttcacaccacaaatttgacacctgagacctttccaacctctgttcagcagaacaagctgaggaaatttttatttttcataaggatttgaactccacacaaattcttgtgtggaaaaagagtattgccagctttcagaatctggtataaaatcccaccttttggccaacccggaaaaaaataatctagtaaaagcttggctttgtttaattcagcgcaaagtttggattttggttgaaattggagatgatgtgactgaaaagttgtgtgtatgacaggttgatgtgatgaaaaaggactgaagtttggatccaaattttggatctaaacacagcccttctcaccctaaagaattcgacctctcccaggtttcaaagttttttttttctcaaaagcgaaagaaggctgcgcttcattttattaaggagaatttacacaggagataccgaaaggactgtcccccccaaacatgtcacacaggagagactgaaatggttacaaagtgactaaagtgaggattcctcttcttctgacaatttgtatgagaaaaaagatttgatcaaatcaatcgacattttcctggtttccctacaaaagagttcgtctaagcttcataggtccaaaaattactattcatcacctctgtcacctaggtctttttattaaaagtcatgttatataaccaatggaagttatcaggcatcagcagtagtttgcctccctatccatttatccacccagaacgaagttctttaaccattgccaactgttcttaccggccaccagaaaaaaaaatagaaccatgcaaaaagaaaaaggaaacaaataaacaatcatttgatacattctgtgaggaaaaattcagacaacccaagcaaaaaaaaaaaaaatcctttcaacatgtcaagctttggattgaaataaaaggcatttaaaaaaaatcctttcaacatgtcaagctttggattgaaataaaaggcatttatcttcagcctgacaatgatgacaatgtagtgtgttgtggttgtggatgtccgaatattccacacagtcagtctaccttgtggaattccaaggtagcctcataactctatttcgaagacccaaactgtaaacaaatgcagattcttcactgggattgcaaatcagaacaagatcttaacagccgataataatttggctacgcgagcaacggagcaaggccacaccatccgatcatctgcaacaaacatgcaagactgccatgcatcttcttcaccctaatgatcaggaagtttgggaccctgttttgaggtgagtaaattgcaaaaacatggataaaatccgaccaaaacttgttgatagttttacaagctggtggcagcatgtcctagcataccaaaaagagatgaagaggaagtttaatagcctggtaatttacaaatattggaaggagaggaatagaagaatcttccaaaaagaaatctggatttctcaacatccaagaggagatcgagcagcatgaaagactaaaccaagaagaaattaatctaaacgaatgtctgtaaaaaaaaacatattagtaaggtagttgaagtatataaagtcagctgtgactacgatggaactgatgaaaggggctgaaactaattgagaagaacactaaattggccatacatagggcatcatagtcagaacattgaagtacaatattttgaaaacatttctgtcacacacatatataatactagtcagatagcaataggaattaactgcatcttgcatatccaaactgataagagaagaaacagagttttctttagaaaagaaaaacgtttatgaccaatacatgtgctacttagacctgaactgtttgaacaatttcaatagtagttcgaatctgtcaatggcatagacagcctttcgaactataccatcgacaatataattaattccttcgtagaaagtttccatcagcttaagggttatgcttatatttctctcaatgcttgatggttcctcctgccaaccttgtaccgtcgtttttgtttctcataagtaactatgtagttagagtacggtgggatgcgggatttccataccagcacatcaaacttgtcttcagcaggaatatcagcacccagtttcaaatcttgtgatgttagttttggtagctcacttccagggccagccaccctaacatcgtaaaccaggcagccttgaacttgagcacccacaaaggctaccctggtgaaatcaagaggggcatttctttcaagaagatcttcagggtgtacaccaaaggaagacaagtgcttttgtgccacctctcttatgcataataacatgctctgccagaactgggtgctgggattagctcttaatagtccacctactacggtcgcaccaagaaatcctcccctcatctcagtagccaactgcatacccagagatgctagctttggatgctcatcagggtccatacttccaaaggcaagcgccttgaagtagtaccagtactcttcttcagacagcctcttcagcctgatgggttgggctgtcccaaacttaagaatgtcctctgttgtacctatcactacaaccttaattccagtaccgggcatattctgcaaatatgattgaaattttgtccaagctgcctcatccacatcccaaatgaactcaataacaaacaaatatttcccttgagaagccttggagttaagcgagagctctccggtcttcagattgtcttctttaaagaaaaatatatgggagaagcagttgcgcaccctctcatccaggcaagcatgttgcacaaaagtttttttcccaatcctttgagggccaataataggaagaatgctaacatatggatcatgaggatcattgcaaagcaagaaattgatgacttgctccttctcaatacggcgaccaaacatacagttatctatgtatagatatgtactgtaaggctgacgtggtagacgagtctggctaccaaggagaatgacaaattccctcatatctgcaatcttagtttctaaaccatcaacaacatctttcaggtttgttttgctcttgctaccaaaggctactggtgtgcgttttcttatggcatcagcaaaacgaaagcgcttgcgagagttacaggcagacaaggcaaatgactgaatctcatgactcacctcatcttcgatgctctcttcttcggagggttggaacttgatcttgtcgagcatgtagtatccgaggtagaatccctcaataagtccctttagctgcaggagcattccttgatttgtgatatggcgcctttctgcttcctcaacaacagagtgcatcctcagcaagatgcgctccagccttctacgatcatcctccttacaagtatggttgttgtaattttgcgctaaagaagagatgaaccggccgataagatcacttgccacagcagaaaccagaaactccatgcttaccaagctaaagctcttcttgagttcttgggagcaagtagtcaaaatgggacttttcagagcgagagaagatcatagaggtgaaaaagaagctagctataagagtcaatgacaactcaacaaaaaaatagtaacaagtgctgaaggcagttcacgcaagctggctctatctgaaccagaattttctcttcaaaaataaagactaagcatttccagatttgcatgtttatacttttcattactggctataaagcacatgccgattagtaacaattaggaagtatagtatcatcacttatgacaaatcataatatatatatatatatatatatatatatatataaacaaaacacatacaaactatccatatttaatttcagcatatttcttaaatataccatattgcaaaagtatgctgcatgtaaaataaaaccaaacaaattttgctcatcaaatctactaatttaaaagttactggcgatcaaagtgaaaacaataccagtcaatgttgactagtagttgggagcagagtatatgttcctttgtctatctgactatctccttgtctgcaaatagaataatgagtgagtcagcagcacatcatataaaccgttcagtgcgtttacaaatcaacttggttctgaaaccctggtcaaaaaaaaaaaaaaaaacttggttctgaaacaagcattattcctggttgtgtgcattgaccacagcatggttgtcactccaaatctccaatataaaaaaggtatctggcatgatttggagaagaattcagccaagcattaaaaaagttgatcactatgagtaggggtggaagagatattacaaaccaccctccacacaaattctgccaaagaacaggtaaagaagacagtcaatgatttcatctgtcccataaatttgacatctttgtcacctttccaaccagtactaagcagaacaacgagaggaaaattttgatcaatccacaatttctgacaagtttagatgagaacaaagatctatcaaatcaatccacattttctgggtttctcctacaagagttcttctaagccttgttcttccaaaagttacaattcatcacctctgccatttagatctttttgttagaagttatcttatataacctaggaaagctatcaggcatcagcaggagtttgcttccgtatccatttatccacccagaacaaagttctttacctgttgcctattgttcttaccagctatcagaaaaaaatagagccatgcaaaaagaactagaaaataatatttggatgcattctgtgaggagaattcacataacccagcaagtgtgtgaacaattgtcaagatttggattgaaatacaaagcatttatcttcagcctgacgatgaggcctatgtagtatgttgtggatgtccaatgggcaatattccacaaaatcagtctaccttgtggaattccaaggtagactcagaagtcttacttggattgcaaatcaaaacatgatcttgaaaagccgataatttggacaactgcaacttggattgcaaccaacatgcatggtagggccactgttttaaggtgagtcaattgcaacatcatggagatagcccagtccgatcttttttgacaatatcgtgagcttggtggcatgaagcatttcttagaggaaattcaaaggcctggtaacttacacatgttggaatatttggaaggagagaagtagaagagtcttccaaaatgaatgctggattttgcaggatggcctcttcaagatcaaaaaggatatcaagccacaacagatatcagaccaggaagaaattaatctaaacgattgtccataaaaaacatatcaatagataattcaaatatagaaaagaaatcagcagctgtgactatgatggaattgatgaaagcaactgaaactaattcagcagtaacagacattgttgtacaataaattggttgtacacaggacatcatactctcaaagtagtttcttttgaaaatgtttccgtcacacacataatagttagggtggcaataataattaactgtattttacatatccaaactaataagagcagatacaacagcactttcttttaaaaaaggaaacatctatgaacacacagtagcggcacatgctacttcgacctgaactgttggaataatttcagttgtagttagaatctgtcaatgcatacccagccttttaaacagtactgtccacatcttaattccttggcagattttttcctgttaaattaagatttctgcttatattttctcaatgttagatggtattcctcttgccaatcgtgtgttgtggtttccttttctcaaacgtaactatgtaattacaatagggtgaaatgttagatctccataccagcgcataaaacttatcttcaacaggaatatcaccacccagtagcatgtctcatgacgtcagctttggtagctgaccttctgcaggggaagccaccctaacatcataaactaggaaaccttgaacttgaccatccacaaaggctatcctgctgaaatcaactggggtatttctttcgaaaagatagtcagggtgtacaccagaggaagacaagtgcttctgtgccacctgcccacctctcttacgaataataagattctctgccagaatcgagtgttaggattagttcttaatagttcgccatataaagttgcaccaagaaatgatacattcatctcagtagctagcttcttatgaaccctcaacattctactcaatcaacaaccagcacaaggggaaaaccaacaactccagctcaatttctccaatacttggggtcacaagtagcagaatgggaacagggattggggatgagaattctaggcaaggaattagagaaagtagacttggaatttagagaataaagagttggagaatcaggaagagcatgaggaggaaggaggctgcagccatcagattttctgtaaattcatcgacgcttcctgctgtgacgattggtcctttttgtagtggcaagcttgacaatagattgggcctaataggccttcgctttacctgcattccaacctggcccacgtgcgtgacatagctgcatggccagagatgctagttttggatgctcatcaggatccataattccaaaggcaagcgccttgaagtagtaccagtcgtcttcctcagacagcctcttcaccctaatgggttgggttgtcccaaacttaggaacatcctctgttctaccaatgactacaacctaattccagtactggccatattctgcaaatatgattggaattttgtccaagctgcctcatccacatcccaacttaataacaaataaatacttcccttgagaagccttggagttaagcaagagctctccaatctttagatcatcttctttgatgaaaaatatatgggagaagcagttgcgcaccctctcatcctggcaagcatgttgcacaagagttttctttcccatcctctgtgggccgataatcttagcaaagcaagaagttgatgacttatctttgtcaatactgcgaccaaacatacatttatccgtaaatagatatgtgctataaggctgacgaggtaaacgagggtagctgccaaggagcatgacaaattctctcatatctgtgatcttagtttctaaacaatcaaccatctttcaggtttgttgtgctcctgctaccaaaggctactggtatgtgttttcttatggcatctgcaaaacgaaagcgcttggcagaatacaggtagacaagggaaatgactgaatatcatgactcacctcatctttgatgctctcttcttcagggggttggaacttgatattgtcaagcatgtagtatccgaggtagaatccctcagtaagtccctttagctgtaggagcattccttgatttgtgatgtggcatccatctgcttcctcgacaacagagtgcattcttagcaagacgcgttccagccgtttatgatcctcctccttacatggttgctgtaattttgtgctaccgaagagatgaaccagctgataagatcacctgccatagctgaaatcataatctccatactaaaccgagctctgcttgggaacaagtggtcaaaatgggagtttgcaaagtgagccaggcttctagaggtacaaagaagtaggcaaagagaccaagacaagtatacaagaaattagtaacaagtccaagtccaggaagcagttcacacgagatggttcatcttgaaccagactctttctcttcaaaatgtaacacaaaacatttccacatactttcctatgtagtagtagacatgaatttacatgcatttaagtaaaatagtttgtgctcttccaagaggaagatattttcaatgtgcttacaaactgtaagcatttgtagtaaggttgttctagccgccttatcaagaacgaaggaataacataatgatggaattttaatcattcgattagtcaaaagtgctactataccaatactactatccagccaagaaagatgaacattgccattagccatgatcttaatccagtgtttgcgcgtaaaggcattttcctagcacggcattgcacacaagagcgagatatagagctccaaggcatcaactcaccggggcgcgcggcgggcgagtgaccggagcgaaccttgaatccggcggcctccgacgggaatcccagggaacgccgagaaatccaaccaccgcgcacgcctcctgccaaccaccttcctctccggctatccatctcctcctccgccgccgccaccgccgccaccagctgcctgcaacctcactgctcgatctctctctctacgttttcctctgattttttacgacgatttcctcttgacctagcactctattgaaattctccggtggccattggatgaaagtgaaacttcgcctccggcgccgccgcctgcgctgcatcccggcgaccggcggcggcgggatgacggttgacgggggagcggagcggggcggggccaaatgcagcttcggaaatttgtacaaagtgtaggggccttttccgcaaagctccgataggggccattttgtaaaattccatccgcatggaggggtatgtatgtaaattatcatttgtaaatggtaaagaaatccattttaaaaaatcacagggtaacaagagtacctttagagcaggtacaataggtggctataagccagctataaacatattttaaagagataaatgaagagagagaagagcagcgggctacagatttgtagccagctgcagcacggactccaagacgtaatgtgtgtatgacaggtgggaccaggtattaatagtatagtaagcaactattgtatgaattggctattacattggctatagacgatttggagctagtagtgggctgcactattgaccttgctcttgtacagtatgttgtctacatagggggttttgaactttatgccactctcgctctcctacaccgataatgttttatcaaataccaccttcctaaaaatttttgattatttaccatctaaatccactaaattatttttattgtgccattgttgtgaactaagtcaacaaaccaaaggataaatgaccattgcccttatcttccgtgaaaagagattgaggaggagcttagcctctgggtggaaatggttgccctcccgtcatagccacttcgaacgagttaaagccacactagcaaccccctcccttcttcacccctccgaacgagctagagatggtgtatcctctgtgactctgtcgtccttgccgcaccagaggtaatcgaggatgagccacgtctagcttaaaatgtcgatctggacgttgaccgccacgctgccaactgatatgcttttggttgcaacactgtgccactttgaaggcgccatgcccgtttgcgacatcgcgttgccacccaatatagagtcatcggagctcagttcataaccactggccaacatgtgacgacgtcgttccttcgtggcttctcctccatgaattgggaagaggaagaagataagggcacctaggtcatttttatccattctgcttagtttgctggctaaaatggcaaatttgaaacagcttagtcatcttaggtggcaaataatcaaagtcttttggaggagtgacatttgagaacatgccatccgggagagtggcataaattttaaaaacccgtatgtataacactagtactagatcaacttgtattcacttagatgtgatacctaaccttatgtttcatgttgacgttaacattatgtcactaaaatagttcgatttgagcttcgtatatcggcaaaacctaacagatataacatgttgtacccctcacatttaaggagtgggcaaggaagtcaccaaacctccttgtcattagactcgtcacacactcataactcctcatcggcatgagcattggctctctccttcaattgagccccatccctcttacaattgttgttgcctatatcagaagtactatgtcaccagattcgacttctatttcttttctttttgtcattgccgactgatgcttaatcacattgttgcgccccttcttatcctcttcttgatgctaatttaccgtctttcttgcaattttttccatcgctgtcctaactcaatatcgagttcccaaccatatacaatgtctagccaacatacatgggggctacaatgacggacattgagcttgctacttacaaatactactttttttctctttcttttttcttttcttcgttttctttcacttattcatgattatatcaaggtatatcaaacaaagaaaattagacggaatttcagttcttctcttacgaacttaaagttttttttttttgacaatacaactcaaagttggtttatctaatgacattcgtaattatactccaatataatattatccatatcatcagtgtggcacctctactcggattgaggtgttttcaggcttttagccgtccgtttcacagtgaacgaccgagatcgatcgctacagtgattcgtgaattgtaattatacacaattgtaactacgagattccagtcaaaaaaattgtaagctataatgaaaaaaaaatgcaaatcactgttttctattgtaacaacaaactcattttactatgcgtctctacctttttcttctacccgaccctccacgaagagatgggttgggaacccatgagaaagaacacagccttatacctatccaatacttgtcgccctccgcctagctccaacatatattcatatgctctttaacttattaataactcgtatccaaaaattaaatttaaaatttctattttgagcgttgattttaaattcgaatttgattttaattctaggggtagtatatttgccggctttgaattcccgaatcccggccggactccgccaccaccgcaatgccgcgccgctccgcctcccggtacgccgcctactgggccgccgacgcgctcgccggcgacgacgccctcgacttctccctcaccaagggtagggttcatcacgccggggtccccctcctcctcctccgcgctcgcctcctcaatttcttcctcctctcaccacctagggttgttgcgcagcgctggtgggcgtctcgccggattccctcacgggcgcccccgaggccgtgcgggagcgcgtcgcgctgcggtgcctccaggaggtcgtctccctcgcctccgatggcgactacgaggccacgccgacggccggaggggtgcttagtgtggacgcctcccgctcctgcgaggactcgctgcttcaactcatccgagaggtattcagcgcgcacgatacgcgaccatgcgcactcttgtggctctgatttctgaccttccttgtttcatcaagtattggttgatttgattactggaggttggttgcgatttgttcatcggttcatgtagtagacaagcgatccccattccctgttggtcggtacattgctggagatagttattggtagcttgtttatggtgtcggatgcgattgtgctggtgtggggttagtcatttccagctttggttatgtctttttttttttcagataaacaaggttgacattaataaatacctgggattttgtgttaatttccttcttgattcaagaatcaagagatatactacaatcggaacttgaataagtcatacaaacacatgcgtcatgattgggttggtagattgtcttgcttcaatttcgtaatggcaagagtacatatcctttctgattacacctatacaatgcttcttgttgtgtaagcagtaaatatcaatggacatagttggaattatggaaaagatattttctgaatttacttctcaatagtgcatcgatgatttatatgtcacattttccagcaagtacagtttataatgggctttagtacgttttttttttgtacaaaaatacgtgatccttcaatttgacgtattccacttcaatatttgttgggccctctaaccaatcacttaatccctgatccaatgtttcagatcaatactagatcttgttattaatttttttgtttgcgtattctgttgatatgaaacatgatgtttttcttgtaacatttccatctgttgtgttccctatggataaattctgcttaaaaggcaccttgtgccctctacccattgtgttgattactgatccagtgttctaattgtacaatattgctagcctagaccctgctatacaatgagctcatgcattccagtgatatgaaacattgacattcctcttttaacttccaatcttctgtgttcccacctatatttgcctatatctagagtctaataaaatacctctaggttaattcccatcagactgtaagtctttaagggttgagatactataagactatatccctatgaagaatttatgcttaatctccaggctctaaccaatgagttgtttcactgctacatgttctaattgcgcaacgttgctaggcaagatcagttattttctgagctcatgcattctggtgatatgaacataatatttcctctaccttcactctagttattgttgcaagttatatatgcttattattatgtctcaaaagataattgttgcatcaccttgcatatggactccataaatgctaatatttgtacagggacaagggaatgccatcgtgccatgttaaatgttatttctcacatgattatgtgtggcactatggtgcatcaccttttgagatgatctccatgaatgcgttaatttgtgtagtgaagaggcgatgctgtgttaaatatgtttattcattcagttttgaagctagtgtgctgcaatgtgcatattataaagtccttcctgatgtccagctaatttcaatgtttacataatgtaaaattttcagattggtagctcaggaagcttggagaaggttatgcttctgccctttagtcaagatgtccagaagtttatatgtataaagagacctacattacctgaaacttcttttgaactggtatgttaaaatgcgacatttcagaactgaaaaaaaggacttcttttgacatattgttgtgctgcttgtttgtgttcagctcagagaagtttacccagagatcacacctgtggtcctaccatcgccagtggagcagaatggcaatgatcaacatgacaatgtcagccatgatcttgaaaatacagagaagactgggttcaatacagatggcgctcagcttcagcaagatgatctggcaaatttagtcaacgaaagtaacacaggaaatcttcagaaggatgcaatggcaactcctgattttcaccaaccatgtacatcagaaaataggtgttttgatcagccacaagaagattcaattaatgcagttggtgtcaacatcaggtctccaaaagacagtccaactaatgtagatagacacatacaagttgcagctgagccttctttagctacttctgcagatttgctgggaagtaatacaggaacaatttctgagcaggacatgatagatgatacaaccatggttcaatcgcaatctcaaggggtcaaaaatcctaatacacttcattataataatggagatgaaccacttgttgccagcattcagtcaccaaaggattccatccatgaaggactgaccatacaggcaactgtttctccagcttttgacagaagcaatgatgctttaccagcaagtacatctgaaataagccagttgcctgagtttattactgcaagggatacagtaatgaattcagagccacgtatcaacaaatctcatccaaattccccgaaacatgacactgttgataaagcaaatcaagatgtggattatggcagtgttggtattcagaaagctgctgctttcctatctgaagatcgcaatggggctactcaaggagagaaatctgaaattaaagatccaccagaaaatactgcagaacatacaaaaatgtttgaacaagaaaatagtgtcgaggctcagttggaagtcggttgttccgacaaagttaatcaagatatacaggatgatggcaacatcatgacaaagaatatggtctgtgatgggctgaatgtgcagactgctccggaacctcatagctgcagaatggccttgcataacaaaaatttggtggccaaccatttgtccgagcagaatattggaaggaacacaactgctgttgagaaagattgctgcagtattccaacctctcctcaggttgttaatgacacaagagtgaagcaaccttcaaacaagagaaccatggggaatactgtggtagaaacatcgcatgtgcattcttcagatgatagtctcagtggcttcgcagccaccggtcttctgtcaatggctgacaaaataccattctgtactcaggatcaagatgccaacggtcctgttgagggcttgtcagaacaagatttgtgcataaagtgtggtaaagatggccagttgttgaaatgcagcagctgcttgttagcggctcatgatacatgttttggttcattagcgacattggatgattctggccagttgtattgtcctgtatgcttctatactaaagcaactgaagcatatcaaaaggcaaagaaaacgtattctgaagcaaggaaaaacctatcagctttccttggtagaaagcaattagctgagcaacatcagcaagctgcagtggggcaaagagctgccaacaacgaggatcatttgaatgggtgtaacgatgcatctaaaaggaaagataatcatcaatctgaaggaaataacctttctcatagggatgaagaccctacccggaagaggaagaagcagaagacaaatgctactagtgatgcttgcgctcaggaagtagtcactgaaaaggtaccagttgttcagaattctgatgttgcacccatgaataagcattctgtactccagaataacagaaaacaagctcaggttgcagagcacgagcagccagaggaaaatgaagaagctagtggagaatctggtaatgacaattcattgcacaaaacaacacattcatctcagaccaaatgcagtcctgctgtaaatcagaatgttgacgctgacaaagaaaatggccttgcaagttctcaacagtcagaagattctgatgaaattgaagctacatcttctaatgactctaccaagaaatcatcgcctccttggcgcaagttgagacaccgcaaagcaatatatcaggataaggatacagcaatgccaagtaattctaagaaagtacttgggaaccgtgatcaacatatggcttcaccatcaaggaaaaggaactatgcatgtccacccaagcgttagtaagtgttattaataactaataagcttcataagcacttctttctcctgttgtactcccatttactgcagtctgcacatagccaaaagcatagtaaacataatttatatgggcacaaaaatgtttgagttgtggttaattttgaaccaaatgacattgaacactctgtctgatttatacatatgacaaataaaactgcactatgagagagttggtgggatagaacattaagttttagtgctctcgcaagttacaacacagtttccatgaatattcatagttcattgtcttagactgatagacaacatcatgcatcagcccatatggtttaaaaggccattagctttatcatgtaataatactgtatgatggaaagcaaatttgtaggaatcattaatacctagaattcataggagtgtgagctcatgaagttatatttacgatagtgaaatcaggctgtacttacatatggtcctgacataggtaatgcacggtattctctgttgcgtgaaaatgcaagtatttacaacaaaaatggaaccatcaacgggaatttcgactcattttccttataggacttcggtgtttgctagaatggatacctattcagatgcttcatttgttgtgattttttttttcactggaactctaagagtgtcgtacatggtagtaccaagaatttaagcatgtcttttcttgcagctctaaccctattgtaccggctggaaggcgcacaaagctctgttggacagaaaaggaggagataacgttgagggtgagtgcacctgatctgaaaaagttgttaccggcactgatgaatcttgcaccatcttctgttgcctagctagtaatgtgcatggatgcacctcttgtatacttacacttctctcgtgttctattcaggaagcaatggcaaaatttaccccaagggacaatggcccaattccatgggtccagatactggagcacggtagggacgtgttccacaggacacgcctcccatccgacctgagggtcaaatggaggaacatgaagaagaaatcaggctcatgacagtcttaacaacctactagtgcaggctgtgcagcttttgttctgtgtattctaaccacttactcttagagcccattgtgtgtgtcatcaccatcttgtaaggttgtaaattctcgttttcgagaaaaaaaaagtaaggttgtaaattctccttgatgtgtagaacacttcaattttatcgttctttcttggtatgtagaacagttcagtgaacttagtttgatgtcccgagttcaacacatctattttctgcagatggctcccttctgttaaatgttaatgaaggcgaataggtgcaatgcagaagtgaagatggaaatttttgtgttcatatggacaaaatgttcaggacaaatgatcaatagggagaacagcaatgttcagacagttaagagagagagaggggtggggggagggatgtttgatgtttaactacaatcacaaatttacaaaggctcaatgatggacagggtccaaaacgagacggcgatctaggcctacacaaggataagagccagcaccaaatatatgttatttatttgatcgaagcaaatatcagactattacataatatattagagaatttcacggactaatttgtaaaattagtggttgtgatactgtgctttttgttaaacaactgtatcattcatacatcagctatattttgtatggtacagtctgagctgctcctagtagggagctagcatttttaaactcgaccatagttataacttatcataaggagtttataaattttaatttcatacaaaattcacagagtgatcagttcaatcaaaagaattatgtgaagcttgtcacttgtaaccctgcttccactacaaaactattttgagttcctagagtcaatatcatgtgcgggaaaactgtttatagttcctagagtctgctcacaatagtgcaccagaatctccacactatcagataactccgcattctgttacggttagtacccaatggctttagctttctccaacaaattctccaaaagttgatagaaccaactcagttgctgaaggatgagctctatcgttagctctgaagaaatctttgatcgtaatacagcagcaatccctaagaatcccagcatcttcatgtttcatcagttttcgtactcttgccacattctgtcttctttgtggaaatgtgcacgttcaacagcaggatggatataagtttcaatcccttttggcttgaactcaagcagcttgtcagcagcatagaaggcaagtacaacaattccatgactcccgcatccagcagccaaacttgaccagatgaccttatttggctcttgggcaacaaaacaaaaactaggacaacaaatgaaagaaaactagtaaaaaatccgtggcagtaagcaaaatagttcatacaagtcaacaagaaattagtactaacaaactggagttttcaaagtgagaggggatcattgaggtaacaaatttgtaaatatttcttaaatacaccatattaataaagtatgttgcatgtaaaatataaccatatacaacttttgttcatcaaaatgtactaatttaaaagtgattggtgatcaaaccaaaaataataccaatcaacatcgacaagtatttgggagcagagtataaagtttgttgggcttttgggagcagagtataaagtttgttgggcttgtgtgtggagttaacagtgtttgtatgtgtttcagcccagttggcacatataaaaaggatgtatgctcagaggagaatagacaaaggatctagagagttccatataaatttcccaaacaccacatggtattagaataacagacctctcaaatcatttttccctaaggagatatagtagaccattaacaaacttatcttcttgactacaaagtcatacaacaacacaaagagaaaatgcccataaaagcaccagaatctcctctggtttcacacaggaatccaaacagacaccgagatcaagggcctagatttccagcacaaagcaagccttcccttctcacacacaaccccaaacaccctgttgaacagcccaactagcatcctggcctgagctatgttgcaagcactcaactcacaagccataaacccttccaaaacctcagaagcattggcctcaactctcactgacccatacttcaccacaaaatcctgtatccttggccccagcaactccatctccacaagtctcaggcatggttcataactactaccaatgaagcaactcgccattgactcgaacaccgtggtgaagtgatgcaatgcctcgaagaagaactcgacaaaggaggcactagatggagatacccctcttccaattctaactaggtcctcttctatggtgaccactagcttaggctgtagcttcttgacacagacaagcagtaaactctgcaatgtgcttagtgacttgtaatacatacttgttgtatcacatgagacaatcactgagcctttacagtcctcgaagaaggcatgcagttcatcctcattgtgaacacagatggaattgtattgaaatggaagttccaaagagtcggcaaactccgataacagccgtacaactgtgtcatgagtgctagcgtgacagtcagcatatgttgtgatagctgttagtctgaaggacttaccgccacagcgagcaaggtccgacatgagtgatgaccactggatgccctcgccgatgttcaagtcgacgacatggacatccatgtcaccaatgatggcatctaggatggcctgattggtagtgaagtgtgcaaacttaacaaatggtgatagctcttgtatgatctggtgcaccaacatgttaccagatggaagtggctctggctgataacacccagtggatgcactggacatccgggaacgcagaccttggtcaaagtggtatgccaatcgatcgaaagaactggctgctccattttcaggtatcccagacaggaagtcatcaagcctcgagaatgctactgatgcaaggattgaatctcctgcctcgaccgcctctgcaccagcaaggaggaggtcgcttaaactgtcctcctccaagagctcctcttggattgctgccaagttgacactctcttggccaaaaattctatcatcacaattaatagacacatcaacatcaggagcatcatgttgatgcaactcattagaatctagcaccatggtgtcaagtaaatcaaggtcctcttgttgatcagaacaaggatcaacatggagagctgcttgagaagaccatatgaaatacccactctcttcgtgtgcagggaaggagagaagaggggaacaaggatatgacatagtctccattcagttgttgtctaccataacaagttgcctttgtctgtgtgcttcagcatggacaattggacatatatatacacaatgaggaggcaaggggaatggataaacgtagagaagaaaagacagagtgatgggtgagccttcaaggccaatgcaagctaaaatgtcttggtctcagatcccataataacatggatcaagctgaaggaagatataaaacgacaagtatacggcatgcattgtcattttttgttggcctagcagatgaagcagaacgaccagagaatgcactgaaggtatattccaagagtgcttctttctgcgtgtcagcatctattcagttattggactatatgcatataaaaagaataccatgtggtgttgcccacttgccctgaagtacctatagcttgtagtcatacatcaataagccaatgacaatgaaaaaaaatgcaaatataaactacatgcttggaggaaaaacatatgtttgatctttaatttggtggacaataactcaattcctacatatcttggttgtgtatgaagagtccgtttcagtctgatcagaacaatgttaagatttcaactttattatgaccagcaaaagcgcagttagttttcatttgctaatgtggttaattttattaatgctaaaaaaaacatgacatagacttgcttccaagctcaattcagtcataaagcgctgttataaggtggtactatattactgtcagattcctaatgtagtcaatggactaatggagttgtgctagttctgccaaaacattaataatttattagatgatagagtggagttgaaagaggacaatacagattgtttcaagtagtgaagttgttgcaaagcaaacacagaaaacatgtgtgggtcaagcatatttcttggttttaagctacctattgctgctatctgaacattttttagagttggttccagaagatggcaatgtccggtacttcatatacaaatggctggagcagcagtagagatggggcacaatgaggtactgcttggaactatgttccagtgagaaaaaaaattactaagaattgctctaattgaaggcatctggtagttaaggagagaatctcgcagtgacagtacaagacaaacgcaatagaacaaatgaacaactgttgttttctgttctgtagaaaaaatagcttggtgtgtctcactgtctcgtaatccccaactagtcttttaagtcacttaaaagtattatatcctggtctatcaatatagagtttctaaagtattagaagatacatggcatgctacaaaacgtgaatcacaaaatgaactacgaaggagcacatggaaagtttataatactaggtagaagatacaggtgtcagaaattagacagatcggctagaataatgcaattttcatatgtattatattatgccttaactagagaaaataagtgtagttctacaacaaaaggttatcctctttcagaaagtgttcagtatttctaggcgagaagccgtttatttgtaagttgttctgctacttcaataactagattgtcaagttactagttacaattacataagccttggtttgtctacacattattctagggagcatgagattacaggatgaccctgtgaatgacagtgtaacagtagtaaaagtaaatgaaatattattttttcggaatatgcaaagtacgtatctttgtattaagattgagggtaaggccttacacaagagcatctcaattatgtacaaaaaggatcaaaagaaaaaaataaaaaaataataaaaaggggtgctaaaggcaatgtctatcaagtgaaggaaataataagataatagtttgaagttcaagcaagagtgaagattatagcaccagggcaaagaaaaggagaaagtttcagcattatgccctatccactcgacaagccaatctatcttctaggtaaatggtgatttgaggcttgtctagattaaagagaaattcactgtcaactctgctgaacacttgttagcagtttcacatcctactacttagagcatcaaaaacttctgatcaattaaaccgaaacacatcacaatccaaggatggcaaggcatggtcaactgatttgtctattaagatctccaaaaaaaaaaaaattcttgtttcagaattcagtagactggatataactgaaagacgggactagaaaggcggcagaaaataatagtctaacaaatgcaagagtacattgaactttcaaaaggtaccgaagaacatctcaatcacttgcaaagcctaggtacctaactactgaaaacaaaaggactggtgacctaaggtccaagtcatactccaaagtccaaatttccagataaaatatttgcccatttcagctaatgctgtgggggagttagggaagctgaatcatgccatcatgtaggccccattctagagaaagcttacctggtagtgctgaagattttttttgccatttgcatccagtaaacataaaagcagctgtggtgttggatacttggatcgatactgcagtccaccgaagacgaataaacgtttggtttgataagtgtagtgttgaaattgaattgcgggacccatattgaaaaaaaatcccccaatcactacgttttgccttgcctgtatgtgccaactgctacaggcaacaaacaattccttactcggttggttcgaccacagtttagacttcgatttttcctctgacatgcatgcaccgactttcacagtgtagtatggttcatttttatgcactgaaatcgatttaagccttacactggagttgctctaacctctttgcttgaaattacatgtttgcttatgttcctattatacctcttccattcttccctggatcaatcaaacaaaataaaataaactatgtatgtgaaacatgatccacttaaaaaccccatgatttgagatatgctcattggcatggttttcctgaattaatcgcatcgaaacaaggaaaattgagaggacccaacaagagataggttaggttcttggatgcaattttcccccttaaaaacttctgtggcgagattatgctcaatcccttgggattgattgggaaataaactaaacaaaaaatcccacatccgaagagactgcttacccaaccaatcacacctaagtcctagccaactatcccggacagaaatgcgtgtacaccgataaaacaaacaattgtaccaacgtgggcgagcaactgacttgctttccacctctcatgtgcgggccgcagggagaagtttagggttaattaggttggttggctttacctgaatcgacggaggcgcgcggcggcggcggcattcctcggcccgtgcgctgctccggctgggtgcgcgccggaggcggagatggtggcgacccgacccgagccccagctccggcctgcttgggggagatggagatggagggagagaaatgcacggtgctttttgtcactgacacgtggggctcagagattatcgggcccatatataaaaacaaagtcacacgtctcaaggattatcgggctcatatgtaaatgataaaatcacgtgactttaactaaagaagaccatgatcaggagagaaatggttctatcatgcaatttagacactatcgcatgttttctcacatatgtattgcacacatcaacttaaaatatcattaaaattatacatttttattaatctacatctatttataaagtctcgtcttcaaattcattacattgggaaaaaaaccaaaactttaacatatttatcctctcaaaattgttagaatttttatctttttttacgatgaaaatataaatgaatttatggttaaaactttaaacataagtgtacatttttttctagatattttgataaaatctattagtcggtgcgcacggtgtgtatacgagaaagtttgtatgcataggatatgttgctaatcatcaaacatctaacgatccctgatatttttaaaacgaaatatttgctccacgctttggaaaataagattttaaaaataataataactagcatggtgacccgcgcagattgcgctgctagtattattatattttctctcatataatagcatatatgttttcttattataatattcaaatatattaaaatgacaacataattttaaattttataataactttacaaaactactaatgtgtaatattcatattatattttatatacatgttagttattaattatttttaatatcaaattttagttatttgtaaattatatatattcctatatggactatatggactttagactcgtcttttaatatttctttttttttaattccgaattttctgtaaattatatttctatatatactctatactcttcttccaatattatttatttttatttctgaattttcatattatattttatataagtgtcagttattaattatttttaatatcaaattttagttatttgtaaattatatatattcctatatggactctagactcatcttttaatatttatttttttaattccgaattttatgtaaattgtatttctatatagactctatgctcttcttccaatattatttatttttatttctgaatttttattatttctaattgtatttctatgtggactctaaactcatctttcaatattctttaatttttaatttcgaatttcagttacttctaaattgtattcctatattgaccttaaactcttcttctcatgtttttcttaatttcgaattttagttatttataaattatatttttatacggactctaaactctacttttaattttattgtgtttattccaaaatttagttagttttaaattcctagatggactctatactctatttctaatattccttattttttaattccgaatttctttttttttcttaattgtatttctatatggactctatactctacttctaatattccttatttttaattccgaacttcagttatttcctaattgtatttctatatggactctgtactctacttctaatattccttatttttaattccgaatttcagttatttactaattgtatttctatattctatatggactctatactctacttctaatattccttattttttaattccgaatttcagctatttcctaattgtatttctatatggactctagtctcctcttctaatattccttattttttaatttcgaatttcagctatttcctaattgtatttgtatatggactctagtctcctcttttaatattccttattttttaattccgaatttcagctatttctaaattgtatttctatatggactctgccttttcttttttctccgattaatgtgagaatttttaagccatgagagcgaacgtggaggctcctttttctattcctttaataatatataatagatacaacaatcattagaagccgagcaataaattaaaacatcgggatcactatacaatgcaattgaatatgttgataaaaattgttcgtttgttttgagccgcaacaccattccttctttcctttcaaccctagtccagttcgatacctctctttgctcgggctgtctctctttgccccctacctcccttcgttcgggctgtctctcttcgccccagcctgcaaataggcccagctctcgggctgagctaaacctccggaagaaatattgcatgatgcagctcatcctcctcattagttgagggctattgatctactcgatttcctcttttcgtttttctcaaaataaaagagaatttgcaaaactcaagattaagggcagctcatcctcctcattagttgagggctgttagatctactcgattttctctttctgtttttctcaaaataagaaagaattcgcaaaactcaatattaaggtttgggattcttgtaggttagccagagctcgtttttcttgatataaaagagaatttgcaaaactcaagatcgaggtctgggattattgtaggtcggccagagctgatcgttctcattatatctcgatctctcaaaattgtttgaggattgttgatctactcgatctcttctttcttctttatgttgaaactcgatattaaggctgggatgcttgtccgcggccataatcaatggagattaaacccaacgaaattaagggaagacaatgaggtgggagtaggaaattgattttgcaattaattgaacgagggaagcgtaaagagatccgaccacactcatccgtgagatccgtccacactcatgaagataatccaaaattgattgaggggttttgatttttgtcgcctcctctttctgttttacaagaattagagcaaaattgtattgtatcgacccagaatcgaggaatcggatgggaaatttaggctccacggatgtaatatggaatcgagccctataccgtggatgggaatcggggatgaaatattttttgactcgtgcactcgaggcagaatcggaaagaaatcgtgagggatatggattcgtgggcgctacggattaaatatttttgatgcggaattggaaaaaaaaaacttgtgcacaaaaaagttggcagcgatctgatctggattcgtattatacggagtggaatcaggaatcggaaaaaaaattagcgcctgcttcatgagacaacgtacgaaatttttttggcaaaaacatcttaaatttttataataggtaaagataaagataatagataatcttctactagcttaaaccgcttcatctaaactggaattaggcatgcttggcaggataacatcatgtagattccaactacaaagcccctgtaaactgaaaccgaatggccctgtaaaccaaaacactggagaaaatacagagaaaacatactgtcgccaaatgagtgagataggccaacaagaacattctatgcccaacctttgcagatcatatgtccccaggaccaggccaaactcttccaatggccgtttggagcacgtccaacttctttttttctatggttccagccttaacaagagaacctcctgatcttttcttctcattttcgtcggcagcattggaccacatttagaattttccagatccaacaaggttctctgatatgagagaccacatgacatgactgagacactgtttttttaaaaatatgtggacatcaatggcagctggggacaaaacaacaagagtttcaatcagaacccattccattcactataacaacatctttacaaaacaaccgtcgcaaacatgttaaacacagttctttcaaccttcagactaaggcattaacagatgattgaacaggaggatgaattgcattttcagtaatggtacaaagatcagctagctaccctacgaatgattcatatatgcatatggtatacatcagctatctttacagtacatgagttgcagttagcgtgcaacttgaggtgtgcttgagtcctgctcacatgaaatccatggagtcatttagggtctggccgctcatcgattggcctccgttcaaagagttatggggattatttgggtggtgatgacgtccctggtggccacttaagtagtgcatctgctgctgctgcgagaaataggtcggcatctgctgctgctgctgctgctggagtcctccattgaaggagtttccgttcatgtttggaacttggcctgccgctatcttaagccgctgaacttcttctcgtagggcgtcattcagagctgcattaaacagagaaggctttctcaacaggttgctttgcttatctggataaatatatttggattctttgatttcaattgccttgtaatggccctaaacaagataatattatatctgggccttaatgacaaagaaagaagagcttgataacattatttgtgggccttaataacaaagacggaagagcttctgaaagaataggacataccatctcgaagtttagcttgttcttccatggactgcaaccggagtttgagctctctgttctcagcagttaggccagacgtgtccctctgaccataagtaaattccaagatgaaaaagggtataaaattaggaatgtgtgagcaaaagataattagaaaatcaaaaaaccataagatagaacattcaaacgctgaaaacattaacattagcggatgagactgatgcacaatcagaaacatgatctttattgttagcagcagagtaaaatttaaagtgattttagttagaaataacattaacaaggagtaaaaacactaatttccccccaaaaaaaaatcactagtcctgacttcttgattccctatataaaaaacttagtgaagctttgtggagcaagataaacatcagctgttatccctgaccaccaaaccaaagtttcaaccccccacctaatttcatcatctttaatcaaaccagctttcaaatatagcatcaataaccctgtttctgacatgaccaacctataaagtatataggcatcagcattatgaccctacttttgggtgcaataaatccttcagttgtcacatcggctacaagaacacttgcagacaaaagaaaattaagaaaaaatgcataatgtgttcaggctcaactatgttttcctgaaacaaacttgtaatatttgcggagtaaaagactacaaaacttatggttactcattataatttgttagctctcgaatgataaattcacaagacagctattccatatttacaaatcatataaagccggtagatcagcttattctccctgtaagcaggactaccataggctctctccaaaatcaaaaatctctggttcaaaaagtgtgaactgataggatgtgcttaactgttcaagggctagatgacctagataagatattatggaatttttgggataagccgttacaaaagctagcatatcaataaattcaattctcactgacattctctgaaatacaaatgtatgcagtggcagtttgcaagaaaaaaaatccttctgatcccattacatatccaatttagtatacagaatatgcagggagagaactatatctgttcatggtatttttagtacactatgaaaaagtaataatttggtcttgtcaaagcgaacatctaagcagcctaacatttttcatgtaaatagtcaagtaccagtgaaaattataaattcaaaatagcaagaaaattcctaaacctgcttgtcctggaaagtgcaatttgcaagtacagaactatagcggtactcacagttgagaataaatacaaccaaacagagactaacactttttatgatcatagcatcccagtacgcctgaacaatcgtaccagaactccagaagagctagcaactttgaactcgaaggaactagaggtggttctgtgcaggagctcgttgttaaaaaggaaaattaaagaaagaaaaactcagaagccaatgtacaacagctgtaacaatcaagtaaaaacaatcaatgttgaagcaatcaaagaatacagtaatttttttgtgatcgtccatcccaaaaactgctagtggacagtaaattggttgcactggacagtgtcaagtagaaattgatgttagtcaaatgatgtgtaagctgaaacaatactgcatcaatgtatctaaagggaaatccggttattccagctgctaatatcaggtctgatacaagagaataagaaaagcatagccaaacaaaaaatcaactgatcagatagagcactagcctcacttttatggtagtagttgcagaggcaccacaagcttgagctataatgcatacctggagcagcgtgagctgtgttgaaagcgtggttgcctctgtctgcagcgtctgcaccttcctctccagctcaccggtgtacttgatcttcctctccttcgacctcgccgccgattgcctgttcgccagaatcctacacaaaagagagtacccaccatcaaattgagaacgcaacaaggagcccgatttcaggaaaaaaagaagaagaagaagcacaataggccagcaacttcaactaaatgatttcatgtttaattatcaaattgaaatagtatagggaaatagctaaagaaaagttgttgaaaaacttcttttctaattttttttttaaaaaatccagctccatttctactgaaaccgtagtgtgaaaaaaaaaattctgacctcttcgcgcgcttggggtcgaggagcgcgagctcggcgagcctatcggcgggcatggccttcttggcgtagtcgggcggcgcggactcgccctcgaacagcgagctctccccatccatcgacccgctcctcttatgcccagccccaccgccgctactcccactcccagcaccaccaccccctcctcctccctggaacgcgaggccatcgaagaacgcggcgtcgagggagaggctcctcaggtgtgcacccccaggcggccgcggcgccgcctgcggcagcgccggcgggggaggaggcggggtcgggtcggacgccgcgggggagtcgtcggagagggaagggaagtcgaggtcggagaatccgaactcgccgtccgggtcgagcagcaggtcggcatcgggcagccggatgaacgtctccgagtgcgcccgccggtggtgccccctcggcggcgctcccccggacggcgccggcggcgggaatcgcgggtccatgatggctgcggcggcggcggtcaacgccggcgagaggcggctgctgctgcggcggctgcggcggcgaagtggctggggtttgggaggtcgctgctcggagaagaggaagatcgggtaggtaatgggtctcgactagaggaagcggaggcccccactcctgcgtggacccggtgcatagaccccaaaccgacttacacgaatctcgaggcggaatggaccgtataagtgagttccggtctatgaggagggtccacggaagaacggaatatccgcgccgtgaaatggttgttgcatccgtccccgcatgggtaaacttggtccatatacacctgtagctgtagttcgggtgcacgaatcacgaggcgttacggacgatgggatgttgcgccggtgcatagttggg

SEQ ID NO: 73616 - DNA, 1816 bp, Oryza sativa
aaaatcttaccacttctagcacaacacctaacacaacaggggggtgtctagaattatgagcataaggattaaaacctaaaccacggttatgtgtgctaactttagattgatccaaaatcatgttgaggttctttttaccatcagaaaatctttgcaaagaatttttcaaataagaaacctctttttctaaattagcacaattttcacaatctaccatgacacctttgcttttacgacacttggggcaagaaagcacttcattgtttttcacaacatcttccatttattcaacacgacctaaagcatctttcaatttcatcttattcaaattgcatgttgagcaatccaaaacatcatgaggttattttaactttttagcacaaatcatgttaaacatcaaactagcatgaaaagcaatttgatatttttgcaacaactttttagttaaaaacaactcatccaaagtgcgtgtgtgcaaagcaaaactacaagcaagagaagatctatttttcaaatcatgtgcaacattaatctctctaatttttgaaatatcattcattaaaacctcacaacttttgcaatcatcatcattaggaataagagattttaatctagcaatttcagaattaagagattcaatgataaattcctgttttctatacatcttctcacacttcatattttttgcactcaaaatattaatagcttcttcaaaagcacttacctcatgatcttcatactctgtatccgattcaccacgcgccatgaagcaaacactggagatgttctttcctttatcttcatctccacactcaccatctacatcgcttagtggctcaaatgcggcgtatacttgatcaaaaaccttcctgagattctccttgaacttcctcccttgggatgtaccctttggcttgttgttgttggttttctcaccatctttgtcttctcttttgcctctccgaagcttacgacaatgcgaacgaagatgatcaactgaaccacattcaaagcaacgatttggaccacctcttttcctgttcctggcattattcatagctcgagcaattctgttagcaaccaaagccaaatcctcctcctcgatctgttcgagttgatcatcggaagtggcattaaaaatagcaagaaaagatgacttagatgaagaagcatcaacatccaaaaagaagaaaaagaaaccaaagcactcgacttagaatcaactttacgagaaagaacgttcatctcatgtgttttcaattttgtgtaaagtgaatccaaagtcaaagtagatatgttaacagactcctgaatagatgtaactttcatctccaaatagacatgtcaagaccattcaaaaagtgacgagaaatctcagattgtgaataattagcatcactagctgccaacccgtgcgttgcacgggttatttatcaccatcacaaaatattaaaaatttaattatacattggcaattttataaaattacggcaagataagaagagggtcattgtcaaatgctactcctaatttcgaaataaaatttacaaaatacttaactaagaactaagagcttaagataggaacaaccatagtcacaaagttcctgggtcgatgggatcggggaacggggtcgaggaacgtgatacgctacttacaagaggtttttactaggtggggacgaaaatgaccccgtgttttcgggacggggacggcgttcccgggtcgaggatcgctgccaccgaccccgtttcctatgactatgggaacaacttcatgtttattaattctggatttagaggaagacaataagctt

SEQ ID NO: 73617 - DNA, 13946 bp, Oryza sativa
atatgtaatttgaattatagtacatttccatgatttaatattcgcgatgctcagaaataaaattaataaagtatcgagttctacctggcgttgattccagattgatttttttaaaaaataactttgaatttgtaaatctttaatgattttaaaaaatttaatagttgagtcgtaaaaattctagtctgaattatatatagtatttccacgattcaataatggtgacgctcaaacttgatttggagactcgattatagttttttttcactatttaataaatttgaaattcctaattaattaatgtcaaattgtgcttttatatatgatctaaaaacgaaagacagttatgcatacagctaatatatatgcaacaccactcccatctacctgtgaatgcatcccttaatacatgggaaattaaagacccttaatacacgggaaattaaagagataattagcatccgtgtgccatctctttcgtatgcttaatacatgggaaattaaagagataattatcgtaagtgtgccatctttttttatacgatactgattaggttaatcactgagtactgaaaaaaaaatagtgcaagagcaaacatggtctcaagcacgaacgttccatggttgacatacattgcgccatctcgttttctcatagaatgctgacgacacactcgggcggtggcggcggcggcagcggcttgagttcatcgagtgcagtcgacatcggcggcatatggtagcgacttcatcatccggagatcgatatatcgataggattgtatctgatacggtggactcccaacgaaacaatacctctagatttaatggcttttaaagtggcccataagtgtgatctgttaattgatggtcaggattagattgaatcacctaattaatggtttgatctttccggttaacgtgagagctcgtagaaagtgcccaattagtataggtatagatagataagaagaatcaacagatctaagatcacttaaaattttattaaacctagaaagatagtcatccaaaacttctccaggtttcatctcaaatttaatgtactctttttcaaaaatatcacgacgaagttctttaatgttatttgtaccttgatgaaaattattcaaagcaacccaaatctcatgagcagtttgaagatgagcaacacgatcataatccgaacgagaaatcccactcaaaagaatattgcgagctttgcaatttagttcaaaagcagttttttcagcagcagtattaatagcttcaggaatcacataaggaagagaaacttttctccaaatatcataattctcagccataatgtaagattgcatcctactacaccaatgagaaaaatccgttccatcgaaaacataaggcttagttgtaaacttattagaaatagccatggcaaaaattcaagatcggtaaagatcgaaaagagcaaacgaacgtggctctaataccacttgtaggatcgaatcacaagaactaagccaaccagagaaggggtgaatggttgagatacccaaaaactaaaaacttttagcggaaataaagttaccctcgaaatcgatgaaccgcggtcttaccgaagtatggttgagatacccaaaaactaaaaacttttagcggaaataaagttaccctcgaaatcgatgaaccgcggtcttaccgaagtagtagcaccggtctgaccgcctggatatcgtcagtcttgtaagatcataaagggcctttcccatcccaaaagctagccattgaggtgaggggcttctccacttatatcttaggtcctttgcccttccacaaccaatgtgggactattcaacaatctcctccttcacacattggtgtccctcagcccttcaccgtgtatagaccccacagaataggcccacggtccatcaggtatacgggccccgcaggcacccacggtccacggtccatcaggtatacgggccccgcaggcacccacggtccattagacctccccacagaacaggcccacggtccatcaggtatacgggccccgcaggcacccacggtccattagaccttcacacactgtgtccatcgggccagagatgttaacctagccaggctctgataccaattgtaggatcataaagggcctttcccacccaaaagctagccattgaggtgatgggctcccccacttatatcttaggtcctttgcccttccacaatcaacgtgtgactattcaacacatgtgtccatgaataatcattttctataaactgtagccaaagatattcaactgatgtcttctcttgtgcatattgactaggcacatgcaaagggacatctcagcacgtgagataaaaacacaacttattacgaatggtcataatttaaagcaatgaactcaaaaagatattaacggcacagtccatacatctaatagtatcaagtgaaaagactacctagctcgagggcttctaagtgggccaattgtaaaaatttttaattgcatgtttgtgaagtgatatattacatgttaatacatttcaaattttttaaaattttttcataacaatttgagtgacatgcaacaacgaggggatatccctctcgagcgatatcaaaattcacttcccaaagtgaagtgattgttcagttttcctcgacgagatagagagcatattgtcacaggttcacagcagcaaggacaaaggctaccatactaatgcattagtcagtgagtccaaagactggaaggactcacaatcccgaagtgtcaccacaccaaactacagacgaaggtgtccatatagcacctgaacatgctaacattgttagtaaataacgagccaagatatattaggcacaggcacatacatattactccctccattttaaattgatctatatatttttataggtataccaaaactaagaaaagctaataactctctcatactatatttactctagcaacaaactcaatgcatgcaccattctcagtatttcctagccaatagcaaatcaagatattgcatgtgggttataaatacttgtgtgcatggatgcatgcatcaatgttctttactccaatgcacaaataacgaatagccttaatgaatgaacacatatatgtaaattatttaggaataatctcaaaaatactatatgtagatcaatttagaatagagggagtatctgactcgctaatacttgggaaagatagataggcatctttaacacaccagttcaccagaaatgatgcatgatcatccatcgttggggcagggcaaccattctgtcgtcaacaagaaaacaaaagtcaatcagtaaacgaatatgcgaacggaaagttaagagaaaatcaattctataccactgagtttgtttggattcaataatttgccttcgatattgtctctttctataatataccggtgactttattaattgttctacaatatgctattggactgggcattcttttcaaaaatacgcaaaaaaaccttagatacatacaagattaacatttgatttatctaattagaagtttcaaaaaaatatgaaaatttttatgtggcctcgttacacaagtatacatgctttaattttttctagtatatttagattttagaaaaaaattttgtatgtggtatataatgggaaaaaaatatgcttatacgagggataataacacaaaaaaatatcttatgtagtatatgaaagatgatttatattaaaaacatcaataaaaaatattttataaagcatataacagataaattatatttttttaaaaaatataaatgtaaaaaatgtttcaggccatataaaagttttcatttttttaaaaacttttaataggataaatcaattattaaccttgtatgtccataagggtattttgggtatttttgaaaagaatgtctagcccaatggcatattgtagaacaattgatgaagtcgtcggtatattatagaaagagacaatgtcgatggcaaatcgttgaactcgaacaaactcagtgatatagaatagattctctcgaaagttaaatactacatacgaattatgcatgactagatgagtgatgaatcaccggaataaatccatgccttgtgcccaaaaaactacattttccttcattattagagaaaggtcatatgctacatcaaagtcaggccaaatcccccccaactatacgtcataaaccatcaaactcaaatgaagggcatccatagtcacattactgtactcttcccttacaagaagtgacatagtcactctatggcatctctgtatccacaaaacaaaactgaccatttaaataatactagtcaaatgtgcatacagagagtcagcaattaaatggacaaatatacactttcatgaagaaatatcaagaaagtacataatacaaatttaccacccagcatcctataccaaattaggactacgagtctaagatttatccagtccacagaaccgcatgcatgagaataaattaagcaaactgttataatttagatatttttggatcattcgagttcataattttcaatttcactctctaaagtaagtgttataagaaaaaagaaaggcgagacctctatgacttgtttaatcttcaccatcagtacaggcagtacacatcaataaatcataataagcacaatttttttaacatagcatttgcttcatcataaaacatagctttttgttatgggcattgggccaagaggccatgcccacgaccaacccaaggtgagaagtactcatgaacagtttcatatcaactgttatgcacaaggtttcattggggaaatatagctaggaaaatagccggacggcgtcggcttagatgggatgaggagagattataggatggggaggagaacttgagcgatattagactaatcttgatgcattgcttaaccaaacagagatacaatccatccttgtagatgggcgacttgtatcttactccatccgtcccagaaaaaatcaaacttctagagatgcatctagacaagtgtttgtccagatacatctctagaagttaattctatttggtacggtaccgctgctacagtaccgcgcttcatcttgggttggtcgtggacatgacctcctggcccaatgcccgtaacacttttggtaaaagagaatgatttgttcctctagcataacctccgtcacaaaatgtagtcattttgggcagcaaaaacaacttaaatataaccttaacaattaatttgtacacttgtaaatagtaaagaataataatattgagaatgaacctttcaagacaaaactacagttacatatgttcgatcgaaatatccaaatttattcaacagcaaatatttagacagtcaaattcaatcttccaagaaggacactagatgattctggaactctaatgacaatttcagcataagagattattgacaattcaaacagctaagcgagcacaaaggtgtgacatttagatcaacccaaatataacctataatttggagagaaaaaaattaacacagtttgcttatctacgtaaaatgaagagcatatacgcaccgtgcacaatagagttggtcagaaaagaaaatgcatcaacatataatctttcatgggctcattccatggttcttaagtagacaaaactaaaagtacacaaaaaaaaaaacaaactgtagcaacatgtgtcaatgaataatcattttctataaactgaagccaaagatattcaacttatgtcttctcttgtgcatattgactaggcacttgcaaagggacatctcagaacgtgagataaaacacaacttattacgaaaggtcataattcaaagcaatgaactcaaaaaatatattaacggcacagtccatatatctaatagtatcaaatgaaaagactgtatctagctcgagggcttctaagtgggcccattgtgttcctaatttgatatttcaattctttaaggtgagtttttcatgtggttgtcgccaatttccaaagtgatatataactcaagctacaaaattgtatactatagccatgtagtatgcacaaattgatactactttcaaacaagctgagtagaaatcaaagcacccaacatttagttctggtatttctaagctatggacattcatagcatagactagtcaaacacattaaaacagatagatagcacttatgagaaccgcataattcaagactaatatcggaagcggcatgtcatatgtaggacagttcatcaagcaggtaaagtaacaacaactgtcaccgagaaaataaaaggcattcacaagcaaccaattattgagaataatatgaccttgctatatgtagagagtaaatacgcatgggaagaaattacctttagtatcgaaactacagaacggatagtaataacccattccaatggtttggggtagtttcttaaattgcatttactccagatggaccaggaaggcaccaatacgagtgctcacaaacaacatattatgttcctcaacaaagccaagacatggtgatgtgatacgaggccctggttcgacagaaaggagcttgtccagttgaatggttctctcaagcacccatccagtagcatcatcacagttggtcttgttcttccatagatcgagactaaaatctgtgagaacaaggaagaccagcccaccatcctcagccggcacaatcctgcagcgctcatcccaatcggtatgcataaccagtaaaaggaattaccaaccaggatatcagaatggtatgccaaattcccaaaagaaaacgcagttgagatgacattgccccaatttccgttctcagatgagtaaacgcagacgaacgcgttggcctcgtctgcgaagagcattgtcacctcaaatggactcgaatggcagtcgccgtgcacgtgaccctggtcgccgtcgacgcaacgcaccgtcccgtggtagatggttatcctactctcgtcaagggatgccggaggaatatccacggcgccggtcgccggtgacggggtcccacagcacgaatcagcggcggtggatgaggttgaagagaacggcgcggccgtggcgggtccagcgccggggtgaagatggattccaggttttcgtcttgcctgaagaagccgaggaggggaggcttacggtggcgggcgcggaagcggcggaggaagccgtggtcggagacgaggcggcgccagcgcttgcagacgagggaggcgcgagggagggaggacggctgcggcgggaggcggaggaggatctcggagaggaggtcgtcgttgtccagcggcggcgccggcgaggtggggcgctggcggcggcggttcatcatcgccgagttggggttttcctttttgtctgtcttttttccttttttttcgaattacagaacactggggctgtttactcactttaccaacttctctatgccacaagtgtggtgtatgggctaaaacggtacggaaatggacggaaatcatctttatccttttcgttttcatatttttttcggaatcgtaatcggaattggaaacccggatacgaaaacggaatcgaatattatcgaaaccgaaaacggagcgaaaacgaacctgcgcgaatacggtaacaaaaatttatcggaataaaaaaccccttaaactggtaaatccaattaaataaattatatatatttaaaagagtaatgttgttgataaatcccaatgtaggacaaaaaatattcttatgtaattttagatttgcataacaaatattttttaaaaaaataacagccaaacaccaggtattcactatttagtgcttaaaaaaagaatctagtgtatttcagtcacaaaatttctagtaattccgagaaaatttccggaaattctgagaaaatttctgaccgattccgagttccgacggaaactgcccttatcatttccgattccatttccgagaaaatatttccgaattcgtttccgtttccgaaaaatttcgaccgacaaattccgttttcgaaaataggtccagaatccggaaagtttccataccgttttcaccgctagtgtggtgtgccatagtttttttggcaaaaaaaaaatggattcttttgaataccatcacttaaatgagtttcgctagaatctcattctcaactaagactacttcgccaaaatgccatctcggaggaaaatggccgtcattcttattcttcctcaccacaatgtcgaaggagcttacgggcaactaccgctagctccaccatcgcgccagcggtgccacctcgctggccttccatcctacccgccacattggggcttgaggagaccgcaaccgacgtcgtcaatgttgacgacaatcgagtcggagagtgggccgacagagacgaactcacttacgacgggggcggcgcatcgaggcgtgcggatgaactagccagcggtaagggcggcgtatcgaggcgggcacagaagacgcagacttcggtgagggctggagcgcatgagtggcggcgggggagcgcatgagtggcggcggcgcaaccgtggcggcgatagttgacgcgtgcgcggccagcaggagcgcgtgggcgggcacgcatggcaacgacggccgttgcacagcaagcaagatcttgtgggccacggcgcaaccgtggtggcagtgttcatcgcacgcgtagccggcgagagcgcatgcacaggcacgcaccccggcaagcaaccatggtagcggtggtcgtcgcgtgcgtcacgcttgtggtaattttttttaacaagtgagtgtataacatatgggccattttagtagaaaagtgtggcatgccatacctttggcttcaaccaaacacttgcactaaaaagtcaagcatgtctaattgtagtgtggcaatatttggcaagcaacgaaaccgtccctagattgtgggcacatcttttgcggtaagatgataatatgacgtactgcatattataacaaagtaattttatagataacatttttaaattaaaaaaatcgatagaaaactttaaaattagtttgtgaaattcaaattttgatagtgtttgattttatagtggtccaacaaatgaggcctggattttcttttcttttgtcgtcagtttcagtgttgccggtgatagatcggagtcgacttgggagaagtagatatctagggatcaagagatcatgcgggatactaaaaagctagagaacaataatgcacatgatgatgaagaattcatatggtatacaaagaggaattgtgtatgtatggaaagaggagtcaaatttggaagggagtccaaatttgggaagattgatagagataatgaaagagataagttgaatacttgcaagagagggtttcccacgtggttgggagtcctaaattgtgttagattcatgggatttgcacagcctacctcgtgtatcgattttaaagagacttgagttgagagaaagttagggtttcgagttcaattcgagattttggtgaggagtgctgttggtgcactttgtaaacactagttgatgcaataaagtcgagattcaatctacatcttcgagtttgtcatctaccggtgttttctgggtcccaacggtctgactgacagcacggcggcggtctaacctgtgggatagcggtggtctaaccgcaggtgtgcaggctgtctgaccggtaaggctacggtggtctgaccggcggcgacagtgcttcgtcatctactctggttgatgtaaatcttttactccgcaaaagattttaggttttttggttttccctaccattcaccccctctgttaggtttgtttggtcttgttcgatactacaatgtgctatttgtcatgtgttctataggtggcatatatattagttggttcgaccaacccagcgatcagaagcaatcactggtggagaagtgctttttagtcccggttcgtaaccccctgtagtcccggttttcaaaccggaactaccaatccgggactaaagatcgctatctttagccctgggtgaaaaaaccggaactaaaaatcgatctttagtcccggttgataacaccaatcgggactaaagatagggatctttagtcccggttggtgctatcaggcgcgactacagcggcggtagcggcagtccgccgggtggtccgttcctccctttcttattgcctcccaaatggcgcgttgtccatatgcgccagtcagaccgcacatgcccatcccaactccatagcgggaggcacagattcatcacaaattcattcacaatatccattcacgtattcattcataacatcacaaatatattcacaatattgattcacaggttcattgacaacattgagtcacatactcattcacaatattgattcatagattcattcacagatcaaaacatccaaaccacaaattaaaaaaaataaaaaaaaatcgactcaccggccggcctcccatcccgccgccggccagccacccatcccgccgcttcccctccagccggatctgggggaggggagggcgaggccgccggtgatcggcctccatcccgccggcccgcaccgggcctccgccggccgtcctccatcccgcgcctagccgccgccagcccgcgcccggccgccatcgcgccgccgccggctgcctctgcaaggggaggagggggaggggaggaggagagggggtgagagaagagcaaggggagagaatggaaggagaaggatggagaggatggagataaggaaggagaagaaaaagagataaggatgggagatggggagagagaggctacgcatgctcttgtgcgtgggctggtgcgtaacatcaaccgggactaaagatcccggggggcctgacaaggtctgacaggtttagaaccgggactaaagatcaaatatgcccgctgtagtcaccaaccgggactaaagatcggtttttagtggaaccgagactattatggatttcggccgaccgaccaaagatggtttctccaccagtgaatccacggtccatgtctatttggatttttttggatcactagctatgcatagatttataggagctgagattttctagatttaattgtgaacattagcttgaattactctagctcgaattgcacctacaaataggatggactaaacaaaattcggaagagtaatctcttgattaaagccttcatagttattatatcctgagatgtgttgcgaattggatgttttcttgtcattcatgagtttgtcaaagataggccataatttgatttgccttcatgccaaaccgcaacaattaggacggatcaggatcctctgtggtcgattgcaccgtacctttatcactgtaatatgggcccgatggtcttcgggcccacatattacaaaggatctcaatctctcccacagtgcgtggagctttagatatggtccaccactaatttttttcccgtctggtcccactaaaaatccgtcatctcctccttcagaggagaaaccgcccgcacctccccaactttccgccgctccttccccatctctctcttttatcctctccgttacgactcccatggtggtgaccatccgccccctcctcctctccgtcctctcccacggccgcgcacggcggcgactcccccgccccctcctctccacccaccggtggcacacggcggcggccattccccctccccctcctctctcactggcggcacagatttgagcccctataccaccggcgccgcttgggagaagacgtggtggtggcggcatctcgacggcagcgggtgcctctcccctccctcggctaccccgagtccacgaagcggcggcgaccttcccgagcgccccaactctggcaagcttctctctttagtcggataccgacattcccctttctctctcctgctctcgctttcttgtgcacggatgggcaacgaaattgctgcgaggttctcgtgaccaaagttggtcatgcgaacccagggaaggaacggtccccattccactctcttctccatgcaagcaatttgcctaggtgaaccaacattgccatatatcacgtgtgtgcactgtgaatagtcttatagaacattgctctagccatacatacaacttacaaaagcagaaatcatcaactcatggccgtcagcatgtagccaatcttcgcatatgcctgtaaatacatctgaactctggaaatgatggctgtagcttcgacgaaacaaaacaactgcatttctggactgataaccggcatgtatccagcaaatctgtcgcttgttcgcgccaattctggttgcagttgtgttttcgacagtcacggatggattcgattgaagtcacaagtttacagcagacaaaatagcaggattgagaaaacgtaaaaatagaaaaaacgtaggattttgataggaatgtaagtgtaaaatagaggattgcaaaacgttggaaaaacacagaaatatccgtttgatcgaaccgcaggaaaaacgtgggaattggatgagagagatagactcaaaaggaaagttacaagaggttgaagctcttgctaaatttactccaaaatctttataggattgtctattccatagaaatttcaaaggattgaatatgattcaatcatttgtttcaaagtgcttcatagaaaattttcctacaggattgaaatcctccaaaattattatgtttttcctcgaaatcaaaggggaccaaatcagtaaatatgcccaaactaaaaagagtttacagcaaacagaaaagaataatacggagtactgtatatacggagtagtaaatagctaaatatgcccaaactgaaaagaacccaaaagttcttttgcatctacaatatctttgtatatttgcgattacacagtggacgcatgcccacatccaaaaatttgtttgtaataacaataattttttatttataattatacggcagacgcgcccacacacaccacttacaccacttcagatgcaacatcattataataaatcatgttgaaagcccacttacgtatgcgtagaatttatggacactgggattatttgaaatctaattggtgaaatcattcacccacgacttcatcacacctgtagtgctttcccatttgcaattacaatatgagtaaatttcataaaactacatatactttgcatgatctatcataaaactacagattttagaactagtttcacaaaactacagatttaatgttctcgtttatcacaaaactacaggtactttgaacactatatcataaaactatagatttaagaacttagtttcacaaaactacgggtttaatatcttcatttttcacaaaactacaggtttaatatcttcatttatcacaaaaactacagatttagtgtctccattctcacaaaactacatgttttaacaatgctaaaacctgtagttttgtgagaatagagacactaaatctatagttttgtgataaatgaagacactaaatgtgtagcattgtgataaacgaatacactaaatctatatttttatgaaacaagttcataaatctgtagtttttttatagattgtatatataaagtacctgtaattttatgataaacaaagacactaaatctgtagttttgtgaaacaaactcttaaatctgtagttttgtgataaattatgtaaaatacatgtagttttgtgaaatttactctaaatgagtaaatttcataaaactacagatactttgcatgatctatcacaaaactacagattttagaactagtttcattagtcttgcacagccatctaatgcaacgaaaactaggtgtactctagaaacagtacgacttgcctatgcatccccattgatgtacccatcccattccaagcttcggttatagtgctgcaaatatattactccttcgtttctggttacaagatttttgattttggtcaaagttaacctgctttaagtt

SEQ ID NO: 73618 - DNA, 23626 bp, Oryza sativa
caaaactacgggtttaagatcttcctttttcaccagagcacaggtttaagatcctcatttatcacaaaaactacagatttagtgtctccattctcacaaaactacacgttttaacaatgctaaaacctgtagttttgtgagaatggagacactaaatctatagttttgtgataaatgaagacactaaatgtgtagcactgtgataaacgaatacactaaatctatatttttatgaaacaagttcataaatctgtagttttttgatagattgtatatataaagtacctgtaattttgtgataaacaaagacactaaatctgtagttttgtgataaattatgtaaaatacatgtagtgtaaaataaatgagtaaatttcataaaactacagatactttgcatgatctattacaaaactacagattttagaactagtttcattagtcttgcacagccatctaatgcaacgaaaactaggtgtactctagaaacagtacgacttgcctatgcatccccattgatgtacccatcccattccaagcctccttatattgctgcaaatatattactcccttcgtttctggttacaagatttttgattttggtcaaagttaaactgctttaagtttgatcaaattatagaaaaaaatagtaatatttttaacccaaaataaatttattataaaaatatatttaattattaatttaataaaactaatttggtaatgtaaatattactatatttatctataaacttagtcagacttgaagcagtttaactttgaccaaagtcaaaacatcttataacctaaaacgaacggagggagtaccaactaccaattagatgactccccacactttgctacgggaaacactgagcaattctcaatattttatttgacgatcaagctatgagtaaaaagaaaaaaaagaaacatcaaggtttattagtcaaatgatacccgtgctttagtgtgaaacatattgataagtatatgctaaatattgtaaaagtgataaatagatttgttaaaatatagtgcaaatgacatgagggggtgatgattggatatgtttgcattttgatttgtagaattaaataaatgagtaaattttataaaactacagatactttgcatgatctatcacaaaactacagattttagaactagtttcacaaaactacagatttaatattctcatttatcacaaaactacagatactttgaacactatctaaaactacagatttaagaacttgtttcacaaaactacgggtttaatatcttcatttttcacaaaactacaggtttaatatcttcatctatcacaaaaactacagatttagtgtctccattctcacaaaactacacgttttaacaatgctaaaacctgtagttttgtgagaatggagacactaaatatgtagttttgtgataaatgaagacactaaatgtgtagcactgtgataaacgaatacactaaatctttatttttatgaaacaagttcataaatctgtagttttgtgatagattgtataaagtacctgtagttttgtgataaacaaagacactaaatttgtagttttgtgaaacaagctcttaaatctatagttttgtgataaattatgcaaaatacctgtagttttgtaaaatttactctaaataaattgtaaatcatgttgtatgcttgcatgagattaaatatataattattgctagtgggtgatgatgtggcatggttgcagttgagatttagatttagtgggctttaactttatagaaagtatagattaatagaaagaattagtaacaatatcccctgaggccctgactgcggttgatcaaccaaccattgcagatgctgttgcaatgaaaagcaataaaaagatggtgcttgctgaacctaagcacccagcatatttcactgtaaaggttgcaaatcaagaggcatctgccgttacttagaaatatagcgttaatgatatgattgtatctgtcgtaactgatagatagtttctttgatccacatgtaatatcgaagatatcataattttagtatataatgctgtggtatttcagatagacggttgctagttataaaaataattaaatgactgcacctagatttaataaatggttgcacctagatttgtagataaatgaattgtaattgtgttgtgcgcatagcaaaacaaaccataattttgttggtaccaaactgccaattttgaaaacataatttgctactgaaatgaaaaatattgggcatggacaggtccagaataaaacattcgttataatgcttatcataatgctcatttcactttgatagaaagcaagtcagggcatcagttgttacgtcttataacaggacatctcgagtagataattcctacgagtccacttcacaattgacaaagtgcactaaataaatagagggtcagtttccagtttatacattgggtcattggcacatatcttcataggccacacagccaccgccacatacaaaatggaagatcatgcaccagtaatccatctctgcaccttaccaataacagtcaaaagtctagatacctgcaagagaacaattccatcagtcattctggtataaatttacagtcacaaaattatatcgcattttttttggtgcaatgcaaaatgtaactattattttcagcgttgtgaaccatacatcaaatttccaaagttgaataattccagtattattactaggcaaaaacaaaaagaagaaacactgaacagacaatatagaggaacaattgaattattggaactgttctcgaattttggctacatcaaactagaaaaaaacgcatattaggaaaggacctaatattaaataaatagaaggggtgaggcttcgaaccaggtctgctagcccaccaccttgtggagctagttggaaaacgcgtgggcgtttctctctacatctaactagcaactaaaggggtacaagtacaacgacacttggcaggtagaaagtagaaacacctgtttctagttcatactccagtctacttttagaaattttaggacaaaccaattattactatattcaaattaaaagtcattggagaagcatagggacatcaaccattcatgatttactaccgtttatgattgtacactcaactctttctgatgtgtacctcaatatctcataagtggaacctcttttggtccacaaatatcatttatcttagcatggtaccaacacaaaccttaccaaattttcttaaaccataatttgctgccaatgaaaattttattactaaaaagtacaaaagtatgcacaatgaggatgcaagtgagggatctagttaatttcaccttgaaccagagctcccaatgagttctttactgtagttagttatctattttatagaagagtgaatttcactatggacccctttttattaccctagctgcacagtggaccatgtttagcaacctttccactttatgccacctaaacataccaaaatacagcaatttgattcgattccctagcctatttgtggagcctggaatctacttcgctcctcgtcggatcagcggaggatcgagttgcctgggcatgcaaatcagaggtgcagtttgctgctgacctctccgctcacagaagccactactgctctgacaaagcacactcattatccccttgtgctcacaagctagtgccatctaccatctcttactccttccatggatgggtcatgggccaaatagccatcgtagaatctcaagcaatacccctggttcaagactgctatgttttgtcaagtatgttaaaacttggatataccctggtccattgtgcagctttatgtcccatggaacgtggaacttgggtgtgttccttgttccgggaactttgttctagatcgagaaacgggaactatgtggaccttcgtcccgaaaatggatggaacttcgtcttgagagtcgtcctagtacaaggtatggagtaacaagtagagtggtctgatagagaaattaatgtggcacgatggaaaatgatggaaaggcaatccaaaattttcaagcaaaatctataatttgattaactttcactaaatttgaactcatctggatgggacgaacgctgttgttgctcactcgctgctcgccaacgttctgctgtgcatgtacgagcgtcagcaccatcatgcagtggagaatggacaagcattgccctcatcacgctgtggtacgaccatggagagatagagggacgttccaaacaacgtaggaacacgttccaactaacgttccatgcttttagaaaatgacgtcccacgttcctcgatccatcgatccgggaacttttgtgagttagtaatactgcagctagggtaataaaaatgtgtctaaagtgaaattcacttattttggaaatttagtggacatctgacaaatcataatcagacaaatacttctgtaatcacaaatcgccatccaaaacctgtgtaacacactagcacctaaaataataaaggctccagatatccaaaaaacacacatacaagataaatatatgtaaactgaataaaattctaaaaggaagcaatattcctccaaacagtatattcataaaccttgtaactagggggtgcataagttatctaaaattattctgtgcaagtaatcactagtatgtaaatggactagagtaatacatcctgaagctaacataatctagtaaaaaatagaacttcattgaccaatacaaaatatataaatagtgatttcttcttgtgcaaattaatacattgcttgcagcaggactaagaagaaaaaaaagtattccctttgttcttttgtagtgatactccagacattctacagtctctagacaagatagaacattagtttccttatattagagtcgacaactaaatactatattagtattttccaagacaaatctaactgtggttctcttctcagtggccaatctaaatagtaaatacttctacatctttcaatgttcaaaattaagaaaaaaagaatggaccacaacacaaggcttctaaaaggtcatctcgcagaaacaggtattgaatgaaaaaaaatagtgtcactctctgaaacgagccagtaaattacttatttgatatgtcggatgaattaatctgttctgcagtcaaatgctgaaaacacacctaattttactgcattgtaaaaacataagtacctgcaacataagtacttgcgtagggatgaagcgaggacataatattggtttcccaaagcttcctggactgcagtgaatcaatttgtagcatgaagacactggaatcagcacatagaagcatcaccttaacatcctcagcataacccaatctcactaaatgacttgtcttgaccccagagcccagttcaagaaccttgtttagctcagctgtcctctgcagcacccatctggtaacaccttcagaacagaccttcctctcccatatttgaaggctgtcgtacgacagagtgacaaggccaagataaccaccttctgccagaaagatctgagacatgtagtggctataacaatttggattggaaggccactcaatcacagcaagggtttgcctatccaaatcaaactgaagaatggcactgccaagaccagtggggaaccaatacagggaatggccaacgagtatgccaggatcaacaaaagcaaagaccaagaatggagcaggagtgaagatgagattgctccatctgccggtctccgatgtgtagaagcaagcgaacatttgtgtgttgttgctggccacgcccaccaaggcaacattgaaggggcaacagctgaatccgccgtgaacgtggccgtcgtcgtcggcggcggcacagagcgccgcctcgttccagacgatcttctccttgccgtctatctccggcggaatgcccacccggcggtggtcgccggtgtcggggtcccagaggacgatctcgttctgcttccggtccaggaggaggacgcggccatggcggcatccgcagaacatccgctctttgcggacctcgtcctcgccgagccgcatcgagaagcgctcccttgggatgagatcccgcggatccatcacggaccggaagaaggggaagccgaagtcgtcggcaaagacgccgatgatggggggattccggtggtggcgggggcggaagcggcggtggaaggcggggtcggtgacgaggcggcgccagcggttgcagacgagggaggcgcgggggagcgaggagggcagcggcgggaggcggaggaggatctcggcgaggaggtcgtcgtcgtccggcagggtcaccggcgccgccggtgaggtggcgcggccgcggcggtggcttatctcgccgctgaggccgcgtgcattgagattggagagtagtactactgtagagtgtggacagtggataggtggagaagaaaaccatgaaaattttgcaaaaccgaaattattttgttaaaactgttaaaccgattattttgaaaaccatactccctcgatcccaaaaagtttcaaatcctaattacaaaatcgtagccatgaccatgatggttagctacaggtaaactaacacgtgattactagaccagcacccagcatgcagaggtagcacatgtaggaccttctgtttctcctggtttctggtcttcttagctcgatcttgtcctttaatttatgatttctgaatcgtctaactttttggatttgataatttgtgaagatggatattaacgggaaaggaaaaaggcctcgttatctcaaagaggtagatttgggaatttttattagtctatttagaaccagatttgaaagatattggaaataattgattgattttttttctgtcttcaccttctctttgtcacctttagcttgaagccttaaaagcttgcctatgttgtctcgtaggtttggttccaacaaatattatttatgtgttagtaaccgattagtacatgatgattattagttatgtattagtaacaagtaaaacttttaatgaataatattttttaaagcaacttttcaatagaaaaaatatattattttgcagttaaaaacatgcaacaatatatcctccccggtcacaaaatggaaaccatgcccatacgtgttggccgttggacacttgaatcacgaccttgctattgtgtgaatgtctattgcgaaggcgtggaccgtggaaacacatccctacgagatctatttgcgtgcttatggcattcaagtagattagtgtgtacaattgctattatagttagatgagcacttacaccaaaaaattgttttttaaaaataatcttgttgtgcaaaaataaattttctttaaataaaaccttctactcaacggatttttcttaaatatttttcttaaattatgatagggaggtaggatggctgggggggaggcggaggaggatctcggagaggagatcgtcgtccggcagctgctccagcgaggtacggcggcgatggatcatctccgactcactcgtttggggggttttctcgtccagagaagcatatttgaggtttttcttgtgccagacaaagatcgttagcttacgtgcttttgcataattttcaaacgatagcttgtttagttgcacattaatttaaaaaaatcaggttatttttattattttgtttaaatgtgggatagtttcggaataaattcaataatattaacactaacacattaaatacacaaatgttgcaagattaataagatgggtcaagtagtcttgttgatgcaaactgctcactttgtatatgaggatgaatcaagactccccctgtctcctctttccgatggattaaaaagacttcctaggaaagctcaagttattctcaagcaacaagttgccattcagacattgtcgagaacacatttttcatgggctttaagaaactgtactcgctatttgtccagggagagcttatgttttattagggattgtttatatgcctaacttttttgcatttttaagtcaaattatttttctccagtgatgacccaaagacaacggtgatgaaaaggaccgattaggtgtgagggttgaggttggggtgggatagggggttgggatagtcgaaggcggggtctttgcgggcttagagtaatggcctaggagtcagcgatagggttagagcagtatagtaggtgaagttgatggtgggggcaagggaaatcaatttgtaaggaggtgtaagccgtcaaagatgaggaaggtggggggatttcatcaatgaggaagaagggcgagagtagttggctaggagatgggcatagcgcacgaaagccgacaggcctttctaacattatagaggcaccatgaagcacatcactagtggtggcgggatgctaagtagggaaaagggattgcatcggtagtggaattggggtgaggaagaagagggaggtagggttgggggagggggagtggtttggagacagcctgttcattcaaaaattgactgatatttttttctattttcagacctcggaactatagataatccctttcttattattaatatggatcctataaacttacatcttggtgctaactctttcttaaaaatagtcgcacctgataattccgcatctggttacttaataccatgagttggagtaaatttgttttcattctcccttgaaacaacagagcaatttaattcaatgtaagtaactttcctaaaaaaaacctatttctctcctaaaacaattttctatagaactaaacccctcaagtgtcctaaagtattgagaatgattgtttaggctgtgttcgccagtccatgttcccaatcggaatagtacgcgtggaaaacagagcggtctattagcccatgattaattaagtaatagctattttttaaaaatggattaatttattttttaagcaactttcatataaaaactttttgcaaaaaatctcaccgtttattggtttaaaaagcatgcgcgcagaaaacgagggagaggcattgggaaaagggtgtgccgaacacagccttacttattaatacttcagtcctaaatttttttctaacatttcaattctgtcataaattataaggaacaattttctcttagtctgtctttaatgcaaggcagcgcttttgctataggaaaaagagagcgtcacgttcttttatgtgctgttaggcttttgtactagaggtagcatatttgttggttcgcccaacacaacaattagaagcaatcatcggtcgatgtctatttggactttttggatgactagctatgcaaagatgtagtaccttcatccctaaatataaaattcaatccctaaatataaagaattttggtgggacatggcacatcctaacacaacgaatctagataaaagtacatccaaattcattgcattaaaatgtatcaaatctcactaaaatcccttatatttagggacggagggggtatgagaactgagattatggagatgtaataagctcgaattgctcatagtcatataaataggatggagtaaaccaattttgtagagtaatctcttaattaaggcattctaagtttatgctatcctgagatatgatggatttttttttttgtaattgagtttgtcaaagatacatcataatttgatatgctttcatgcaaatcgacaacatttatagaacatagatcatcgaaattctagtaagccaaagcaagctaaaagaggacatgtgcatgctccaaattccaccacccaaccaaccagttcttaaaaccatctgaagtgcaatttttcgacaaagagagttttattaatcttagacaattacatcaagaggatacaattattctaagaccaccctcgccctctgcatagctaggatgcacacagcctatcatctgaagtgcaatgccaaaatgtaaataaatcatactaaaaaaaggtggaactagcaacaacacaatctccatcatgttataaaacaatgggcaaaattacacgcagtactagtaaagtagaaacaccattgatatatagtatcatttaccaacaacaaagcatgaagttcctcaaacacgaggaaatgtgcaaaagatacatcaccagctccatcatagattaatattcatgggcaagcatgtgtcaaaattcaaaaggattcagttcagttcatgaggcaattactagctatacatacaacttacaaaagcataaatcgtcaactcatggccatcagcggtttgcccatatatacggcaagtaaccaaaccttcccatatgcccataaatacaactgaaatctggaaatgaagtggcaagccagcaaattcatttgtcactatcagtcacacaatttaacaaatttcacaaacatcagagttcaaagcctggatcaagctgtgatgataatgacgacttcaacgaaacaaataactgcatgtctgttctgggtttaaaacccataagaaacatgtgttcagctgcgcacatcagcctaattagtgctatgactgataactggcatgcatccagcaaatctatcccttgttcacgccaattctggttgaagttgtgctgccaagttttcaacagtgacgtatggggaaaaaaaactcaatgaagtcacaagtttacagcagaaaaaaaagcataataatgtatatagtaaatcactaaatatgcccaaactgaaaatgacccaaaaatttgttgcacaccaagcggcattgcaactacaatattgttagtcttgcacagcgatctaatgcaatgaaaactgggagtgtactctagaaacagtacgacttgccaatgcaccccctttggtgtacccatcccaatattatgatatactgcttcaaatataacatcgattaatacaaacaatatcccctgactgcagttgatcaaccaaccatgtccgatgctgttgcatccagcatatttcaatgcaagggttgcaaatcaagaggcatctgccgttactgagaaatctagtgttaatgatataatccactttatctgtcataatgctaagatagttttttcgatccaatgtagtatcaatgattcataactttagtatataatactgtggtatttcagatagacggttgctagttataaaaataaatgattgcacctagatttgcaaataaatgaattgtaattatgttgtgggcatatcaaatcaaaccataattttgttggtgccaattttgaaagcataatttgctactgaaatgaaaaatattggtcatggcctggtccagaatgaagcatttgtataatgcttatcctaatgttcagttcacttcaatagaaagcaagtcagggcatcagttgttatgtcttataccaggaaaccttgagtacataattcctacgagtccacttcacaattgacaagtggactaaataaatagagggtcagcttccagtttctacattgggtcattgacacatatcttcataggccacacagccaccaccaccacatacaaaatggaagatcatgcaccagcaatccatctctgcgccttaccaataaaagtcaaagtctagaactctagatacctgcaggagaacaattccatcagtcattctggtatttacagtcacaaaattatatcactttttttttgttgcaatgcaaactgcaactattattttcagcattgtgaaccacacatcaaatttccaaagttgaataatgtaagtattattaccaggaaaaaacaaaaagaagaaacagtgaacaacgatagaggaacaattgaattattggaactattctcgaagtttggctacatctatctagcaacaaaaggtttactacttcactgcctcattttggcagatgagaggcacaaccacacatagcaggtagaaagtagaaacacctgtttctagttcatatgtatacttttaaatatttaagaaccaatcagtaattactatgttcaaattaaaagttgtcagagaagcataaggacaccagccatgcatgattactattgtttgtgattgtatacgcaactcattctaatgcatatctcaatatctcataagtgaaacctcttttgctcgacaaatagcatttatcttagcatggcaccaaaacaaaccttaccagtttttcttaaacacacatacaggagatatcacaaatgtaaactgaataaaattctaaagagaagcaatattcctctaaaacatatgttataactatgggtgcacaagttatctaaaattattctgcagaactgaccgtgtgtatataaatggactagagtaatgcatcctcaaatctagtaaaaaataattagaacttcgttgacaaacagaatgttatattagaaaaaagataatacaaaaaatatatgtatatatttcttcctggtgcaaattaatacattgcttgcaggtgcaaattaatttcttcctggtgatgcttctgactttttaccctcttttgacaggactgaacattaatttatcaagtaaataaaaacaaaatactatgcagttattttccatgacaaatctaaatacttctacatcttccaatgttcaaaattcaaaaaaagttggaccgcaaagcttctaaaatgccatctcgcgcaaacaggtattgaatgaaaaaagaaacagtgttaccctctgaaatgagcgagcaaattacttatttgacatgccatatgattcaaattctgtgctttttatttcgtgtttatacaactacacctattaatctgttatgcagttaaatgctgaaaacataagtacctgcaacataagtacttgcgtagggatgaattggcgcgatgacacaactttcccaaactttcttggcctgcaacgtatcaagttggagcatgaagacactgtgatcagcccatagaaacatcaccttgatatcctgagcataccccagttttgttaaataccctatcttcaacctaaactccgggttaagaacattcttcagctcatacgtcttctgcagcacccacttggcaacacctccagaacagactttcctctcccacatttgaaggctgctgcgagacaaagtggcggcgccaagacaatcaccttctgtcagccaggtctgactgtatggctcggaatcgtagggccattcaatcacgctgagggtttgcttatccaaatcaaactgaagaacggtaagccaacgttcaccataagccatccaatacagggcattgccagcaagtatgccaggatcacgaaagaaaaacaccaagaatggagcagctaccgatatgagatcactccatttgccagactccgagcagtaaacgcaggcgaacatctgtgtgttgttgccggcgacgcctaccaacaccaccctgaaggggccgtcgtcggcggtggcagcagacagcactgccccattccaaatgatcttctccttgccgtcaatctccggcggaacggccacctggcggtggtcgccggtgtcggggacccacacaacgatctcattcttcgcccggttgaagaggaggaggcggccatggcggcagccgtagaagtgccactggccgccctcgtcctcggcgagccgcagcctgaagcactcccttgggatgagatccggcgggtccagaacggaccggaagaaggggtacccgaggtagtcctcgaagacgccgatgaggggtggtggattccggtggcgggcgcggaagcggcggtggaaggcggggtcggtgacgaggcggcgccagcgcttgcagacgagggaggcgcgggggagcgaggaggggcgcggcgggaggtggaggaggatctcggagaggaggtcgtcgtcgtccggcagggtcaccggcggcgccagtgagatggcgcggcgatggcggaggcggttcatctcgcacgcagcgttggggtttggctggggggcggcgggtcggggtaggcggacggctgtggggggaggtggagcggtggtggggaagagctggcatgccgggctggcggcggccagagccggcgccgacgaacggtggatggtgtggcaagagattattgatccgatggttttagatacatcaactagtgttccgatgtcattaaatccaaacgattaaatccaaacgattagataattaataaaacttttattgcaactagctaaaaccaacttgttgtaatccttataagccgatgcaacgttcagataactcattggctgaaattccgataaaacccttattgtcaatcaaaacgcaggctagagattatggttttaagcacaacttaggaggtcaaacccaattgatacagcactaagtatgaaaaaaaaatataatattagacaatcaagcctttgattgattttcagggtggtggatatcttagctaatctagattgacaaaaacaatttagccgatactggcaaaaccctagaaaagatctaaccgatataagtaaattgaataattgacttaaattaactaagatatatgataaataggtacgcaaatatatcaaccgaaccagagcgatccaaaagatcaaaatgaaccgccggcggaatgtaggacttaccccttcgccgaagatcgaactgaaccgatgcagcccgcgtcaggtgccaaactccgccagttgataagtaaaaacctcatgaaagaagatggtgatgcaccgagagtagttgttttgatcgagagatagattatagggaccctaggtcttatagataaaaggaaatatacaagtcctgatcggacactaaataaacacttcctaaagatagaacgaaattactaaatcttgccaaattaatagatagaattaagccgtcatgcgagagtcttcacgattccttcttgaactcggtctcttctggataagtttcagtcggttaattgttctcattccttaaccgaattagtaaagaatcttatcaaattttggggttaacaccccggccccgagaggggcggattcagccttgggcgcggcggagtctcgacaatgacagtgtctatactagagtggatttgagctagggttttgaagttttggcattttttttgtgatttttgttttggaccttcacactgtagtgcatgtacaccaatcatgcatcaaccctttctagatgctcgcatgtactaatcatgtatcaacctcatctaccagggttgattttccatgacaagccatggtaagaacggcttgccatattcgtacttttttggcatgtcctcggatgtccaatgttgcatccctttcatgcgaaaaaacatgaaggcctaggatatctgtttagctccagtgcatgacctaaactttgatgaggtatagacatgccagtcagtctgaacctgcaactgacaatatgtcgatgtagcagcgattagacgataagttgaacaatcagctgttagagaattggagacccggacgttgatgatgattgtaggctctagtctcaagtgtgccaaaagcgtgtaccgacccataaacgatagccgatggcttggtgtagaatcggctgaaggatccgatgtagtcgttgaggctagccgatgttgatgggactctgaatgatcaactgcaagcttgttgtagaattggatcggccggaagtccgatagaaatagactcaaatagttagataaacaatgaagccgttgctaccaatcttgtatataatccttataagtcgatgcaaccatatctagataactcatcggttgaaactccgatgaaacaatgattgatgcctactgacttaactaaaatttacttacaaccacaaccccataggtcaaacataaccgatgcagcataaggttgataattgcctgatatatttaagcaaaccgatatgacaccgatcaaagtggtcatgtattaaatttaactaagacagtaaaaccatcaacggagaaatttaagacacctgataagatcagctaacactctgataaaacattagcatgaacctactggcttaacaagacttagattatcaacaacagtctatgggttggatataactgatgcagcacgatatataataatctaatactcaatgaaccgataaatttatctaatgtgatggatataacgaatctatctaaaacaacattgtgattgtagagatatattgactaagtcagaagatcagacctaaccgagacagtcccaactaaactgatgcttctctaaatataatgcaattaaagatagaattaagatatcatgtagacaaagataccgactaaagcagagaaatccaagaggtcaaagggatgcagccttgaacaacaccaatgtagccagtacaattgacaaggccgacataacatagtacttaccccttcgtcgaagatcaaaaaccgatgcagccccgcgttaggtgccaagttccaccggtaataaataaaaaccttgaaaatgagggtggcgatgcgccaagagtagttatattgatctgtgagatatattacataaaccctgggtatatatatttatactcataggctgataagagtccaagtaagacacgatataaaatttcctgaagataaaaagaaaaacatatgtcctgatcggagatgacacaaactttcctaaatacaaaacttgcctaattaataaataaactcaaactgtcatgccctggtcttcatgactcctcgaacccggtcttttctggataagcttttcatcggctaattgtgatctttccttaattgaatccactaaagaatcttatcaaaatttgacgttaacgggaatcaggcacgcgtcacgaatgactcgcaaggcgcaagggcgctccggattcagaatcacatgcggttggacaggtgacgctatgaagtgggtaggcgcccgcaaggtagtaattgaatcggacgataacgtaatcatggcgcccgatataccactcatgtacttggacaccgatattgtatcggaatagggtgacataccaaaattttgggcagaaacatctttaatttttacaataactaaaaaaaagcccatacattgcaacaggtaaaaacgttttttcagtggtacaaccgctattaggaactaacgttaggatcactgcatatatacattataattgaaaacgttaataaaaattgttccatggtttgggccgaaagcctattctttctttccttttccatcccaacccaatccgctacctctgtctgcttgatctgactctcttcgatccagcccacaagtggagctacaagtccagctcacacagccgactgccctgacttaggtggagctataggcccagctagcatattcaactgccgtctccaacctccagatagtcatgtgcttgtatgccggagccgatcctctccatcaaatccagccgaatcttttttatatctcaaaattagttgagggcttttgttccactcgatctcctctttccatttttcctgaaatcgaaacgaatccgtaaaattcggaataaaaaggtcggtcggctatcatcggcaactaagactaaatctactgaattaaagccaaattgaaaggaaaattatgagaaaaaataatgagggaggagtggggaatcgatttttgcaatgtagagactgtcgacgtttgatgtcgcgattccggtatttgcatagtatggggatcgtcggtgctaggatatatgcgagactgaggtaaaagagacagagacagggatttttacatatgttcgggcccctgaattgtcaagtaataaccctacatcctattggccggagccggtgttgctcttattcactataaatcacaccagtacaatatttgggcagcctatctaactgttgtcaatatggcggtttaaaggtctgactcgtagtcgacaatagggtagtcttcctcctcgaatccgtgcccggcgagatcagagatagcgctttcgtctctcctgacagtatccggagacaccgtaggggactagccgtgcttatccctgaagtcgatatccggcgtcttgtcttggcgtatgttggcttgtatgttgttccgtagattgtggtgggtgttgattgtggtgatcttgtcccctctcctcctagggggccttgtatttatacccataggtgtccccttgtccaagtagaactagggaaacctatatggatacaatccgagtagtccttgtcgtttccatgtagaactctggttgtctttccttattcggaacttcatccatatctgaggtcggtttccgtataagacatgatacgtggtgtgtcctgccgagatgtagtcgactgctattaggtatgtggtatccataaccctgacagtagcccccgacttcaatgcaaatgaacaaattcatattctcaaccgctgaccatggagtaactgttatcgagctcaagtgaccgttcttggtgagttcggagataacgttagacttcctttatcagcctcgtgcgggcacctaaagggtttgtctgagtcaatctctgacgtcaaccaagaaagtacagagcatacgactaggtctcccgtcttgctgtaatcgagaatttggattgaagtcaagaaattttatctcggcggatacaccatctcttcattccgtattccttgtcgagatccaccaactgttctcgagcgatcgagaaggcgtagaatctgcgacgaagccttgtcaacattggtcgtactcgccttagtcgatcttggtgtagaaccatagagacatagagtcttcgtcaatgtcgaatagaattttcctgaaatcaatactcagaaaagaatattagatagaaatagcccccgagcgagcgctcaaagggtgacatgttataatatgtatgaaaaactgaaaatgagttaaatttatagaccaatgttttgtatatgagcgtcttctctcttaccgacttcgatcagtcagtttgttgagtcatacactctcccttgaccctaagaggagaaggctcttggacccttgacctgccttggttgaacaagcactgatcctagcccccagccgtgaagttggaaaactcaatttccgattacacggcttggttaatacgcgcggcgagaactcttacacgaccagatcttacatggtcttttgtctctacaggatccgacaaggccttatcggctctgggcgtcactagccgaagttcctcgaaggccttgtcaagacggcgtaaagggacagtaggataggtttcaacgctaggtgtcgtcgtggtaagggatctctgggtaaaacacttggcgatattgtgtacctgatatcaactttgttgaggtagaggtagtgggagaatcgctacacttttggtcgaggaccaggtagtagtcccaactcgaccacttgaagtaaaggtagtgggagaatccctacaccactggtcgaggaccaggtagtagtcgtaattcgaccacttgaagtggaaatagtgggagaatcgctacaccgctggtcgaggaccaggtagtagtcgtaactcgaccactagaagtaaatgtacgagagatcactacaattaactggttaagaaccagtgagtaggtgtctctcgatcattttgagtcgtggtacgaggaccgctacgctgccggtcgaagaccagtcgtagctgttcctcaaccatctgaagtcatggtgcaaggaccgctacgctgccggtcgaagaccagtcgtagctattcctcaaccatccgaagtcatggtgcgaggaccgctacgctattgctgtagttgtacctcaaccatatgaagttaaggtgcgagagattgctacgttttactagttcgagaaccagcgagcaagtagaattatctctcgaacaccaatggaagtttgcggtgcgagagattgctacgtactggttcgagaaccagcgagcggggcagaattatctctcgaacaccaatggaagtttgcggtgcaagagattgctacatactggtttgagaaccagggagcgagtagaattatctctcgaacaccaatggaagttgcggtgcgagagattgctacgtactggttcgagaacaagcgagcgagcagaattatctctcgaacaccaatcgaagtttacggtgcgagagattgctacgtactggttcgagaaccagcgagcgagcagaattatctctcgaacaccaatcgaagtttgcggtgcgagagattgctacgtactagttcgagaaccagcgagtgagcagaattatctgtcgaacaccaatggaagttgcggtgcgagagattgctacgtactggtttgagaaccagcgagcgagtagaattatctctcgaacaccaatggaagtttgtggtgcgagagattgctacgtactggtttgagaatgtcacgcccagaaattcactagtaatttccgaactaatttgtgtattaaaatcctcgtccaggaatcagccgaggtacacaaactgacaatttaatatacagattcatcataatgcgataaatacttacatgagaggcactttagtcctcagcacgaagaaaactgcagcgaaaaataaaatctagcgaagctctggcttcactcccacaggcagctcaactggggtataagccaaacgtcttctccttcgcaacttgtcttcaactgaggtttgattgattattgcaaggtgagtatatggaatactccgcaagccacatagcaaatatgcaagtgcacaaggataccaaagaatggcataatatagggcttatttgcaaaagaagcatttagcaaacaattgagaattgtaaaatagtggagtaattaatcatcaatattaatcaacactgaacagcacacccatgctgcacaagcccaaccatcctgaacaaccatacccggctgtacagatctatctccaaaccaggaatgtaccattccaaaccaggagctaatcaaattaccatcaattatcacgttattattaataagtagtgtgggactaatcacgaaagacattgttagacccgcccataaccgcaggcacggctattcgaatagttttactctggccagaggtgtaccactgtacccataagatacaacccaccgtcatgtcaccgtgtccgcgcagacacgtcaccatggcgagtgattgtgacaagacccctcgcataactcaactcaaagcagtgcaccattcccggatcatagtcaccccctcaaaaaccagaggcatggactccctagcgacccccatgggcttatctccaccacttctcagtctggtgctccgcagtgagccttgttatacaaagtgtccagccgttgcccattctggcttatggttggcacggtaaatgtttcacaatcgaaaatcgtgaacaggtccttaattgtcatgagcactaccatcaaaaccatgtgctcacaacccaccattatcaaattttagttggcacattaattaatcaaccaatcacgattgaccatcgtgagctatcattaagccatcattaaataacagtgaagcattagttatcccaattgtgtgctaatgtttctaagcatggctaagcaattatgtctaacatctagctgaaccaatatataaagctcaactagtcaaattataataacctaaggtatcaaggaatagagtaatcaatgcaaacaggccattacaaaggaataagttcacaccacccggtggcattcgaaaataaatgcacagttgaaataaatagagaatttaaatataggatcaacatgcttaaaggaattgtgtttgggatctgtgtgacttgccttgcaataacgggtcttcaattaatcttcttgaacacttccggcgcactcgcgaaccttcgaaacgacggaaacgacaagctaacacgcaaaacaaggaaaaagactaataaaaaccaaataaacaatacatataaagtaaacaaacatgtagatcataattttagatgaattatgagacttgaacggcctcattctgacttcatatgaatttattacgaattttactagattaaatctaattaaagcctatttaaaaaggattaaataaatttaattcaatttatggataattttaatatgtggatctttattttatacaacttttgcaacttgaaccacattaaactgagttacagagaattagttatgaattttcaaagattaaattggattaaatcctttatatagattttaattgaattatgacgcaataatgaattatttttgaaaaggaaaagggatttattgcgtcagcggactcggctcatggtggaccgggtgcacggcggcggtctacggaaacaaacggccgagatctatcctatctaaaacggacggccaagacctaaacgatccaccgcggtccacggggaacggcatcgatgacgtcatcaccagcggcgactcggcctcgcacgctcgccggcgaacgacggcgcggcggcacaaatgaagagcatctacgcgatgcgggcgacgcggcgatccttaccgaggcacgaacggctgcggacggtgaccggacgacgacggcgacgaggatgagcggcgacgaagatcgggtcgacgacgacggcgatgttccggcagtcctcggcgttgacggaggggtggacgaggtcggcggcaactcggcgaacacggcggtggtcttcccaagcgacgacgatgaccggagcgacggcggcgcaaggctggacttgcggcggcgatggcccacggcgaccggcgatgggaaggaaagattagggttcggggagagagacgaatccgattcgagatcgaatccacggatttccaaacgattttagtcgacgattccaaaagagaaaaggtagaggagatctcggggatcattttccctctatcaattcggccagaggaggaaggaagcggccgaatttggaaggggatcggcggctgcacggcaaggctagggcacggctgcggcgactggaggaggaagacgacctgacaggtgggccccacctgtcagcggcgagggctcgcgcgtgggcggctcggctggcgggctgactgggccggggagagagagagagagctttttgggccgactttcggcccaaagccaaaagaagaattttaaaaactttttcaatttaaattattcgtgaaatgcaattccatttattaaaaatacttccttggctcaaataaatcccagaaaaatctaggaactatagaaacaagagaagtatttaacaaaattttatctagcccacttttatgttgagatttaacaaattaaaattagatcttctcttttaggattttaagatcatttctaataattccttttacacaacaatttataatttaaggatttttaaatgagaaaagcacttaacataattataattagatcattaattgattaactaattactgaattgttctttgtatcaattaggaattgagctctgaaaaatccgagaaaatttcagagagtatacttaatcatagagaatttaataaaaattaaattcatccatgctttatatttaggaaattttatttcccacatttaacttcacctgtaaattaatgaacatttaatataaattctattaataatttatt

SEQ ID NO: 73619 - DNA, 16965 bp, Oryza sativa
tgagtggtggtggagcatcggtacatcatccgtggattcgcaggtggcgagcgacgggtgaaaacctagcccggccttggccagaccgacaacgatggttatttccccctcctgagggcgttgtcgtgctgtctcacccctcaagggcagttgccgggcgaaagtccagtcttggctcctttgagctctaacggacggtggcgtcgcttcttgaagacgtcgttttggcacccccttgctgtagggcgatctcgtctgtgttcctttgttggtctagcggcggccggtcacgcttagcgacggccggtccggtgctaaccttctcctgtcatgtgtgttggcgctgctggtgtgtgggtggtggtatattttttctttttcctggttatgaccctccaggattgtaatcttgtaattttttcctactctgtcaatagaactcgttcaaaaaaaaacataatgactgtgaatacatgcatactagccatgtttaatttgtttttttttacaacttgtacaagttaaaaacataatttctatttttgtgaggtgatatatcacatattaattttatcttcacggttttttatatatctatttaaattatatggaaaaaacgaagtgacatccatacgagagtttagtgatcattcccctttctctccacgaagagtttagtgatcattcccctttctctccacgttcttcgtgtattgttcaattagtgcgttataaatgcttgggagtttgttaatatctttgtgtggtgatgggaggggtgtggaattgattgacgaactgtttgcacgatcgcatcgccttgctcaagttcaggtcatgctggagattgctggtgagctgtcgcctgcaattttctgcaggaattgcatcattaaactgaacagcgttcagacttttgtaaaacattacaaccgcgcacgtcgcctgcatagattacatgcagagatcataccattttatgaatcgtgaggaagactagtgatgttgagtgattaagcatttcgtggcagaatgtcacaaatttcagcctgcgggcacaccgggctattctgcaagactgcaaccaagtttatgggccttatgtcctggaccccgtgctcgagtacgaatggtctgtgtatttaaaggaaatatgaaaatacatataatacattatttccatttatttgcaacaataaggcaccagtggtctagtggtagaatagtaccctgccacggtacagacccgggttcgattcccggctggtgcattttgttcctcccttcatttttatcactggcttaatcgttttctgaagatgttcacctagtcagccatatttctgtgctcatttctgaagatgatcacctattcacctctgtcccgctgtgactatctttttttttctctcactggcttaatcgttttctgaagatgttgagatgttcaccctctcaaccctttttgtgctcatttatgtccctgtgactatccactgccaatcaaaagtcaagacaaaaaagactcgccgaggaacgcctcaacttagtaccactccataacactatcatatcctatgttttatgatagaatacagcctccaatatcagaccttcaaaacatgtagaagcaggaccgtttgaactgatcaaaacaggcagcaataaacaacccaaatcagaaatcacccccctactgttcttgcatccgtttaactataaattctgacgagatttcttacactggtatcagcaacagcttatagctcagctcggttcagttcagttcattcttgcaaagttacatagaacaagaagaaattgagcagcaaatatatatatcttctcttcaccgtccgttcttggacagattgagctagctagccagccagccatggccatgggttccatcaaggtgcaggccgtgatcctcacatacgtcctcctcgccgtcctcctccacccgctgctctgccagggctcgccggcggcgtctctcctcgaggcccagaccagcgacggtaacaagagagctagctatagccagctagctgctcgatttcttcttctccattgtttttctgaacttggtgaacctgaatgtgctctgttttttcttttttgttgttgttgttgtttttttcaggtaaaacgatcgaccagggcatcgcgtacattctgatgatcgtggctctcgtcgtcacctaccttgtcggatgagtgattcagtggcccgatgatgcaatgctgcctgctgcttttttttttgtttcttttgcacacgtttaattgtaatgttctttaagttgtacaaattcattttgatctgtcaatgagacacggcaagacatgagtaagcattagtactgaaagtttatgcggtgatgacaagttcttgatttcgtgtcatacaactggaatgacagaggatgatcgatcgacttacttaacgggcgattagttgcgcaaaagttttattcgtgtcatacaatggaaggacagagcaaatgccgataggctgcatgtcttcgccatctcttgaggtttcctgccaccacaacacacaaacacaaacgatcaaaaatcgtgaaatggttctatggttgatcttgaggagaattcgaatgtttttggtaaattcaaatttagacccataaattcgattaaactttgttgaaatttcccggttcttgacatctgattggaccctgcgacgtcctaattatttggttttattatcccattttttaaaatatagcgatgtgagcttttcgacattaagttcgacgattagtcttaacaaaaaaagtataagtgaaatgaggatatggaagaggtttatagaaattcaataaatatggatatagattcatatagtatggtgtggatgtggtatcctaaaatctagcagatgcggattatacaatattttcatctgaatatccggtaggttatttatcgggtaatctgaaatcgtcaacccatgtaaccattttatttgttccatataacatgagttgactcattcaatggcctaattcatgagttaactcaggctcctcaatctgatattctcaccatctcatctcatgaccacttgtaaccaccgctactatagcctttgctatgtattgttgttttatatttgtaacttattagtatatatggacatcatatttagacgtgctatgtgtcctaggatgtgtgtgctatcctgtgttgattgattgggtgcttgtcttgaacgtgttaatgccagctttgactttcaaatcttactaatctattatgtataaacattatggattcatattaagtacttaagaaaatactacctctatcccaaaatatcaaatttttggctgtgtctggacaaacgtatatccatatacataaccaaaaagttgtcatatttaggacggaataagtctacataacccccaacctattgtcaggagattacttaaccccctcaccttacaagccaggtatttaacccccaatcttactaaaatcatttaattaaccccttatggtggttttgctccctagttttgccttgctggcatgccacgttagacagatggattgacaggcatgctgtgactgtcacctgattttctcaggcaaggccttctactctacccggtcctctatttacattgaaaatctataccatttttatggttcataacattgccattgaagtcggaattgcatacatgtgcaagaattcagtagcacgagcaaaacaagagtgcaaaaccaccgcaaggtgttaattaaacggttttagtaaaggttagggagttaaatacctggtttgttaggtgagggggttaagtaatcacctggtaataggtcgggggttatatagacttattcatatttaggagagagataatagttgttatgttggtccgttgattgattattgttttttgtccattgtatcgctaacttaatgttgcatcgattgtatatatacgcaataccagcaattttgattcgtttctgagtggagtctgctttgactctgcaacattactgacataaaaaaacaatctgttatgcattcacatccgcaacatccacattcgctatgaattaatgctcttaaaaaaatatggtatatgatatggtatcatcactatccgaatttgcttaactttcatcctaaaaaaattacaagattcatattttttattgtgacttaatttatcactaaagacagtttaaacatgacttatattttttttagtaaaattttaaataaaacactttaagaatattcaaaaatagctcaaaacttcgtatgtgagggttaacacttaataccaaggtttcatgtttaggaaacttaccgaacggttccaaagtaggatagtctttcgacataatatattagaaattattttatatagctgtaattatagagatggagaaaaaaatttgagctctgcccccttcccgctatttgaagtcatagtaacctagtttttttccttgtcttttgttttcctcctttcttgacataactcggtataactgattgtgttgtgtaacaatattcttttcttttaatatattgacgtgtaattcttttacgtgttcgagaaaaaaattatacagattaagccgaaatttgtttgagtttcagtttcattttctatcattcccctttttatttccttaattaacactcgacgagaaccaccctcagttccatgattggactcctgaaacggttttgctataaataaatcttgcgacagatttcttgttacatatcattcgatttttggaccgtttgattgcgtcaagattcgtgcttacacgggtgggaaaataaaatgtgcgtgttaaacgtttaagcgaggagtcgaccgcacgatctcctgttgccgaacaaaggacttttaccaactgagcaggaaccaatattgtttttgagtccaaagaacaaacttatatactacttacaaattaattacagtgtaattactacataattacactataactactgaaattacaatgtaattatactaaaattacagtgtaactttttaatgcatatgttgatgacatttttatttttttattaaacctccttggacttataactgttagattgagtccgttgttacgattaagctagcccgtttccctctgcaacgtgacgcacatccatatgtggaaaaatccgagtgagatgaatgaaaaaatcattcgaatgattgctaggcactcccattaggcctgacgtttcttctagaagaacaaaagaggcgtgcgacccacagaatctgaacacgcagccaaacaagtgcccactgcttgactggctgacgggacatgacgcccaacgccgcgccgccagcaaacactgaaacacactcccacctctctctctctctctctctccctctctctctctctctccctctcgcaccatctccacgaccaaacccaccgccacgccgatataaggacccgtttcgggtactttaaatcaaaggatttatatagaaatttcatagaatttaagtcctataggaaaattttctatttggccctttgattcaaaggattgaagtttttcaaatcctataaaattcctatggaatagcatattgcatgtgaattttggaggaaatttagcatgagctccaacctcatggaaaatttcctttaagtctatctctctcatccgatttctgcgttttttttgcgctccaatcaaacgaccattcctgtatttttcctatgttttgcaatcatctgttttacacttcaattcctgtcagaatcctatatttttcctattcctccgttttttctaccctgcgattcaaaggggcccttagtttacaactttttcccaaaaacatcatatcaaatctttagacacggagcattaaatatagataaaaataaaaactaattgcacagttagggggaaatcgcgagacgaatcttttgagcctaattagtccatgattaggcataagtgctacagtaaccgacatgtgctaatgacggattaattaggctcaaaagattcgtctcgtggtttctaagcgagttatgaaattaatttttttattcgtgtccgaaaaccccttccgacatctagtcaaactaaataggccctaaaaggtgatcataggctcatagccttataggatacataatataagagattttatacggattgaacactttctaggactaagaatcgggtaaagagtttattcagaatcatagtcttgggaagtatcccatccatccttaatatcttaggtagtactccctccgttttttaatagattacgccgttaactttttctcacatgtttgaccattcgccttattcaaaaattttatgcaaatgtataagatataaatcacacttaaagtactatgagtaataaaacaactcataacaaaataaattataattacataatttttttgaataagatgaatggtcaaacatgtgagaaaaagtcaacggcgtcatctattaaaaaacggaggtagtatattttaggacagaggaagtatgtgaaaagaaaagaaaataacttatttaatcaatttatacttctatatactacgacctatttatatttttctctaattatatttaataaaatatttaaaaatatagtataaattgagtcacccatgtaaaaatcatacgcccccgcctctgagtctctgacctcccgcacggccgcaccccgcgcttgacccgtcgcgcgccacgccacgccacgccagccaccgcagcagcagcagcgcgaacgactaaaccccaccggcgccgtacgtacgtcaaacaccaaccatccatccccgtctcctcctccatataatcgcaagccgccgccaccaacgcgagatcgagttagcccggccggctcctcgtctcccttcccgtgtcgcctcgccgcgcgccgccgcccgtgtgtacgtacgttacgttacttcctcgtgccgtgcgttgctgaatactagtatgacggttcgctcggagacgggcggcgcggccaccaccaccaccgtcgtcgtcgccgccgccgtcgacgcgccgcccccgtggcggctgcggaggcagcgctccgtcccggccgccgtcgtcgccaccttcgccccctgcgtcggcatcggcggtcaccacgcgccaagaagagtccttcgcttgggagggaataaggcggcggcggcggcggcggtgcaccaccgccgcggcgaggcggaggaggagggggagtacttcgattccggcggcggcgtgggtgtcctgcgtgcgctgtggaggaggatcgtgagggggaggaggtggaaggtgatgagccggagcgggtcgtcgacggcgaggaggagggagcagtacgcgcaggacgagtacgagcagaacttcgacgagggcgccgccgcggccggcggggagcccgagccggagtacctctcgcgctccttctccgcccgctacgccgccgccggcggcggccggcgatccgccgggctagcgcgctttggcgtttcgcgcgctaattaattattaatcgatgtcgatggtttaaaactgtcgatggcgggtaattcgaacctcgttttgctttgctctcgatatgtaaattaaatttgtggaatgaattatgctgtcctaatccatcgatcgaaatgaagatgaagatgaacagtatggacactgatgatacttttaatattacttttctgcttgaattatgttttgttttcttttttgcctcattctttgatcaaatctacttcatctgtttgactgtttgctctgagcagcagatagtcgaagatagcaagaataatatctctcaattcaaatatccagaagaaaaaaaaaagatcatccattgcaagttctgttcaggcctgatcatatacactttcagataacccatggctatgatcaagagccgtttttatttttccagtgcaacctctcaattcaagcaacgtgttcaacagtgaaaggcatagcgtagacaggtagactaatgccatttctgcctcgattaatcttatattagtctccaccacaacatcaagaaaatctgtgatattagtattttggatggacgaaagtcgtatgtgcttttgactgctgacaaacagcctcatattattgggtgtagttgttcattcagctgaattttcgtacggtcatatctggagttgtcaaatgctcgccagtactacttatccatagttcccaaaagttttttgcattgtggtgaatatataattagtcccggatttggaagaataaccaccagtgattgtaagatgctttgacgtccttgccttaattacctcagaagttgaaaattttttgtttacctcagggttcaggaacacgtgaatcatccttcaacccaaaaaattcttgtcacgataaacagtactatcatagacttgattggttctcttatagtatgagtctactaccagtctaccaccatgtttaaatcgtgagaccggtttacaattattatcaaaatcttgaggaaatgagagttttccgtttactacccctaacatgctaaaccagccgtacgttaccctacctgttttttttttcgtgttacacgaaacagctcccatgaagtccatgatacaaacctgaaaaacaaaggttccatgaagtaggtaatttacttaagaacacccctaaataaatactaaaagaagtgatccagagagataggagactgggaagagagagaaaccaagattatgaattactccatgctctaaaataaataaatcaagtatgtgagatgacctgtctatatccatagtaacagaatatgtcacatgtcatactaggtttgtttatttagtatagggtgagtaattacaaggaacagtataaaacaaaatcagagatcatgaagaacatcagcagtggcttaggaagaacaggaggaacaaaaggccccggtttctgttcaagtgttcagttggatccctggcctctgctgctgcagcagcctaaagacgggagcatctatccatttatcaggtgatttttaataaaaagtcgggtgattttttagatttattttaccctttatttacatccaacggattacaaaagaaaataacaaatacatattaacttacatactatctttaccaaaattacaatgcacttgcatgtaatatcaactgaatatacacatgtaaatttagttatataggaccgtaattttatattttaaaaaaataataaatacatatttacttacacattatttttgtcaaaattacagtgcacttacatattaaatcaactaaatttacaaatgtaattttagttatataggactgtaattttatattttaagtacatatttacttacacattatttttatcaaaattacagtgcacttacatatcaaatcaactaaatttacaaatataattttagttatatatgactgtaattttatattttatagaaaataataagtatatatttacttacacattatttttatcaaaattatagtgcatttacatatcaaatcaactaaatttataaatgtaattttagttatataggactataattttatatttcacgacgacgagagggacggtgtcgctcaccgatcagtgttggccgtgctgtcgacggttggctcaccggtcagaggccacttgtcaccgtgcttctccaatctctatcatcgtgcgcgcttgggctagctggacacaacggccgatgtgcttgtgtccgatgtgccggtcggcagatgagctgaataaaaggtgaaatgttagcaaaaaaaaaatcacgcgagtgatcgatagcaaaatgctcccaaagacaatccgtacaccacggcgtgggccaccaaacagcccggcccatacatggtgtccgttgggctgccagcccatctatgacagctgggcccggctggccggccaacgcggcgtcacccccggacgggccggctagtggtcaaagccggcaactaaccgcgcgtcttcctcgcatcagccgcgtcatttctcacgtttttcccacgtcaaccgacctcgcgtccgcgtcgcacgcacggacacgggctacgcaagctacagtttacactagtagctttcgcctctctagaaggaaaatgacctcacagaattaaattaacttattaactaatggcctcttcttcttcttcttcttctaggttctctgacccctccgaatcaaacgtggcggctgacgaccttccttgtgcaagtcttcctcctcctcttcttctttttccttctcatcggtccttatatatacatcagcacgagctcgccatggcatcatcagcaattcccagttcattcctgcctccgtctccagtagcttgctttgctcgcagattgttccttttttctttttctccggcgactcgagatcgtggctagctagagcctagatggcctcttccatggcgggcgcggcgggggaggagaaggcggcggcgggggcggggcggcgggggatgatcgtgatcgaccggcaggccgtcgaccgggggatcgcctacgcgctcatggtcgtcgcgctcgtcgccacctacgcgctccactagctcgatcaatcggctcagggaggaggaggaggagaagaagaagtcgttccccttcccctaccaacctgcacttcgatcgatcgatgccaaaagtctataactatagaacctgattctttcttattcaattcttctttttagagaaggttaattaattgtgtgtgtgtgtgtgtgagagagagagagagagagagagatcgatggataatttggatatgtacactataccaagtgggttaattaactggatgtactcttctgcatattttggtgttcattggtaacagtttggcattggaatgtctggtaaatcgatgatttacccctttcgcctccaaatacagatttaaatattattttgtactagagaagtagaaatgtagtgatattttcgggagcagttgataatctgaatgctctgccacatcttcacaggttgaacaatcaaattacgtattggctggttatacttgtatcttttcttgagtcgtcgtcattcgtcaacacgctgaatattctttggagtcctctatagatagtagagccgtagaggggcgatgagagatggaaactttcttttgaacgggcaaaaagtctgccatttcatttataggagagagaaaaacacggaccgttcttacaagagggccagagtaaaaagcgaaaacatgatacaataattattaggtaaccgatggcaacaagtatttgcaaacggtggaggatcatctaattaccctcccaaactatcgcagtcatctgaattaccccataaaccattaaaccggacattcttcacccctaattatgcaaaccggacgaattacccccctcgacccaatccacggtagttttggtctacgtggcgtacacgtggcagtccagtcagcgttttttaaattaaaaaattatgagacccacatgccatacacttcttactctctccctattctctctctcactcttttctctcgcacagcgaggacgagcgcggggatgggcggtcggcgaggtgaggcgagcacggtggcgttgacgtcggcgcggaggcagaggcggcgcggacggcggaggagcatggcggcggagctgtgtggcggcggaggagcgaaggtggaggaggagcgtggcggcggagaagcggaggcggcggaggagcggaggcagcggaggaggtggaggcggagtcagttgtggcggaggcagaggcaaggtttgtggtgagagcgtgcagcggcgtggttagcgctttggcacagcaacagggaggaaggcgcgcgcaggtgcatgcatgagcaagaagaggagagaaggaggtggcggaggaaacagcggctgcgacccgccggtgatcgatgcgctgtccatggacggcggcctccgcgaggtgtccctctctgtcgtcttctccgtctggtgcctcctcctcctcctcctcctcctttgctcccagttcctccacagccagaccgacccttcaggtacccacgaacgatccacctcctctcatggatcgatcaatgtcatgtcaccctggcgtttgattgatcgcttctttgtagatttctatgatgacgtcgaggacggaatgcgtgaaaactactgcaaggtaatgccgctggaggcctacattttcccaactgagtataacgcctctgcggccgcgccgacatgccagccatcgttgcaccccccggagccacagcaggaaaccgaccaccggagcctggagccgttcaacaacacaaccggcggcaaatcgtccgcggaggcggcgctcgattagctcgacgagttccagaaccggatcctgcagggcaaggccgagaacggctgcgtccccgacggcgcggcggcccaccggctcgagccaagcggcggggagtacaactacgcggcggcgtccaagggctccaaggtgctcgcccacaaccgggaggccaagggcgccgccaacatcctcggcgccacgctcctccgctaccacacagcttcgctgccacgctcctccaccacctccgctcctcggccgccacacagatccgccaccacgctcctttgccgtccgcgcctcctccacctccgcgccgacgtctgtgccgccgcgctcgcctcaccttgccgaccgcccgtccccgcgctcgtcctcgccgtgcgagagagaaaagagtgagagacataatagggagagagagtaagaagtgtatgacatacggtttctataattttttaattaaaaaaacgctgactggactgccacgtgtacgccacgtagaccaaaaccaccgtggattgggtcgaggggggtaattcatccggtttgtatagttaggggtgaagaatgtccggttttgtggttcagggggtaattcagacgatcaggcggtaattcgcactttttccttaagataaagataaagataaagattaagtgtttcacataaaacgatgtgttaataatgtgtgattaattgagttttaattattacaaacttaaaaaatggattaatctgatattttagaacaactttcatatataaagttttcacacgaaacgcaccatttagccgtttaaaaagcgtgccattttaatccaaagtttatcctccattttcattagaaacgaacggggccactggacctcctccctgccttgcacattgccatgatggaatggaatccgccacctgattcgccgtgctgtatgctccattgaaaattttatcagtccgctgtaaccaaatgcctcaggtcgtgtatatgattattccgtcgaaaatctttttttttttctcctttgccatctcctttcggcaagttcacaaccatgaaggctggaaacatttatctgtctcacattttcaaaaccatgaaggataatggacatgaagtcacttgatgcataaacttagacaataatgttccttcattagaagagtctcacatttttacgcggatagatacaatgatgatctttaggcaatgatgaatccagaaaattgatttgttggtgttataacgtgtttattggtgtcatagtatgttaattatgcttagatcatggtggtataatatatggataaacagttttcctataaattttgcaaaaagtcatcggtgccgtttgacactggtcattacactacactgtagatccgcccttgtctttaggccacgtttgtttcccattaagatacaaagtttgcattagtttccgttaacactttcggaatcttgctatttaagagtattaaacataaattactgacaaaatccatttcataacccctaggctattttgcgagacgaatctaacgagatatattaatccatgatttgctacagtgatgctacagtaatcagccgctaattatggattaatatacatcattagatttatctcgcaaaatagcctaggggttatggaatcggttttgtcggtaatctacgtttaataatcctaaatagcaagatttcagagggcgatttaatagcccggaggatcaaacaaggccaatgtattttgtacaaaattttttttgtgtagaagttgttttaaaatatattagataaacccacattttagtttaaaataattaaaatttaattacatgacttctttcgctttacatgcccgtatttaatcctcatcttcatcactaccaaaagaagcctctcccttcgttctcaaatactgacacgctgttaacaacatatctgtaactttgcgttgttttttccagattatttactggattatcggcacatgtttatttgctctatactttgaaaatatgctttttgaaaaaaaaaactttcttctactacattttttagatcagcagttctaagatatttaaagtcttttctttaaaaaaatatttgatttaaccatctaactaattaagtagataacatgcaacgataatttatttaataatctaaatcaaacatggccctgaaatttgtacgattatactatgaccctacacatttcctttaaaaaaagagcacccataatgactaatcatagactaattagacttgaaagattcgtctcatgatttttatgcaaaccgcataattagagcaggtacaatagcaggctataagccagctgcaaacttattttaaggagataaataagaagagagaagagcagcgggctacagatttgtagccagctgtagcacggactccaagatgcagtgtgtgtatgataagtggtactaggtattaataatgtagtatgtacttattgtatgaatgagctattagattggttatagatgaattgtagctactagttggctatactattaaacttgttggtattttttttatctatatttaatattctattccaaaatttttccggaaccacagggccgaagtcaacagacccccaaatccccaatccacatgccatcttacatccgggacccgttaacccgtttgcccaccaccgtcctcctcctccgacccttctcccccatctcgcgccctcctccttcccggcgccgcgtcctactccccctccccgcaggcgacaccgcgagagccgagaaaacgaggcctcgcgccgccgcctctctccactccggcgcccctccacccacgacggcctcacagcccacctctaccgccgcgtccccgccgtagccggccgtcgcgggcgccacaatggtacgtgcccccccccaacccccccgcggctctctctcgctctcgccttcccccaggctcgcgctgtttaggtttcgccgcgaatgggggatcggtgtggcgaggcgaaccgttcgacggccgcgcctcgccgcgccgtgccgagatccggtggctggagcgtcgaattccgcgtggatctggggttttttgtttgttgcgtactgacgtgattgcattctcgctcgtgttctcctgtgattttttttctctggcggcgaactggcgatggctgtgaatgttggcagccgctcaggttggatatcaaggtaaccaccgcgcgtctccctcggatccgcttagcttagtttggtttgtttagctgatagtgatcgtctgtttgatggttggatcagaggaagctcgcgcagaggtcggagagggtcaagtccgtggatctgcatccgaccgagccatggtgagtgggcaagtttgtgtgggtgacatggttttgggttttgggggtgctagggatgtaatgattgtgttgttcaaagtcacatgaataacttcctccggtgtaatgccaggattttgtcgagtctgtattcagggagcgtctgcatctggaactaccagacgcaggtacgtgactgttcacagtagcttaattcgtcattttctgtctagtttcatgaattttatgagatgatgattatctactaccagcacgatgagcttttgtactgcaaaatggatattcccatccatatgtaaaattcaagttacatttggatttagtgtgcttgtagtagtgaactttgatggtatgcagtgatagtaagttgttccggagaaaaaagggggggggggtaagcatagtgatgaatgaatgaattcttaaaacctagcgaggaattcttcaatgcattgtagaaaggatatggtcaaaacagaagtaacaaggagtcaatgaacttctagatgattgtttcagatgttcgagtgttagctacataattgtgacttctaaaaaggtttgcaaactgtatagagtaataaaacaggaggaggaggtaaaacataaaagtaaaatctagtattttcagtatagtgaaatcgatagaaggaaaaagaaacatacatattttcagtatagttactcttactgttaaactgattataatatattcatctatccccagacgatggtgaaatcatttgaagtcacagagttaccaggtatgctttcccacgtcatcgcttacttctgttccttgatataccatcttgctaatataatcatccccatttcagttcggtcatctaaatttatcgcacggaaacaatggatagttgctggtgccgatgatatgttcatacgtgtgtacaattacaatacgatggataaggtcaaggtttttgaagctcatacggattacatcaggtgtgtggctgttcacccaacccagccttttgtgctgtcatcatctgatgacatgctgatcaagctttgggattgggataagggttggatgtgcactcaaatcttcgaggggcattctcactatgttatgcaagtcacatttaacccgaaagataccaatacttttgctagtgcttcccttgatcgcacagtaaaggtttgtgattttg

SEQ ID NO: 73620 - DNA, 8139 bp, Oryza sativa
tgtggatgacaggtggggccggggatcggcggggcccgggtagctgtgagacacgtggtggtcgtgaggtccgagccgcgtgttgctcatcttgctggcttgccagttgctgcggcctgcgggagcgggtgggccccacgggtaagccgctgggtggacaccggagctgaggcttgcacaagccacaagatacttgtctgatgacaaacctcatcttaacattattttattatttcctgtatttttaaacttaacatacgtttttctagtataataaatctggacttactattcttatatatattcattgtccttaaaaacatctcatctagattggtttttttgatggagggagtagtaaaaaatagatgtgactggataaagaaagattatgatttacttcctccgtctcattttaagcgtaccgatgagtttttttttccaactttaatcgtccgtcttatttgaatttttatatgactagtatttttattgttattagatgataaaacatgaatttagttttttaaaaaaacaaataaaatggataattaaaatcggacacgaaaatgcacggttacacttaaaatgggacggaggaaatactaagaagagaaaataggtggaggagaatggttgtgattggctgagaggatagggtaggtaaatatatagttttatttttggataagtagtgtgttgagaatagctatgttttaagacggggtagtactgcttagcttggtaagagtattttgatagtagtaaactagtaatctgttatgttaagcaggggacacgatcttttgattcgaatattttcatactagcttgatagagtattaattttaatacacagagttcgttgggtagatgctttgtgctgttgacttggttacaatgttgcgacgatatttccattatatgatttttatatgagcttgtgaatgtgacagatattgacaacaaaaatatactagtagtatactagtatcccattggacacattcttattgtaaccaattgttttcaactgaagattcatccacttcactaattaaaagggcattcgatgaatgtgattaggtcagcacagcatgagccggtgatccgaagtaagggattaatggatatttttacacacaattttcatgataatgtcgtgactttatcgtatctagtaattctgtaattacttggaattattcatttgttcaatttcatatataattagaggataattggatcatgcaattacaaatatgcatattcaaataaatatcattacaatttgtttacttatagtcgtgacactgaaattttacaaaattaggattgtaccactatcgccacgttttacatcttcttcctcatctgcacgtgggacccacccattagattcatcttcttcctccatcccccctcttctttttttccatctctctccaccacctcccgtcgtccatcctcctctctgtcgctcactcctcctcccccggcacagcggccacccccaccatcgcctctagtgccacacccgctgcctggtcaggttgggtaaggatggctggcccatcgacgtcgtggttggcatcctcctcatcgtcgctcccggtcatcgtgtcccatctgcccggcactgcggccacccctgccgccgcctccaagcctagttgtcgcgtcgcgccgagccacctagcccacgtcgcacccactctggtgacagtgtcggagtggacgaatgggaagaagataggaagagagaaggaagaagacggataaggaagaaaatggatggacaacgtgacgatagtagcacggtcctaattttgtaacatttaagtggcacggatacaaataaataaattataattgcgtttatctaaatagacacatttataatgatatggatccaattagtttacaacatctcttcctcgctaagagtaaaaaaaagatgcaacatgtctggtgaagaattgatagtgacgatgttgatgcctaccattttagatgcaatccccctaccaaataaaattgagcaagagatgctaccgattttgatattggttctttatgagaaaattccttgacgtcattttctgcatctcacatcaagaagctctttagtcatcctgtcactttttttttcactttcagaggcagaaaaacaatgcaagtaaactttctcattgggctagtttcaagtgattaatgtgaactgcatctcagaaactataaaatatgatgatcataatatgacgtgttgcgcacttgtgctcttatgctcatgcatgccgtcattttgtagtaacgagaggcaaattaaatgtagaagatagggtatgattttggtgtcgattactgaaaagatagctaataattgaaatttttaggtgagagcatatgagaagatggtgattatctaaaagcactgcagcctgcagggtaaataaatctgatggtagatgacatatagaatgattggccaacagcaagattcttggcacaacagtgaataacccactgatagtcatattacttctgagccagatcacatctaactgtggccaatcagcatcagtaataacttgcagctattgttgactctctggttgtctgaatactcctatggtaatagtaagggcctgtttaatactgctccaacttctaaatttagcttcaggagttgggtctggagtagagttgtggagctggttcattttatgagagagctccacccagctccactcctaattttggtggagctggaactgtttggctgagctccagctctagaaggggtggagctggagctgtgccaaacaggccctaagtaatataattgatttattgcggagttcctatgctaatatgtaactatgcaaaatttacatatactgtcaagaaagcatgcaaattgttaactaaaatcagtactaagatgcaaacagttaattaattaagaagtgtccaagatgcaaggagatgcatgttgttctccgaacaaacaacagaactgtgtattactcatttgttaaagaccattccatcctgtgttgcttgttctctgaattaattaacaaaagtgcagtactcgtgtaagtactaaacctgcacattagcagatatgtttagctagattgctaacacttggcagcagacatacagttggagtctgaaactctgaatcttcagtacacatacgtatgcagatccatgtcgtattctcagagttctcgttaagaagtcaatcccgtagagacccaaacgatcggttgatcacttgatcttttcttgcccaaagaacaacttgctgagacaatgacgtctgtgtagactgtagtaatgtgtcgctctaatgtacaaactggagttcgttggtcgagcaacggcagataaggtcttgaataactagacaaaactataacatcccccatatatatatatatatatatatattatatgtataataaaaaattttagtgaggacgctcatgatcttattaatattgctagtagtgaagagtcgagtctccgtcgtcccaatgcttgatccgccctaagtccaagagactgaactgttgattgatctcttgtgacagtaacactcccccgtgcatggattagtgtgtgtaacggtgtgtataatctttgaaagggacatcagtgcaaattaatcggatccgggagtaagcatctgaacttttctcactttgcaagagaagagaacacacctagctagctaggcatacgtattgcatttgcagattcagaatatcaaattgccattcagtgctagttgctcctagtaacaactaacaaaccgcggcgagatgacttttgctctatcgcttggctaactttacatgagcagcttgtgtaattagttgggctgttactttatagtgaagttctacgtatggaattatgccattacctctgttttttaaatatacggcagtgttaacttttagacattatgtatttatgtttgccgatttgttttgttattaaaaactatgtaagtgtcaattattttacttgtttttataattaaagacattttaagccgtacatattatttttgcatacctacgctaaacttttaaataaaacgaatggtgcggagagagttttttttttctcatgtcccagcaagtatataccatcggtcgctgccggcagcgtgcaccggccatcgcagaaaacgtaatcgggccgccagtgggtctagggattctagactattcataaattgtgactaacacttgagtcatattcttgaccaaacacacatattttagacccttcaattcttggagattttgttatccacatacgcatttttgaagttaattttccaaaggctgacatttgaacaaagatgtgaagcgggccttctttgggctaaatcctctgcccaatgtgcaatgtgtttgtgtcggtttagaggcccaaattgaatatatttcgtcaatcagctcagaccatcacaaaacggctagtgcaaattttcagaaaaaagcttaacataattttcccatgcgtttattcttgcaaagttcttactactaattagtatttgtaatttttctttgtgtagttttgtagatgttgggtatcaaaagttaagttgatctgatgatatgtgcgaaagtaagtacattgtttgcttgcttgcttatttgacatagctccagctccatgaaaaccttttagcgaagctagttgaaatggttttacaaaatatactagagaggtactacctccgtttcacaatgtaagcctttctagtattgtccacattcatatagatgctaatgaatctagacatttgatccacattcatatagagctaatgaatttagacattgtcatatataaagaatcattagcatctatatgaatgtgggccatgctagaaagtcttacattgtgaaacggagggagtagccattaagacaataagcaaactcaacggtaaggttgctttattcatatcaccttgccctcatggggaaaagttcaaatatcaatcatcttggacaaatgccgtccaaattcaaaatttattcgtactaatttttgtgttatctaaatgattaaatcttacgaggcttaatttgatactacttaatttccttcagttgatcaccaagcatttttgcatgaatcactcgtgcacttcttccttggtgatcttcttcgtcgccggtggcacatcgctgccgtggaacggcggcagtggcggccactggttgccggggtgcggccatgccggcatcggcggagggtggaacgggaacggcggcagtggcggccactggtttcccgggtgcggccatgccggcgtcggcggcgggtgggacgggaacggcggcagcggcggccacttgttgcctggttgcggccatgccggcgtcggcggcgggtgagacgggaacggcggcagcggcggccacttgttgccaccaggatgcggccatgccggcgtcggaggcgggtggaacggcggtagcggcggccatttgttccccgggtgcggccattccggcgtcggcggctggttgaacggcggcagaggtggccactggttgtttccaggacgcggccacgccgggttctcgccgccgccgtggtgggggctcgccgcctccggcgccggcggcgcatcaggggtgtacgactcgggcggcggcgccggcggcgaaagctccggctgatccggtggagcgtggcggccgtggtgcttggacttcggcggcgccttctcgtggtgcttcttgggcggtggcgccctctcctcgtccttgtgcttgctcttcttgacatggccgctgccgctctcctccttcaacggcggcggcgcctcgccgacggcgacggcgtgcaccggcgcaaccgcagtaggcggctcgaccaccgccggctcgatcaatggcggcaacgcgccgaacgaccacaccggcgccggcgccgcggcttggccgccggtgaccaggagcgagcgcgacgtggcgtcgacgcggcatgccgagagcgacgcgatggcgaggaccacgacgaggtacgacatcttgatggcaacttctacacgagtagaagttgttgttcttgatgccatattggattagttaattagcttcttgatgtgtttctgcttaaatggtttgcttgagctttatataggacttgaaacttgagtggtttttggttggtgagggtgaaaaatttagtcaaactttgtagaaactgcgactgggtttaattagtttggtaacaccacattcttgtagtggcttctttttgtctgttgaattcagaattacaggtgcatgagggagtagtagtaatgggttgttggtgtgtccatgaatgtgacatgcattagtgagggtttaggcaggagtcatttcttcatttgctcatggtggatctcctgtatctcttttttactggtatgtgttgcttattaattagccacattttttttctggtcatgaatggtacttcctccgtttcacaatgtaagttattctagtatttcccacattcacattcatatgtctagatttattaacatcaatatgaacgtgggaaatgctagaatgacttacattgtaaaacggaggaagtattagttctcaccatcacagttagtgcgttggtatggcttcctcacatgtggttgtcttgctaggtattactacgtactatttcctccgtttcacaatgtaagctattttaatatttctcacattcatatttatatcattaacatcaatatgaatgtggaaaatgctgtgaaacggagggagtagtatggaagagaattcccaactccccaagagaccaaacttgggctttaagacttgcatgcaccacattgtttcatttgtttcttgtatgcattaagaacgaaatagctagtggtcaaccttacggcatgctatcatcatttgtcactatgcttgggtagcaacatagggcggacgatgacgaggacgaggggtcagcaagtgacactaaaggggcgattttgacaatttgctactcttttgattgccattgccatcttatagagcatcactatacacattgattgccattgccattgcaccggtctcaagggaaacacattatggctccaaaggaacaagattatcttaattagtacctcttgtaaaaaaccacacattatagatgctcttataactgtgacacgtgatgacacttcgaatcagtaacatgtggatcaggttaggcaaatcatcaaatcaccaatctaatggttaaacccttttagctaagttttaaaatgtattccttttctaagctcctggtctgagtgtggaagattcgcgagagtggaaacacacaagacacgggcgatgtatacaggttcgggccgctgagaagcgtaataccctactcctgtgttttggtggatctgtgtatgaagaagctacaaagtgcgagccagcccccgatcgttccgggatcgttctctcctcctctttttttctctaagtgggcaaggtcctccttttatatctcaaggggataccacatgcaccatctctctctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagcaaacacgccggctccggctagggacgagtgcttggaggctctcgtcctgacgggatggggcgaggcgtgcgtcagaccgcctgtcgccacctagcccacgatctgaccggtctgtgactgatcacagaccggatgaacgagcgcgctgcactgcgttacatgcggcgtgacgcgctcgtccaaaccgcaataaatgcggttagggtgagcgc

SEQ ID NO: 73621 - DNA, 4628 bp, Oryza sativa
cgaccccccctcccccccccgagggggttaggccacgtgggtgatcgtgtctgcctcaagtctctaagtcatgatactcccggtcccatgtcaccgacagctccaaaggaaaaagattatcttaattagtacctcttgtaaaaaaccacgcattgtagatgctcttataactgtgacacgtgaggacacttcgaatcagtaacatgtggatcaggttaggcaaatcatcaaatcaccaatctaatggttaaacccttttagctaagttttaaaatgtattccttttctataagagcaggtatagtagggtacaatcagcaggcggtagaactgttcatctaagagtaaagcctacatggaagagtgagaaaacatgagagagagagagaagccggcccttaatctatcgttgggctacagccattaaaaaaacagcatgaccaatcggtcatccatgcatgctgcagctgcaagctttttccaccacttaaacgcttcccaatggcctcaatgagagagaatagagattgtgagagaataatttttgctgagttggactttttatagcccgttgctggctatactattaaacctgctctaaccgttagagagactaaggatcgtgtcataatgattctatatcgatgcctctaccttaaaaaattatgaatttcactagactgatatttatttagtggctgttagagcctatgtgtttgagagaagtaaaaaggagaagatacatgaaacgagaagagcaactagtacatctattaattattttaaatttaaaatatagattaatataattttccaaactaacctttctatagattttttttttttacaaaaacacatcatcacttagtagttgggtaaatgtgctcgtagagaatgagtgaatttatctcccaatcagtatatgtggaacgcatggagtactccgtaacatttccgttataatgttagtggataaaattataaaaaaaagtaataattataactctgttacaaccatgacattcccaacacgttgggcccatataacaacatacatacgcgcgcactcttttttcttaaaaaaaacaagccagacattggattttctattcgacttatactaacaaaaactcttgaaggaaaaacgtacttggtaaataaaacataatctacgaatccggatcataatctacgtatgagactgagagggacacgagtgatttgacgggtaggtttctatatccttaattagtacggagtatgttcttattattctaattaattttgattttcctacataataatactgcatagagagagagagagagagatacaggtggccccggcacacagttcatttgcaacgcaacggctgtttcatcttctgacgagatcacatccatgcaaacgcaagcaattaattaatcccctaatcccccaaatcctcatctccaaatccctcctcgtctcgtcctccaccgtaataatctctgaccaaatcgccaaatcatccgcccagaaagccgccgatcgatctcgtcggagagggcgcgcgaccaatctcgaccgatcgatcgatgatgcctccgaagccggctgcggaggacgtcgccgacgagcagccggagccgccggacgaggaccccgacgtcgccgaggccgaccccaccggccgctaccttcgggtccgtgcgagcgttcttccatgttttgattttttttttattttttggcgaggtttatgctggattagtttagtttgttcttctgatttggctgattgatttcgcgcgtaatgacagtacagggagatcatcggatcaggatcctccaagacagtgtaatgcttccaatctctccctctcctcgattgttacacttctcggttaattatttcagaaccatgcgtacggaaaacattggtaacatgtagaataaaacacaccctaaatatcttagaaaatgattttagattgtttgggacgaacggatcatgaaatttctgcattgcaaatagggcctaataagatgattgccttttcaccggatatgaacaagaaagcattgtaaccgttttttataattagaagaaagcaaggtttcaattacacaacgcaaccagtcgaactgccattgccaggggagctaaagggagaaaaaaaccgaaaactgaaaaaaccgaagtacattgcaacagtgttcattgacatgatatactatgttggtaattatatgtgatatgcagctacaaggcatttgatgcggtggatggcatcgaggtggcatggggcaaggtggagataaacgagagaatcatgggttcatccaaggaattgcagcggcttcgcacggagatccagctgctgaaatcgctgcagcacaagcacatcctcaagctctacgcatcctgggtcgacactaacagaaggacggttaacattgtcactgagctgttcacatctggtaatttgagagagtatgtatttatatgccacacctgccattcctctctcattcttgctacaacactattctatttcttttttcttatttttttaaagcgggggttttaatttattttccgtttatgagtaggttttattggttctacattcatatccaccttctttggaacaatggtataaaactactccatctgttctaaaatttagggcatccttattgttagtaaaaatcaacctttggtacttttgataaataattatgctaataatatatatgcttaatgtcatgtatatcatatcgttagatctatattttaaaatactttcatatgatgctgattttatagttattataacatattatgaaagaaattagtggtcaaagtgtaaaaacttataggccttaaaatttaggatagagagagtagagtacatcagataagcaaaaaaaagttcaattgtgttttatgattagggctttgttttcatgcatcaccgatcgtttgggcttttatttagaagaaaatgaatacagcataataaaattaattggctatttggcttaacgttacatatttcttttgttttcactccactagatgaatgcataatttgcccattcaatatttgaaatatctttgacactatggctgtgtttagatccaaagtttgtatccaaacttcagtcattttctatcacatcaacctgtcatacacacacaacttttcagtcacatcatctccaatttcaactaatcatctccaatttcaactaaaatccaaactttgcgctgaactaaacacagcctatgatatgactaggtaccgtacaaagcacaaaaaggttgacatgaaagcaatgagacgatgggcaaagcaaatactgacagggttggaatatctacacagtcagaagccaccaatcatacatagggacttgaagtgtgacaacattttcattaacgggaaccatgggaaagtgaagattggagactttggtttagcaatggtgatgcagcaaaggaaaacacggagtatacaaggtcggtgaactgctccacaaaggccacaataattacaagtaaattaattacaaggactggagacggctgtcttctatgctttcttgaattttcttctttatcttcaagtaaaacatgaatcgacaattactcttgttaaatacaggcaccatagaattcatggcaccagagctttttggtgaaaattacaatgagctggtcgatatatattcttttggaatgtgcatgctggagatggtgacttgtgaatgcccatacagtgaatgcaagggctttattcagatatacaagaagattactgaagtaagtggccttctatatacagcattcatacatatacctacttctacgattctggtagctaaacatataactcttctacatcaatattcatggcgctgtaactcttcaaggtgtaaagccagctgctctctccaaagtcaaagacgcagaagtgagaggcttcattgagagctgtctagcttcagtatctgacaggttgcctgcaagtgagctcttgaagagcccttttcttcagagtgatgatgccaatcacagaagctccaattcagttcaagaaccagtaaaattccctgaaaacaattttactaaagatgaaccaatttttgtctctctggcgccgaataatgggacagtcaatgggaaggagcaatctttcatcttggtgcttcagaagagtgattttttgttggaagggaacatgagcaccaccaaccctgtcatgctgtttctgcgattccctggtcctgatggtaaaataataagcatcaaaatgacatcttagcctcttaggatttgaatgcaacttagtttctgtcttttcgaacaacaaaactgacttaaatttataatttctttttgcaggtaagttcaagaatgttcagttcccctttgacatggagaaagataccagcctgtcggtgtccactgaaatggttgagcagcttgagctgcctgaatggaacaaccctgtcttggccgagttgatagacgccttcttactacacattttgcccagttggaaaccctgtgttaaagttggaaagatgttgccaagttcttcctagggagtgagttgtccagttttccccatttcggt

SEQ ID NO: 73622 - DNA, 24858 bp, Oryza sativa
gtcaaggcaaatcccccgatactgactgctcccctatgtgctcgacgactgtttggcactcgaattctgacaattctggctgctgtttgcttcaccaggtggcgctgcgagcggcggaggtggtgtccaagatcggcgcgtttgggctgaaggtgttcctggacgagcagagggggcagtcgtcgtcggcggtgcggcgcgcgagggcggtggagctgcggaccatactcaccaggctcggcccgacgttcgtcaagattgggcaggggctgtccacgcggcccgacctctgcccacccgagtacctcgaggagctctccgagctgcaggtggccgatcttgcttgcccttctctcgttcgaagcatactcgtctgattcaaacttagtagtaaggcattcaattctattccagcatttggccaatgtggcatgctcatgttcaaagatggagtgtccctgcaatttcttgcctgtttagtggacagtaattcgttcaagaacgtttcacctatagattcttgccactagtagtgtagtgcttattgttttgaagtaaatgacgtcagcttgagcttaccatttaagatgtgtcctgataactgggggatagcttccatttttggtttatgttatatctccaattggtttacatgtaaactgtcttgcaggattcgcttcccacgtttccggatgaagaggcatttgcatgtatcgagagggagcttggctttcctcttgattcaatctactcaacaatatcaccttccccaattgctgctgcaagtttaggtcaagtttataaggcacggttaaaatactctgggcaactggtagctgtcaaggtgcaaaggcctggtattgaggatattatagggcttgatttttatctactgaggggccttggatatctaataaataaatatgtcgactttatatccagtgatgttgttgctctcatggatgaatttgctcgaagagtttaccaagagcttaattatgtccaggtacaattttattgttcttttgaacctttttgcacataatctgatcaatatctgcagtatacatgtatgccactacttttcctactgatggatgttacactgtacctgtgaataacagggtttgtactttcagcatgagttctatggggcattgaaattccgaaatttcgtaacattttttttgaacgaatcggcacttagagtgcgccaatttcattgaataaagcaggaggaaaactgtacaaaagggaaaattaaggtaaaatctgtgccaggcgtttagcttctgctaggacccaagtctggaacactctctggttcctctctttccatatttcccaagtcattagaagtagttgggtgtgaactcccttcctaggcgtaccagcgcatgttgctagcgctgtccaccaagaatggattgaagtagcggggtaccatttcgtaacattttaaattcaaacaagaaagatatcaaacttacattgcaaactcttccagtgaatgcttcactgaattagcttacacgctcagttgcttaatctgtagaatttttgtttttttgaacgggatagctggagagctgcttattttaattaagaggaaaggaaataatataaagtttttacagaggtgttgtacaaagtaccagagctttgtagaattatttcctgttggttcatctacttgatggtagtgaaaactttgaatgcaggaaggccaaaatgcaagaaggtttaagaagttatatgctgacaagcaagatgtgctggtccctgatatattttgggactacacaagtgcaaaggttctgacaatggagtggattgagggtgtaaagttaaaccagcaagcagctattgaaaaacaaggtttgaaggttctggatttggtgaacattggtattcagtgcagcttaaggcaactattggagtacggttactttcatgctgatcctcatcctggtaacatattggcaacacctgaagggaagcttgcctttcttgattttggtatgatgagtgagaccccagaggatgcaagagtagccatcataggccatgttgttcacatggtcaatagggactatgaagcgatggctcgtgattattatgctctcgattttttggaacctgatgtagatgtctccccaattgtccctgctcttaagagtttctttgatgatgctctgaactcaacagtaagtgagctaaacttcaaaaccatagttgatggcttaggcgctgttctctaccagtacccatttaatggtatgttttcctgttgtcagatgctagttctcacttgtatgctaattctgctcatgtaatgatacaacttgtctatttattcttaactagtaccggcatactacgcattgatactgcgatcgctcactgtactggaaggtttagcactctatgctgatcccaattttaaggtgctcgctgcctcgtacccttactttgcgaaaaggctactcactgatcccaatccatatctcagagatgctttaattgagctactattcaaggatggaaaattcaggcaagtttatgtcctcatgaagtagttaatgaggagttttgactactcttgtcagtaattgcatcttgtactgattattctactgctatttaaccctagtattgcttctatacagatggaataggcttgaaaatcttcttgttcaagggagccaagatagagagtttgcagcaaaagatgctttgcaaccagttctaaagcttctacttggtcctgatggggaggaattgcgagtcctagttgtgaaagaagcggttcgtgtcacagaagccatcacttttggaacgctgattgattcgtataatgcagctccagaatttcttaaaccattaatatccagtggtaatccagccggaccgttcaagataagcgacactgaaagggaacaaatgattgagctgcgggacagggttttcagaatatggggccttctgagatcctcggatggctttgacccaaccatcttgcaaccaattgtgcaggtatacttcagcttcatttctcagtacgtgtgaatgtgtgattcaacctctatgaagaaatattttagctgataccatggagcaattttgatattcattcaggtgctacaagagccagaggcccgcgttcttggctcccgggttgcaggaggtgttacgcagcgcctcgcggcccgcctgttgcagcagctgctgagaactccacctgctccaggatctccttagcagataagacatgtaaattcacacggtactttccacaggaaagagaaaaggaaatgtaattcggaaatcaagtataaagttgatttcttcattcatgccggataaaaagatcccctagatgtttgtagattgttctcaaagcctggaaaattttgggtctacgaaaatcagaaactcttctccactgaagccactagggtttgccaaaccgagttgggaacccactcacttctttttccgcgcgcacgcttttcaaacggttaagcggtgtattttttgaaaaaaaattctatatgaaagtggcttaaaaaattatattgatctatttttcaaaaaaatagctaatacttaattaattatgtgttaataggccgctccgttttttgtgtaggagggacaagttctcagcaatagaagattaatagtaaaccacttcaatggtatgtctacatgggtatctatagctctctaatccattttctcgtttttctcattagactatctccaggttagtagatagctttgctctctttctcttcatttaatctcttccaagtaggaaaatatgctgacatggatcttttgtagagaggctataaataaccgggtgccctaaacgtgtttctcactctcctgcatagaatcaacgtgattctttctctgctgcactgctgtccattcactaaaagagctgcagcttgtgtacaggtgtttagtagaagagtaaatttcagaaaactgcaacttaatacagtttttttgaaatttgctcttagtagtatttcgtgttatcgcatttgtatgcatttacaggtacatgcctcagattagctaacgcccttctatgatgaggaaaggtaattttcggcctctgaatctacagaaaaacagcgattaatctctcaaaagaagagtatgtaaacgacagcacgttccaacttccaagctcatttctgacgcaagctctgagcaaaataagaaccggcgaaagcaacattgttgggctggtcgcccatcgtttctgaacacctcgcgatacaactgcacgaggcacaccagttttctcttccgtctttccgacggcgcctccatactccataggctgctgcctgctgctgatctgaattctgtctgatgcaccgcacccaccctcccgcagcggcattatctgaatctgagtagtcaagctgctcaactgaaaagtggaagcagccaaagcaggataagatttctgagagcaagtttaatagtgtagtccactacaggctccaaatcatttataaccaatgtaatagtcaattcatacaatagttgtttactataccattaatatttggtcccacctgtcatacacacgttatgtcttggagtccgtgttgcagctggctacagatctgtagcccgctgctcttctctctcttcttttatctctttaaaatatgtttatagctggcttaggcctcctttaatggttgagctagtgcactagctcatgcttgtccacctcatacaagagatagcaaaaagtctacctctccaatagattatctcatagcatattgtttaaaatgctttgggtttcacaattcctctcacattttctttaggagcttagctcttgaagaagatatagtgcattctctctccttatcttctctctcttccacatcatataaaagctgatatggagatttataagctagctgactcatccttgttggaggagcccttatagcctgctattgtacctgctatgattaatactagtactgtcacttacctctccgttaaaagggacagatataggttggtattttttttcttgacggaggaagtactcgaatctcaaatctcagttaggcccgggtaattctgctatagaaaagaaacaattaacaaaatgctgagatgaatgaatgttcaggcgaaaattaatccacaatgttctcgcaaaagaaatataattaattcacaatgtaataggacggacacgtcatgacagaagaagcatctgttgaagcgttcacgagacagatgccgcataaacaagtgagacatgccacccacgcgtccatctaatctaatctaaccaccctgcacgaatcgcgacgcacccccctgcgaagcattccgttccaagcgggcaagcgctatatatcgccgcggcgtcatctcgacaaggcacctgccactcgcccactcctcctcctcccccatcctccagtgctacggtgtcacgcagccatggcgctccgcacgctggcctcgaggaaaaccctagccgccgcggcgctgccgctggctgcggcggcggcggcgaggggtgtgacgaccgtcgcgctcccggacctcccctacgactacggcgcgctggagccggccatctccggggagatcatgcgcctgcaccaccagaagcaccacgccacctacgtcgccaactacaacaaggccctcgagcagctcgacgccgccgtcgccaagggcgacgcccccgccatcgtgcacctccagagcgccatcaagttcaacggcggaggtgaggccaagtcccgccccccttaccccttcctcgcatacggctttctttctttctttttcttcgtcctgttcatcgcgggcgatgcgggcggcgggggatctgaggaattgggtggggtatttgtgtgctattgtggctgatctggattggtctggacgggagaggcagtgtgctcccccaaatggagaatcggattgggttgggggttttaggatcctcccatttctaggggtttaggtggttctggttttattatcggccgcgaatttaggtttaatactgtgttgtagtggtctggtacatacactattttttaaaacagttgagacatgtgttaactgcgtgggtgttttgagtataaaatttgaacaattttggtgcttgttatccacagttaggcgttagctgtcttgattgtcatttggttcaggtagtgattagttggtgtgcctttgattcctgcaaaatttgagctgttttatattaatttcctgtgtttgagaggggctcagtctaactggtcaggtagcgatccattgttgtaattttgctatccagtgcttctctaatttgatcaggcagttggatgaatgggtgatctgttaagcttcatttctaggtgaaagttctgtatgcggtaatgtactttgggctcgaatttgaacaattttgatgcatgttctctgcacttagctatcctgattgtcagttggttgtgcttttaaggatttgttcgcctaagataggatttgagtagattcagcattgggttcttgggcttgtgccatagtttattttaatctagctttcaacttttgaaggccctctttgttttatgttctagacatatctagtgtttgatggggtgtattgtcatcgcagaagttcgaactgcattgaattttgtgcttgtacaccctttaatttaaagggtatgttatgttatctcccatctcaatgccagaaattttcctgtctcctgtaaaaatttgagttgttttatgttaatttcctgtctttgagatgaactcagtctgattggtcagttagtgatccattattgtaattttgagatccatcgcttctttaatttgatcatgcacttggagaatggttgatgtattaagcttcatttctatatgaccagatgcgtttctactaaattagacagcaccatgatgcatccatgagctgctgatttattgagctcaggttgagctgcctttgagttggttccacagttgccaatttctctaataaaaatatatagagacaaattagtggtccccttttactatctcttcagaaaattttatttaactttgaagaaatagtttggtagtttcacttatattcatatgttggatgataatatacatgataaattggcgtaaggttcacaatttcacattacaccaaactatcagggtgtgtttggataatgggaaatggggagtgggattaggattgggaaatcaatgaagggttaggattaaatggaactggaagaatgaatggttaggatttaaagatgcatttttgtgggtgggaaatcatttccctatcccattagccaaacactccgtcaaagggaacagcaggtggtatggtagtaaagaggtatcctcaggacagggctacgttgttccagctgggacccaagctgccgcccactcccaacgctcctgtaggatggagctgctgtgtttgtgttattgtgtgagcgcggaattgaagagactagtgttcctttcttctagagcctccaaaaaatcaggatgggtgtgacttttgccagctcttagctaaattcttgcacttggatagacaccactgcaagaggaaccaaagccaaatcttccgagcatagacacaagaaataagcaaatggtcggcacacccctcctgaccatgaagcagaaggcttagtgggtgtccattcactgccggagcatctcatctgttgtctagattcattgatttgcaataaaaaaaatttctagagtaatttattgcgatttcgttgctctcagatatctactctattcgttacaacaaagatattttcagtaatgcctttgtattaactgtgctgcaagccatgtcaatcattcgatctctgggattaacctcaagcctatcagcgtaattatccagtccatacaacttgctccatttctttcttcctccacttactttttttctactggatctccaatcaccgaattaatgaaaatattgggtgttttacaggagggtggtggtgatccaccacatgcaaaacttggctgggccattgatgaggattttggttcatttgaggcacttgtaaagaagatgagtgcagaaggtgctgctttacaaggatctggatgggtggtatgtacaccatgcattgctttatccattgatgtgtcatcctgttcagtctgaagaaatgtattgttcatttattatatttattttctcgtacagtggctagctttggataaagaggcaaagaagctttcagtggaaacaactgctaaccaggtgaaagttcttaactctttgtagattatattatttgcgcataataacaggatgtcctataccatgcagtctactcttgaacaacaacagttcaattcagtagattcttatcatttttgtcatgttttcaatgtctgttgagatagtgataaaaaacacttctgtaagatcaagggatggggattagcaatatggtacatcaatggttactgcagaaacacatcgttagaaacatatgcaataattttggtacattgggcaaggaaactgttattggatgcatgttcattgttctgataaaaaatggtaccgatcaatatgctagtggcttgctaaaatatgttactgcagtttagttaacatgtactgttgaaacaataccttgttcagcagtcctgcaattggatttcaagagttaagagcaaggacactatattttgtttaataagttgttatgacatggtacttaaaattaatgtgttttaccagtataagatgtattgtcttctgaacatactattttctaacatcctgtaaacttttatgaagtatctatgaattttcattgtttaatgaattctgaatatgactgttctaagtacatggcaagagtttgctgttctcatagttcagtttttgctttggctaatgtgttgagcaatatgaaattgtagccctactttctaaaggaaagaatacattttttttagcatcctacatggtgatttgataatagggcacagctgacttcttgcaatttgcaggaccctctggtaacgaagggggccaacttggttcctttgttgggaattgatgtctgggagcatgcgtactacctgcaggtaatctcatgctgttgtgggggtcagaggcacactcattgtttagttgctcttattctgctgttggttattattcctaatggcatgttgtaatttgcttatgttgttagtgttgctagcgccacatatgatgtgttcattgatcacaaattcacacttgaatgagttggacaacttattccccttgtagcatttgcactacgaagctattgcctttttttttaagataatggaaagaatcctgggctttacttcaaagaagctacaaccacttattacataattcactgaatgaagctactgcttgaaaatacggttcccattgttttccacaagacctaacaggagcagagtagaatgatatcacattgtttcatgggttatgtctcaaaagatcagagaaaatttaggagtagtaggatgtgactaggcatcgaatacgcatgtgcatgaatacaaaatgtgagtaccattgaagattactagtattgtacgttctgaacttctgatgtagtacatagtctgactatagaaggaatagttacctctggctgtttaacaacttacaacatcgtgcacacccaacttatttgtgcttcgaatttcaacctttgctattgctaaacagtcttcattgatttccgtggttgcagtacaagaatgtcaggccagactacctgagcaacatctggaaggtgatgaactggaaatacgcaggggaggtgtacgaaaatgcgactgcttgatgttgtctgaaggcaacgctcatggttttttttcacctagtactgccatggatctttgtatgcaataaaaatgggcctattgcacttctggaccttgtgtacattgcgtagaggtggactaatgcataacataatatgcctgagattttcttcttgtgctgctttcctgcatttctttgctcctggtgtttcactgcccatgcatttactactgcgccggtactgcctttctgtgccaattcccgttctcaaagcgaatgaataattctgtgctgatatactacctccgtttcaaaatatagtgacttttagctatgaatctggacacataattgttcagattcatagttaaaaatacttatattttaggattgcttatattttgggacggagggagggagtaatgatgtaatttaggaagaacactcgtacatatggaacgcatgcagttctttgtaaatttacaagaatagtctcgtggaacgcaagtaatggatcaaccaaaatactaatccccctcgtacctcagcacagtcctcatcgcctggtgtacatgcgtgcatctttcatataatcgcggaaaagccacgacacttgtttttaagtgctcaagttgtataaaagttggatgtgagcgatatcttttgtaatatttagaatattatctaaaaacaatatgtttaaatgtatgttggggaataatttcatcagattatattttaaccatatttaataaatatattcgaacataaatttttatcggtcaattttcttgtttctgactttatttgcttgggtgcgtgctgaagaatgtggtgttcttatctccgattctctttcacaaattttaaccatcatttttttttattttacatagatcaagacgaattgtatgattgtttccggtgtgttttttcaaaaaaaaagagcagtttttcttttcatttcgtaaatttcagtcactttttaaaaacaaaaaagtactccatacagcttaattttggaaaattcaaagttcagcataattacaaaaaagcttaggacaaacgactcgcccttgcgattttgcgaatgataaacgaacggtttcatttcacagacgcttcacttcgctcagctgtagtagacatcgagtttgagtcggactccgactccgagtcccattcggtacccctccatccataaatctcgtttcgtcctcgcccgccgcctccgcttcccattcccgccgcccgcttcctccacctgatccttcgccctcgattcgctgcacttgatccgccgctgcgccgcctctcgattcgatccatctctgtgccctagctaccctcgcagcagagtccactccacccgaggtgcgacatggccgtcgggatggcgcctcctcctcccacggccgccgcgctgccgtcccgccgccgcctcagggagcggatccagtcggagcgccaggtggtcggcggcctcctcaagaaggcggaggccttggtggcccgcgccaaggaggacgtccatggcgggcgcgccgcggcggcgcactccgaggcctgcgctctccctcgccgcggccgtttcttgcgtcgtccggaggcccgaccggaggcggaggccaccgccgcgatggacggggctgcctctccccgcaagaagaggcggaaggcggcgacctccgcgagctcgatcgtggaggtggaggtgatcgagccgaccatgcccaaggcgcagagggaccgcctctacggcctcctctcctcgctgtcggcggagatgccattgccgccgcacatcgtggccttgatgcagagccagtgctgctgcgtcgtggaccctaatggcgaagagatggatgtggaccttggctccgcgaaggatgctgccttgttccagttgctgaacctgctcgaggaattcgctcaacagcagaccaccaagattcagccacggctggcggaggagcaagaaccgcccaagatcgaggcacccgacgccaccagccgctcgtcgtcgatctgccaactgatggaggacggcgaggtcgccgatgagggcgcggacatggacatggacatctgcggcggcgtctctcccctggtagtggacaaggttcagttctcgccgcttccgaagcaagaagaggatgatgagttgatcaacaccagcggcggcggcggcttctctctccaatcgccgcctgccaagcaacaagaggaagaattcgtccgcgatgcctcccctgttgcagttgacaagttccctcaaactgaatctcctagctcgagcactggctcctcttctggatcgtcatcatcttcatcttcgagcggtggctcatctggatcatcctgcagcggttgctcctcttcaggcagcgactctaacgatgacggagacagtgcgagcagccgccctgataactctgaacttcccactgaagctgcagcgaagccattggagcagcagcaggtcacagtctgcggcggcgtctctcccctgatcgatgagttctcgccgcttccgaagcaacaagaggatgacgagttgatcgacgtcactggcggcgtctcccctgtatcagtcaacaagttcccagattctcctcgctcgagcagcagtggctcttcctcctcttccagcagcggttcgtcctcctcctcgtcggaaagtgactcagacgacgacggcgacagtgcgagcagcaagccagacaccgcagatcatcccactgaagctgaggcgccgaagcttcagccattggagcaacatgaggtcgcggagcaagacaagaagctgatcgccgagagagcagcatctccgaacaccgagatgcaggagctgatcgccagggcccaggagaggcagaaactccggcttgagctcgagaggaagacggcgcgcgagctcgagaggaagatggcgcgcgagcagctgcaggagatggagaggacggcacggccggtctacgacagcatcgaccccagtgtcatgaagcagctcgggatctccggcgatgcgcagtacatcgtcagcccggtgaaatctcggcacagcctgcatcggcgcggcggcggcggcctgctacagaagctcggcttcttcctcaaagaatagcatgatccatcatcaatggtgtctgtaaagctctgtaggtttcttgtcacattgggatcatatgctctgagcctctgacaatgatctcatcagttgcttgctctcaagcctttgatgtacttaaaaccattgattagcttgcagctaagttatgctgtacatgtgtcttgtattatatctgattatatgaaattatgaatcgtcttaaacaactgtactgtttctgccttatttcaagtgtatgcttagtcttctgttcatgaatgataacagttgcacatgttgttagtttatctgaaacaagcaaagcgacagcatcaacgaagtagtcttttttttttttggtgagatttacctttggaaaaggtaagagaaactgatttataagatatatctggtgcaaaattgaagatcaggaacaatgtttgtacatggtaagcacccttgagtttccaagagtgatgctactaacctcttaacaaacagaaaaacaaagagaaacaactaatagtgctaaaatgcctcaacaacacagctgacattgctgcctcccacttgcaaagtaacaaagcaaaaattgctgcctgtgtagtgcaggatagatgggtgaacctatttcagattacttcttgtgtgagagctctccactagttttgggaagcaaatgctcacaggaaaccttgatgggctgctcatcccaaatatacttgtgtgctcttcaactgcaacgatcttgtctgcttcgtcaaccacataggccataggttgctgttatcgcaaattccggatctcctgcgcgacgtctaagcaacactcaatgggacagttggtcttgattgcattggcgcctatatgtgatctacaagcagcatacccttcctgctcacacattcagagggtgctcagatagtcagattgcaaaggtataccaatatatgcttattaaaaagtcaaaaggttaattaaagatgcttcattaggtaaatacttattaagaagaactgactgatacatatcacataagaagcaaaaattaagaaaagatgggtgctgagttagctaggaatttgcatgttaactgaacattgatattacagacaagcgaaatacctttcgcagcgagtttatgagggtgccaagtggtggagagtttacttttgcacggctagcaatctagaaccacatgcaacaaattagttttgctggaagatttctgatagtaagcttgaatggtacattacatatttctgaacaagttaataaggaactgcaaaatatacctcatcaagtctgatatatccagggggcaaccttgagtcgctttcctcaatcattgtgtcaagaagtttttctaatgagacaccattctcaattgtgtttgcccatccccattctgttgccaagcttaacatttcagttaggaaggtggtatcatggagaggacctgtccaaagtggtcctacaccagtgatcgattcgggatcctgtaaaagaaaatgtaaccacataatagcacagttccttacccaagtatttaacagtaagaatggcttgatgagatttcttgcgtatggcatacagttctcaacttaggtgatgaacttatgtgatggagacatattcattagtagcatgtggcatatggttctcaacttattaaatgggcatgtttgtatgctagcaaagtgataatatttggtttattacctttggggtgttctattggaaacaaagtagtcagataaccttttgtattgtgctaacatactctaatagcccttacttaaccttaagaagtattgatctacttttcagacctgctaaaaatatttaatatggtccaacacttgctaactatatcatagcaaagcctgggttggcagctatggctgatctgggagtatccactacccagtaagcctgactctagagtgaatcatgtatccgggagctttaccactccaagcgatcacacatgatttgatttcaacaaagaaatctttcgcatcaatacagtaaaaaaaatgggacaaactatgatttgcttatgatgcctttcacattattataccaccacagactcgtgtacctacaattttgtctgcacaaccacaagtaatctgccccaactcatcaaatccaaaagtccgtgactggccacaacttttgcaatggcaaatgaaaccataattactgccaaaatagaaatagttagcaactacccattgtatggactaactgttcatatcgtcatagaatgaccagtaacaaaagaacaatgactaacctgatgccatcttgttttccattatgtaactgtaccatgactcgaaaaatagggccatgatatgcatagtatgagaacaatggagtaatgtgaaatcccagaatagcagcttcccgtgcagcaccacctataagcattcgcaaaccgacctcattcggatatggcactggacgtatatatgctccatatgatgacaaagagctaaagaaaacataatgttacaaggttcacatgaaagaagcatggatgctataatgcccactacaaaacaaacctggtcaagttcaacacagaaaaactaatctgtagtgtagcctagtgtgcattacaaaaggaattgactattacaacaggagcattggcacaccaccaaagaaatagtgatatgcatgtacgaagtgcacactgtcatactcaacaatctaatttgaattcactgtttctaattatactacaaacagaattactgatttgatgttcatactcattctaaaatctgctttctaacttcgctcacaccgtttgtccatctgacatggattttcctaggtaaacatatgtttcatgctctctaataattgacattatttgccatacgttatttagcagtttctagtacacctactgaacaactaaaaggccagcatttgaacatgtaaaactatgtacattttcagaatacaaagattacaaccgtcagttgagctataagaagcaattcaatgcagaagtgtagcagacactccagtttcaattgagcaaatattaatcaacataatctgaacacaataaacagaacaattctaataattgacaaaagatagaaatgcttgatgaattagcacaagctttaagaagctaaggcgaaggcattacaaattggatgatactacccgagatgtgtcatgccgaaatggaccacggactcaccttcttgagccataccctctcgcggaccgccaatccgtagatgtcagatacagtaggcccccaattctgagcgccagcaacgccgccctgatgtacgcggcgtcgccgccgaacgagtccacgtcgatgacgtcgaagtactcgcggcggaggtagcgctccgagagcagccgggtggcgtcgaggtgcgacaccgcccacctcctgtccggcgcccgctcgaagcgggagaggttgccgacgatgacggggcggagcgcctcggaggcgtcgttggcccagacgaagtcggcgccgacctgcgccaggtagcggagcgcgcggacgccgcagccgcacatggcgtcgaggcagaggaacggggcggaggggccggcggcgcggcggtggagggtgcccgcgaggaccgcgaggtcgcggcccgcggcgctgtcgctgcggtagaatgcggagcccgggtcgaaggtgaccccgcgctcggagtgcgcgcaggcgggtggctccgcgctgcgccggcggtggcggtggcggccaggttggagtgaaaaggggagcgctctggggaacgagagcgccgctgccgctgccgcggcggcggagatggccatggcgacgggaagagaacagcagaatggtttggattggggtacagggcgtacagccgttcgggttcacttcagcgaggccgacatttcgtgtgaattgttttttcctgagttacgggtgtaatttttgtagcattgcacgtccttaaagaggaagtcattaataagataagtccttaaaaatgagagagtatatatacgagggatctgtttgacaggattttaaggacttgtttaacttctaaatttagttttaagtgttgagtctcgagtgaagttgtgaaagcgctctacccaactccgttcctattttaaattgagctaaaactgtttagctgagctttaactccaagagaagaggagctgaaactggagcctgagcctggagctgtacctaacagtccataacttctaaatttaactttaaaagctacagtgaagttgtaaagcagtttcacctctttaatttattttgtgatagcacttcaaccagctttactcttattttttatggagaaaaattgtttgtctagagtttacctctaagagagatggagctggaactatgtaacataggttctaattctttcactaatcttaactttattaggagagatagagctggaactctgtaaaaataggttttgattctttcactaatcttaagagcatcaccaagagcatcccgaaattctgtcctcaacatttcagttatgggaattctaaacaagatttgaggtgttaaaatttttattcctccaacagattagctataattggtttcctaaaaacaaaaaagtaggcccttagaaaacttccaacagaaatcagctagtttccacccctcgctctcacgagatcacgcttgcgcacgtgccccttcgtcgcccctctcacgcagtaccatgccggcagatcaacccgaccggtacacgtgcacccccagttttcaacatgtacaccagcaattccagcaggcaggaaagcaccaactagcagcaagcacgactagcaattgcagcaggcagcaaatcaccaagtaagcagaacatcagcaagaaatctgcagcagcaagcagctcccatagaaagtaggaagcagcaacagcagcaagaaccagctgcatccatcaactccagcatcaagtttgacaacagcaacaaatcatatccctatatacttctgtaaactatattctatacatacccctatatgcttttgtatatgaaatgcacaaatcatatccctgaatccttacattaatttctgaattgtcaggataacatatatcagaagtagtttggatttacaaagttcagcccagaaagttaaaagagcatatttttttcttattgcctcctatgcaggcagcaagcagcaagcagccacagcaatacatagcaccaaattcactatgaatacatgctcatttctgaaaacatgtccaactactgttatttatgaaaatgcaagctctaacagatagcacaggtggttcatacaatttctgaattgtataaatttgacactactgtccaaattcaaatatatacagttcatatcagccctgacatcatagtttatgaataacatataacacaagtgggttagataatttctgaattatataaatttgacactataattttctctctgttcacagtaagaacagaacacctgaacattgagctttttgcagacttattacaaactacagatataaaaaagggcaacttttccatttcatacacttatcgctattgatttgtaataatttataattgattactgctaacttgctaagctagcaaatttcattattaattgattatcaatgtggagttcagatgtaccacttaaccacaaacatcagattcggcagcaggataagataatgcacaattacaatagacttgagatgcaacaatgatccagaatcggggacaggacttattgaaattgcttccacgaaggaactcttcttcaccaacaaaccaagccatggacaaaatggcgctggaagcgttgtgggagatgggatccagtgattgcctgggcacctgctggtacatggcctctgtcgcctgaacaccggaagtcgacgattggccaggaggcagagcacgggccgattcacaacgtatcatggttgcgctctaaatcgaggcggcggtggtggttgggggagcggcgatggctgtcctcctccagccatcggtggaatgcggtcgacgcgcgataccatgcaccgctccctggaagaaagccgacgcccggcaaccatggggaagcacctgctgcattccgatctgttgcgaggaagaggacgccgtcggtagatgaggtcgccaagaggagctgcgtgggaacgtttcaccaagcgcgcgcgagatagccgcgggcaaaggattgggagcgaaatcgatttgctagaattggagaacgaaaaaccaggacttgggtaccagaaggattgggagagctggtagggaatctgttggaagcaatctttgatcaaaaatccccaaaataccacatagggaatgatatcaaaatgctgttggtgatgctctaactttattacgaagtaacaaaggtacatagcataactgttactcactggatcaatattcatattatcttgataaacttagcaaaaattgctacatgaatttatgtaatttactggtagacatcataaaaatatgtaacggctgaaagacgtttaaaaaactggtaatttaatagaggacactttcagctcaattggcgagagaaattcttcaaagatacatttgtttggcaagtgggattgggaaataatatcccaccctccaaaggacaatattgcatcctaaccatccattcttcacacctcatttaatcctagccattcatccatttccctttctcaatcccacctctcatatcccatttgccaaacacagtgttagggtgaaaagcttttcagctaagactggaacgaggatggaatataatgtatgctaggtgatgtacttggggtgatagtaaatttagatttgcataatttctaaatttttactctaacgtcatgtttgaaatatgtggccttaagggcattctcaactttcttaagaatttatcaatctaactgagccgaaagtgttctctagcaattaccagtttttttaggatgtctttcaaccgtgacacgtttttttatgtatatcagcaaattacataaattttaagtatcttgtagcaaaatttgcctaaaaattactgttattagaagtcgtgccttatacaattgcatgattgcataatataaccgagaataaattttacaatgaaaactctcaatgacttgcaagcctatcttcagtaaatttagatcaaattttaaaatcatgctacatacatataattatgaagttatgccttatagactatggtaaagtagtactccctccgtttcataatataagttattctagtattttccataatcatattgatgctaatgaatctagacatatatatctatctagattcattaacatcaatatgaatgtggaaaatactaaaataatttacattgtgaaacggatgaagtattcatatattaatgactcaactgcaaactccataaaagttactttaaacactctcttcaacccaccaccttcacgacaaaatgccaagcttaaagtctaagttggcccaacttctagaacagcccaagcctgctcatcttaatccaatcccttcggaggaattcattcaaaagcctaggcaagccatgtgatacacacggaataaataattaggactaaggttacggtctcaaattctcaattccacagttgtatatgacggacgacacactagcctgtggtcaactttgttcgtcgttgtgctccttctgctcccatcccgtccagagacgacggccggccagcctgaggtcgattcgaacagctaaagcacgagcactgctatggccggccacgggcgtcggtgagcgatggcggcatcgacgattactctcatctgctggtttatatcctgtaagctccctctgctcctctttctcaactccggccgtctgctctccgccaatgtagcctactctttccttatcatatcagaataaacaaaactagtagtagtactctgtctaaatttgtactcccataatattttgaatattggaccaccttttattactaagctttcactttgaactacccctttacctatgttttcagtttggactagttaatatttcctttttgttgcactctagaccaccttctctcttcatctccttcaccctgtcttctcccaaactccgatcaccaaactcctccatcagttgtaggctttattttggcaatggctcttagcagcagtcgggcttggtgagtgaggcacactcatgtactcagtggtcgattagaggaagcgaagtaaggcaaggcagtggctcttggtaatgatgaaggcagcagagagcaagaggccaataaaattattcttttgttgcctccccttggtgttaccttcgcttgattcctcttctatttccattcgaattatttctgcaaattttccaccagaccgatatcaggcgcgctgagacaggtgccaaaatcaagatcattggacgagctatccggctttacctccatcttcaccagcccttggtcgtgctaagctagcccatcacgatatcggcagcaataaagatagagctcaagcgtgtacaatgccggcaacgtgctcaagcatgacttctgccgctgctgtccgtagttgcaggagtggggaggtcaggattctcatgtgatcgatctccggcagtagagtgaagagaaagagggagggagctagaggaacaagaagcctaaattgaaacattttgggaaaaatacctagtccaaggtgaaaagcttagtttatccctagtccaagatgcaagactggttaaaaaatgtgtctcaaagtgcaatttactctaatatttttttatggagggagaatcccaccaataatactctttcagaaagtgttcggatttatttgaactgattgtgctgagttatttgtagcaactagaacaatgcctctttttttttcagttgcagcagatctcaaataaacattatacatactaaattctaaaagtagctattattgtttgaatcccccaaattcgaaatactgcatgcaaaatggaaaagattaaacagctatatcaatgaggattaatacacatagtagttatatagttcagtattgtcgctccattcctatcaaggcatcaaccccggagttgtttctcaaaattgatacctccatggacgactagaatgtcatgtttggctgaccaatttgagtaactcataggatgaaaatggttcccaaaataatgtagaagcatatatttgcaattagggataaataactgtcgctacctctgattccaactgtagatcatcttagagaagtactcacaagaattaagaaagtgtagaaataaataatgttgctgtccagcaataactacacaataaacaaagggcatttttaccaaactggaaatttcgtggtgttacaaaataggacatgaggcatatcaaattgaacagcaccgatatgagtagctgcaaactatcagttttccatatgctgatatacaaatgcttccaattggacaaattaacttcaagttatgcacttatgctatattgtaggttctttttgtctactctttctgcatcatttgaagtactttcagaatgtccagatttctaatgtttctgagatattattttaatatgaacaacactagtagcatatttctaatgaagaaacaaactggctttgaacacacaaatgcttgttacaggctagcagtgttggatgaaacaaatgatcttcttgcataatatctcttggattgattatcttgagtaaacactggtttcatacaggactgcagaaactgaattgagcattgtcgaaacttgaaacgcatgtaaagatggcagcgttgatccaactatggaatgattgggagttacaggtgctggtgcttttaagcttcatgttgcaagtgttcgtcttcttttccggtggtcttcgacagcgcagcaccaactcgtcattgaggattctggtttggttagcatatttggtggctgatttcattgcagtctatgcccttgggcaactatcacggcaaaaaacagatgcaagtgaagctgggcaacctcacaagtttgcattcttctggacgcctttccttctcattcatcttggtgggcaggacacaatcactgcgttctctgtcgaggacaatgaactgtggctcaggcatctgctcaatcttctagtccaagtttgcttggccttgtatgtgttttggaaatcagcagcaggcaatcagtttgtagtctcagccatctttgcttttatttcaggaatcatcaagtatggggagagaacatgggcactcaagagtgcgagccagaaatcccttagacgctcaaccgatggaggagtagtaggtcaatttcctgaactagaagactatcaagagttgggatacaaaactatggtcatgtttgctctgtctagctcaccagttgtgagaaacctacttgttggacgcaagattgatcaaatggaagaaagggtacgtcatgcattttcaggtcgactgtatagtcaagtttcagaaaacgcgcaacttgtgttcaagattctagagatcgagctgggaatgatgtatgacaacctctacactaaggcgagagtgattcgtacatggactggcgccatactccgattcatcacctgcatctccctgatggttgcatttgtgctctttctgacagggaacaagaagtggcaccatagcagagttgatgttgccataacctatgcattgttcattggagcactctgtttggaggtctgtgcgatcttcttcatggtgatgatgtcgccatggacatgggcatccttgcaatattggaagtaccataggctcgcagatgcagcttggtatgttttcaagagcctacagacggagtctatgtcatggtggtcgaattccttggggcaatacaatttcctcagttcctgcttctctgacaatgtgtttgggaaggtgatgagccttgttggagcaaaggaattttggaggaactttcggtactctcagcgtgtgggcgtcaaagcagagatgaagaagctcgtctttgaagccaagtgccttgccgagatcttcggtgcaagccagacatcaagtgtcgatgcggatccaaattcaggcgtcggttcagcactggacataatcctgcgggaacagttcgaggtggccatcctctcgctacacgtctacaccgacatattcttgcaccgatgcatgaatcccacaagtgctgatagctgcgacgctaccagggagagacggcatctgatggatgcgtgcaggacaatatctgagtacatgtgctacctattggtcgtccatcctgaaatgcttcctgtcagtggcagtgtgcgtgatgttctagataaggcttcagaaaccgttgccaaggtcagctctggagctgctgcaagcaagggcagagtcagtgtcgtcctggagaaactggctacagaccgtgacctgaatgacttgtctgatcccatcaccctcgctgggtttgtcttcaggggccacaaggaagaggctgtgcattgtcatgaatcactgcaagttcttgcgcgcgcgtgggttggggttctcctctatgcagccggcaagtcccgtggcgagaaccatgcaaggcagctcagcatgggtggggagtttctcagttttgtgtggctgcacatggcgcattgttcactaggagacatgggcacatttgaggttgagctagttcgaccgagcgcggtgaatgagggcgggcgtaagatgtttgtatggggctatcagcgtcctcggtgacacaccaccct

SEQ ID NO: 73623 - DNA, 667 bp, Oryza sativa
atatcgagtagaaggggcttcgatagccatcatcagtcatgtgcttccaaaatggatatttcataatcttgaattctaaattgaaaattggaagtaccttatcgaaatgttaattggtcatgccatcatagttccacagtgtttcttattatccttcttgtgcctgtgatgagactttgttctgttcattaatgccggtggctgtgcaattgagggttgtgaaccctcttcaaagctttctgacgaatctttcttcgaaggaggggatgcaatattgacatctgaggatatagtttgaagtggtgactatcctttgctttaccactcagttcgatatggaaattccagctagaaaatcgatggtcttgctcctggagactttctttgatctgcatttgctgagatagtgaacacttacgggccaaaaggaattagagcatttgatgtccttgtgcaagaagaaaatgcaaacacagtattcatgagactcttaattttgtatcacaatttattttcaggtttagctaaacaatttgacttttgattgatgcacagattttgtctgaatttgatgtgtatgcagtggttggactggtaacagaccccttcatatgcgtgatattagggtgacagttgagagtaacggcacctttgtcataaacttcaa

SEQ ID NO: 73624 - DNA, 6227 bp, Oryza sativa
agctcgggcacttgggacaaatcagctacctcaacctgagcatcaactctcttgaaggccacattccagatgaactgtctttgtgcagcaaactcaaggtactcagcttatgcaacaactccctccaaggtgagataccaccaagcttaacacaatgcactcacctccagcaagttgtgctttgcaataataagctccaaggcagaattcccaccaaatttgggatgctgcatgaattgaaaactttggatctctccaacaacgccctcacaggtgacataccaccattgttgggcagtagcccatcttttgtatatgttgatcttgggggcaatcagctcacaggaggaatcccggagttcttggcaaatagctcatcccttcaagtgcttagtctcaagcaaaataatcttacaggggggatcccactatccctcttcaacagctccacgttgacaaccatttaccttaaccgtaacaacttagtgggttccataccacctattacagcagttgctgcacctattcaataccttagtctagcacagaataaactaacaggagggataccagcttcactgggaaacctttcttccatggttcttttatctctaggagcaaatagcttggtggggagcattcctgagagcctaagtaaaatccaaaccctagagaggctagttcttacatataacaagttgtctggtaatgtgccacagaacattttcaacatgacatctttgaaatatcttggaatggccaataactcactcatcggccgactaccaccagatataggcaacaggcttccaaaccttgaaaccttgatcctatcaacaacacagttaaatgggccgatcccagcttctcttgccaatatgtccaaactagaaatgatttatcttactgctactgggctcaccggtgtagtgccgtcttttgggtccttgccaaacttgcaggaccttgatcttgcatacaaccagcttgaagcaggggactggagcttcctctcatcccttgcaaactgcactcaactgaaaaagttggccttggatggcaatattctccgaggaagcttgcctagctcagtcggtaatcttccctcacagctcaactggttgtttctcaagcaaaacaaactttctgggacaattccatcagagattggtaacctaaagagtctcactgttatgtatatggataacaatatgtttagtgggagcatcccacctaccattggaaatcttagcaacttactggttctaagctttgcacaaaataacctctctggccatattccagattctattggcagcctttcccaactaaccgagttttatatagatgggaacaacttgaatgggagtatacctgcaaacatagggcagtggagacaattagaaaagcttgatctctctcacaatttcttcggtggaagccttccaagtgaggtcttcaacatttcttccctatcaaaaagtttagatttgtcacataatttgtttactgggcccataccactagaaattggcaacctcataaatcttggaagtatcagtatttcaaacaatcgcttgaacggcgaaataccgtccactctagggaaatgcgtgcttttggaataccttcacatggaagggaaccttcttactggaagcattccacaatctttcatgaacttaaaaagcatcaaggagctggatctctctcgtaacagcttgtcaggaaaagttccagagttcctcactctcttaagttctttgcagaaactcaacctttcattcaatgattttgaaggggcaataccatcaaatggtgtctttggtaatgctagcagggttatcttgggtgggaactacaggttgtgtgcgaatgctccagggtatggcctgcccttttgccctgaatcaggatcacaaagtaaaagcaagtctactgttttgaaaatagtaattccaatcgtagtgtctgctgttgtaatttcattgttatgtttaacggttgttctcatgaagagaagaaaagaagaaccaaatttgcagcactccagtgtgaacttgaggaaaatatcatatgaagatattgccaaagcgacagatgggttctctgccacaaatttggttggtttgggatcctttggggctgtttacaagggccttctggcatttgaggacaacccagttgctattaagattttcaatctcaacaagtacggagcacccacaagcttcaatgcggagtgcgaggcattaagatatattcgccatcgaaatcttgtcaaaatcattactttatgctctacggttgatccaaatggctatgattttaaagcacttgtctttcagtatatgccaaatggaagtctagaaatgtggctacatccagaggaccatggccttggtaagcagagattcctaactttgggtgaaaggattagcttagccttggacattgcatacgctatagattatcttcacaaccagtgtgtatccccactaatacattgtgacatcaaaccaagcaatgttcttttggatcttgaaatgactgcatatgtcagtgactttgggttggcaagatttatgtgtgctaattcaacagcagagcctagtaactctacaagtttggctgacttaaaaggatccataggatatattgcaccaggtgagagaaattggaaacttatactgatttattgacttgtatgcttcagccatcctattaacttatccaatgttacatggattgtagttttccacaattcacctttcttatgttttcaaatgaaaatgcagagtacggaatgggtgggcaaatatcaacgaagggtgatgtctacagctatggagtactgttgttagagatattaactggaaagcgtccaaccgatgaaaaattcaatgatggtttgagcctccacgatcgcgtggatgctgcattaccccacagggtaaccgaggttttagaccccaatatgctacacaatgatttggatggtggaaactccgaactgatgcaaagttgtgtcctcccactggttaaggtggcgctcatgtgctccatagcatcaccgaaggacaggttagggatggcacaggtttccactgaaataaactccatcaagcaagcatttgttgatctttccagtggaggaaaaatggtttgagtaataattagacctaggcagtacatttgacactccatcaagcaagcatttctagctaagtttgccttttttttcttatttttccttcctgaaattagtgcaaagactgcaaagctgttctgcattgcaactattatgtacagctactttcattaccataattaagtccacacagaatcaacctcttggtcctaaaacttgtttgggtcagcagcaaatgcaatggtcagcaaacaacagacagcaggctggaacacaccaaaatattgttctaacttaaaaaaccaataattctgcagtggttaatcagcagcacaactcacaacatgcaggcataaggatatgcatagagcaaaatgggcacacatgtgcgtgcgtgcgtaagtactgcgtgctactcccacagaggcatttccacaaacatgccacgcgcattcaaaggaaacacaggaaattgagattacagttacaggcacacgcaaggtcagaaaagcagtaccatcctgacctcagaggacggcgccggacctgggaaaccgccatcgcggcgcctgcagtactggcttgctcgccgtcgccgtcgccgtcgcccatcgcgtcttcagcggcggcagcgtgacagactcggcgcagccattagagtcgacgccctcggaggatttggagactgggatagagatcggattaatttgattcatgccattataaatatattgaattagaataataccattactttttttttgctcttttctctttttttgcgatattttttctgttttctgatatcacctttctgcgtttttttcttttttatattatttttcaacagaaacaggccaatgatctcaaatagagacttaaatgtaaatataaatattatagggactgaaatacaaaagtcaataggaaatcctaccaaccgagcaactccaaaaccgctcgatgaaaacttctccaaaccataaaaacggaaacccggcgatggttagttcgattttttaagtcccaacaacaatcgacatgatgcaaaactacatccaaaactgacatacaactcacacgacttaactaatgaaccctaaacccgaattgacgaagagatgaaatactcaaaactaaaaaaaataaatctaaaactaaactagtactcgacacgacatgcaacataaaattcaataaagcaaaatctaatagaacaattcaatggctcaaaatttctaggtaatggatgcaataattttgtgtgaaagttttatagttataggtatatataaaagaaactaataatcttaaagaaggtatacctaacaagcaatttgtgctctgatactaactaaggacctaggtctcgatctttcgataggtgctgataactctcgatttggtggaaactagacacacgatccggcttccaatcaacacaatctgaaccctgcaattgcattaccatgtctcctttggtaatcaaccgtgcgctgctcggttgacctcgctgagaaggctaatcccttcatatgaatcataaaacacaagcaaaaacaaggtagattgcaactcaatttgtagataaatgattaagatctcaaggttggggttccacaaaccgaactagcggcgaaactgtaatggcaaaaatagtctaagcaaaacctaaccctaattcgatgacgctactgaataaatagcttatagggtcatccttgggttgtcctagggtacacaaccccttgggtttagccaacgacacaattacaagggtcaaagccaaatcagactcggactagatgaggtacatggtttattttgcatattcccgatagcccatgaggaattttgaggtgggggtggaggtggaggtggtaggggtaggggaaggggaagaggaagagctggagggagggaaggttcgtggtttggctcaagtgcaagtggtggaggtggcaggggtaggggaagagctagagggaggctagctgatcgtgtgttctttggttgatcatgtaatatgttcctactatttagtgcatgtttgtgtgatgttggacctgatggtgtgcctgtatgtgtgatgttggacctgatggtatgcttccgttggatttggtggtgtggttttgttgggcctattgatgtgtttatgttggactgttttattgttgcatgttgttggacactagtaatcgtgcacgtgcaatgcacgttatgttcaaaatataaattaaacccaatatattgtaaccaaaataatttcacataaaagttttcattttgtggggttacacaagttttaataaaatgatgtgcaactctcctgacaagaaaatatatgtgatttgtagctccttttctacactgcagtaactaataaaatatcccaacaaattaacagagcagaacgacaagatacatgtcattgaccaatagaataaaggggcaggaatgtcaaataccacaaatcttcatgtctcaaaatttttgttgccagccgtgaaccagttaataacttaatatacttgaaattgcagcaaatacttatgtaccactttgaatcttaaatgttccacttcatcatgtttgtaaaaataatttattttaggcccctatagcataaataagcaagatatatgaggctttaagagcgacaaaaaaaaaccaaaaacttcaaaggatcatttcttaatctcaaatgatccttctattgaagcattttcttgaacatgaaaaaaaaaccaagaaaaatactacatgggcaacccagattcaataccagaaagtggttgtattatttacatctcacaagcaatcctttggagtggcttcctgccatgttggcataccttgcccctgaacagatttgatacaccaccatagttcgggggaggggggggaggggggttatcaattggagtgacactctcatctcacttctatcaagtatcaacagtacagatctaactctttagaacatgaaacaactttaaatttaaccagacatacaatgatttttccttattagttcaatccagtacctcaaacaacttccattataatttgc

SEQ ID NO: 73625 - DNA, 15790 bp, Oryza sativa
  unsure (1)..(15790): unsure at all n locations
cagttccacgcgcgcctcctcacctcgggccacctcggcgcccacccgggcctccgcgcccgcttcctcgacgcgcctcgcgctctcgccgcaccccgccgcgctcccccacgcgctgctcctcctccgctccctccctaccccggccaccaacgacctcaacgccgcgctcagggggctcgccgcctcgccgcacccggcccgctcgctcctcctcctcgcgggccgcctcctccccgccctgctccctcgccccgacgcgctctcgctctccttcgcgctcaaggcgtccgcccgctgctccgacgcgcacaccacggtgcagctccacgcgctcgtcctccgcctcggcgtcgccgccgacgtccggctgctaaccacgctgcttgactcgtacgccaagtgtggagatctcgcgtccgcgcggaaggtgtttgatgaaatgaccgtgcgggacgtggccacatggaactcgctgctggcggggctagcgcaaggcacggagcctaaccttgctctcgcgctgttccacaggctggctaacagcttccaggagttgccgtcgagggaggaacccaatgaggtgactattgttgcggcgctttccgcgtgtgcgcagattggcttgttaaaagatgggatgtatgtgcacgagtttgctaaaagatttggactggatcgcaatgttcgggtctgcaattcactaattgacatgtactccaagtgtggctcgctgtcaagggccctggatgtgttccattccatcaagccggaagaccagacgcttgtgtcctacaatgctgcaattcaggcacattccatgcatgggcatgggggtgatgcactgagattgtttgatgaaatgcccacacgcattgagccagatggagtgacttaccttgctgtgttgtgcgggtgcaaccattctggccttgtggatgatgggctcagggtattcaactcgatgcgagttgctccaaatatgaagcactatggaacaattgtggaccttcttggccgtgcaggccgtctcactgaggcatatgacaccgtcatttctatgccatttccagctgatattgtcctttggcagacattgttgggtgcagccaagatgcatggggttgttgagcttgcggagttggctgccaataaacttgctgagcttggttctaatgtcgatggtgactatgtgctcctatcgaatgtttatgcatccaaggctcggtggatggatgttggtcgagtacgtgataccatgcgaagcaacgatgtgcgaaaagttcctggcttcagctacacagaaatagatggagtaatgcataagtttattaatggtgacaaagagcacccgaggtggcaagagatatacagagcactggaggacattgtatcaagaattagtgagctaggatatgagccagagacaagcaatgtactgcatgacattggggaggaggaaaaacagtatgcattgtgttatcatagtgagaagctggccattgcatttgggttgattgcaacaccacctggggagactcttcgggtgatcaaaaatctccgaatatgtggggactgtcatgtggtggcaaagctcatctctaaagcttatggtcgtgttattgtcattcgggacagggcgagattccatcgatttgaagatgggcagtgttcctgcagggattactggtaaatagtggcatgctggatcatttaaaggataaatttggcatgagctcgtggagatgaggtcaaaaaggatgatataacatgtctctgatccagcatatcgatttgtatggatactggaacatattcttgaaccatgcatatcacttctgacacttcacacaatgggtcaaacatcaaaaggttgttcgagatataatccagggctccaggcttgctgttgcagatacattcaatttagtccccattgaaattaatcttgtaagttagggtgtgggtggtttgaaaatcctccacttagccttcacagagaatgatcttgagaatgaaataccaaatacagtatacacggtttgaggtttccggatggtttctgctgccactggacctcacaaccctacaaaggtttataatcaccaagagtccaggacacaactggatagtcacaatgccgtaggttacaactagcattcagctggtaatggtatggtactaatgaaaaactgacatcaggataggagcatgctatttttcctttcagggagacaacataatttttcatatctacggagcgaagttttccttcaagtctttggttctttgtcccgattccttaatattgtaagttacagtcatggttcagctgttccattccattaatagctgatgatttcattgtcgattttgatgatgcataataagatgcgcctttatatggtttaatctagaatcccttgcaatgatgatactatagtgatgaagtaaacttatcctggattataataaatacaaatttttgccttatctttgtgctatgatcattgatgcatttggcagttttggtcagtaccaacgtggtcgtaaaataatcattgcatgatattttccacacataattttgtttgcagtggagtttgggctatctggttctgtgtgaaattattgggttttcaaaaacatttcattgagcgatgtcatgtagcttcctcacaaggatttgtcacttttgcaacagtggaaggccacgacgcaggtgaaactagcaaaaaaaaaagatggacgagctccgggccttgtttcttgccagactttgtcttctacacgcggcaagagatacaggatgtggacggagaaaaagatgctggacgcgcaggtgaggtctgctcttggttttttaagcaactgcatctatgttaactttgatggtcaaagttagtcatgtctcacttagaacaaatctaaaatgacaataagtttgaaacagagggaatgttttacataatcttacaattaattattacatggtctaaaggaaaaaacacattgaattattgaaaaccaagtgtaagcttaaccggtgttgtaaataatgatcccttagatacaactttcgtttatattgaagccgatttatgcacgggagaatgtttgatgctgccaacattggggccattggtgctgccaacattggggctcttggcactgcacttctctgttatgtaacaccaaaggagcaccttggattgcctaaccgtgatgatgtttagacaggcatgatatcctacaaaattgctgctcatgctgctgatttggcaaagtgccatccgtatgcacaagcatgggacgatacactaagcaaggcaagatttgagtttagatggttggatcaatttgctctgtatctggatcctgtgaccactatgtctttccatgatgaaacattaccatcggagggtgccaaagtagcacatttctgctcaatgtgtggcccaaagtcttgttcgatganannntgtgtggcccaaagtcttgttgatgaaaatcacagaggatattagaaaatatgctgatgaacatggttacaggatagtggaggaagcggtaataccaggaatgaatgctatgagtgctgagtttttggctgcaaggaaaacgatcagtggggagcaacacggtgaagctggaggggagatctatgttccagaaagctatacagctcgcaaataaggttggtctttttcttatgatgtatagttcaacttgtgggagatgtttggactcttttgttctgaatgtgtagggttgtttactcggtatgaagtaattagtcatctgggagtaaaatggtctagtgccatatttcaatcagttttacataaataagccattagtgtgtgcttaccgtcttgaaacagcgtcagcttgttgttggcccaataacttcatacatgctagtactagttatttagcattagtgcaacttgttacaaatatttctgaattatctggactataaataaatactactcgagtactatctaccatttggtaaacattctgctaatccttttatgtcagaattgtttcataaatctatgagaactgttgtaattttgactccacacattctcttcagtgatatttcttaagggaaaattactctcacagcaatcctttgaaatgggtttgcttgtacatttgaaatttgacactaactgtaatagcagtggatagctgctctgtctttatcaacttctacttgtaatttcagggaccttaataaacctttagtggcttggacttattgtgcattactgcaaaggcactaacttttatatcactataacatgttctcggaactcagaatacaatctctgtgcagatcatcttggcgtccatctactccgggtgataaagatttactgactggagcgtttatcagcagcactcaccatcctatgttagggaggtggtaagcagtttatgtgctttgataaagctggtgttgcttagctcagtttctcctaacccatccacttttcgagcttgtatgctactccttttagtattgtcaaaatcttgtttcgacatgaagtgaaaagttgtgtgaaaagatcagtaggatcttgttcgaacctgttggcgatcagcctttgaaccccaaggtgttcgacgaaatacaaaatcaaaagagagcattttgcaccgcgtaagcttgtagcattttctgatgcatttattaacttaaatagctcggcgatcgtgccatcccacgatcgagcgctctcctcgccatgcgccctacgactccatcatgcgcttcccgactgagccgcgcaatcccaaggcagaaagcacatgtccacatgacgcctactaactccgacgcgctcgcacatgaacaagcatgcgtaagagcccatggtacaaacgcacacgatccccagacacagacatcatgtaccatgaagaaacgcagagcagaaatgggtacggcgctaactcaacaggaccatatattaaatgtttagctagcttgcactttgtctgaattcccgaatagcactgcaaaatgaagggcaatcataggtcaggtactatcagaatgcaataaccaagcatacaagtaaagctctgcagattgacagtcctatatacgagaggatgaatcaatacctggcttccagcgcttctggtttccgactatgatcagtggctgctgaatatgatgctcttcagttccacctccctctgtactgccttttagctgctcctcttcatcttcctttaccatttcatcttcatagcgccttagaatttcgagagtaagacagcgagtctggatgctggccacgttcctaatggcatcttccaaagctttcacgtcccttgtagtgggcatcagaacaatcgagaacgacgattagatgctggaggctggaaaggtgcacaaagctctgctcaaacccaagtttggatgctgctttttgtgcaaacaactcaatagaaagcctttggagttttggcatagcgccaggttcaaacaacaaccaatgcaggcgactatgcctgaacatcaactcctttagacagggaaatccaccacagcctacagtgagtccatcctcccagccttgggcgaatattactttaagatagagaagcttgggtatacacccaaggaggttgatatctttctgatcattgcttctagtattatagaagatcacaagataggcaagattagaaagggaaatcatctgctccgaaagttttgatattccaacgccagaagtagaaagctctctgagaccgggagcactactacaacatgaatccatcaatgtatctgaaaacttggttgtaacatgtacatgtaatgattgaaggctatttttacctaactcatcgagagtcatgtaaaaggcgtccttgtacctctcgaaccttgctacatcacctccaaaaggcgtccttatgcgcagataccttagtctggtcagccgacggagctcttgtaaacattttatgctgtactctatgttgtaaaaaagagatagcatctccaaagcttgcaaaaatccaatttcatctggcaatctcattgggtaatcaacaattaggcgctctagtttttgcagtctacaaacacttgacggaatgtttatttcgttgacatgtcctcctccacgaataattagtgtttctagttgctgcagccgtccaatatccttgggcatctcggtaacatttgcaacattgagcttcagatacttcaactggaaaaggtatgttaggctgttaatatgctggctctccaggctcatgcacccatccagaaccaatacccgcagagcatggcatttcttaaattgtggtatttgctccggtttaggactgtcaaagaacagcgaacgaacatgtgagcagttgttcgtaatctccttgactattctattatctgtgccattggatgggaaccaggtcctccgaatcttcttgaaagaactccaatgctgttgttcatgcactattgtgacgaaattctgtccagttgataggctaatgataagatcaagcacaatatcgtggactcggcagcaactggccctaccatcatattggatataaactggttggatcaagcttctatttataagctcattgaagtagttctctcctacttgctcccgtgtttttcccttcgcttcaatgatgaatccttcagctatccatctccatataagttcttgtctatcaattacataatcctctggatacatgctgagatacaacagacaatttttcaggggataaggaagatcataataactgagcatcaaaatttttctcacttcgacgtctgagtttagtgtaacaccaatagaattgtgcacttgcatccactggtcctctgtatcaggtttgattgatagcaagctagctatggagattatagctaatggtaaactacgacatttcgatatgatggcatgagagatgtcttccaggtgaggcgggcagcaactctcagaattaaaagctctccggtaaaataatctctgtgaatcttgctcttctagtggctgcatgctgtgaagatagccttcagatgtggtacggctgcatgcttcagctacggcagtgtttcttgttgttgttatgattatactgcccaaattattctctgggaaagcacaattgaccaccttccacgcacctatgtcccaaatgtcatcaaaaacaatgaggtacctgcgtacaattaaatttatgatccagtcatcatactttcgcaccaatgtggatgaatgaacatacataaaagctagttaccactcatgtagccatagctaaaagactggtattgatcgaagtacagatgtttttgtggctagaatattacaattaagagtgcaaagtgttttattgggtttgttctagttctagatacaacgatatatgtctgtacatttcggatttgctatatatcttgcgacagaaaattgaagttggaaacttccaaatttaatttgtgctgtcagataggcgttaagattcacgattcacgtgtgggggaggaaaagagaatgtatccgcgcatgggatgaggatcgactcatcaaccgaagctagtggttgtgctagatcgtgattttatttgtaatatattagacctatttctgtatttgaagagaaaaaaaatatgtttgaaacctctatttgctgttatgttccacaaaaattagaaaacataaaaatgtgtgtaccttttatctttcaagaatcctcgaagatgactgatgaggttctgctcatcttccgatacatctccattgctcccgagtcctttaagcatatcaaccaagatcttccttatattaggggtacgtgaaatagacacaaaagttatacacttaaaatccccttgtattgtcttgtacacttcattagctagagttgtctttccaagaccacccaaaccaacaatagaaaccactttacgttgctctaatggcttgcctttggtcatgatccacttaatgatcttctcccttggaccatcaatccccacgagcctctccacctcctcatacaatgccggtagacggggatcaatttccaccacacttggctcggagatgaaatcatcgatctgattcctcttgcgacgttgatcctcctccataacccgattcttcagttcttggatacactctgtgatctggtgtttgccccataacttctttatcttgcttcctatcttctgaacaaagttggcattcgcatcgccacaactcaacttgtggatgaagaggtcgatgcaatcctcaatatcataagctagctcgagcatgttgttcctccactccttggtcggcccatcaagcttgtcctccttggtcgacagatgctcaagcaagacactgatgctgctgagctcattcctcaaaaagatgatatccttcttcacacttttgagcagcttgtactctccctcgaccaaggcggaaagcttggttagaagaggattcagcacccctactgaagcactaacaaatgctcctgccatctctgttccactctctgctgtttcatcaaccaaccatgcaacgtccagaaacaataacaagcatgaagtacataacacaaacggctagccaagacaattctccaaaagtgtatatgatgtagatgcacccaccaactgcttgattcgtgctccgcgccacgggaggagacgccgggaaaggagcgacgcacggtggaggtggcaacctgctgggagctgccgccagcagaaggaggcagagccagcctagtcgcctcgcctcgcctctaagcgacttctaggtgggttaatcggaggggaatcggtggcgagatcagcctaactcacttgattctcaccatcacaccggcagtgaggaaggagcccattaatagcttttccattgtgcggtggttgttggagcatcgaggaaggatacgccaggaccgaccgggggaataaaaccgagggaaaagaaggcctttcggtgccgttggtgggacctgcgatttgacgtcacatgctaacgctatggaaattgacatcggaaaccacacgagtacatgaccatgaacatggcctttttactcacatgggcgatgcacccagacttggttggattcattggattcatatatattgttcgttacttttcttactctgtatacagactattcaaattattaaacaagaaatcttttttaaaatgtttctatacaaaagttactttataaatttatattaatccattaaatctttagagtaatacttaattaatcatgctaatgagcagcaccgttttccgttgaaggtgggttcctaaccccacattcctaaagcaaccctagttttgtttcagctttaattgaaagagcacgattaataattagtaaatcagcaaactccctcgattccgaaaattgcgttattctgacttaccacgtataaatacttctcgttcctatctaatataccctactaaaactagtaatgtgcccgtgctaggcgatagttgcatttacattgcttgaaaatgctattggcctatttagatctccagacaaaatttttcaccctgtcacattgaatgttcggacatgcatggagtattaaatataaacaaaaaaaataactaattacacagattgtgtgtaaattgcgagacgaatcttttaagcctaattgctccatgatttgacaatgtggtgctacagtaaaaatttgctaatgacggattaattaggcttaataaattcgtctcgcggtttacatacggaatctgtaatttattttgttattagtctatattaatactttaaatgtgtgcccgtatatccgatgtgacatgccaaaacttttcacctctaaatctaaacacagccttagtacaaaatgtaatatacatagatcacaatacgattataatataaggatctagggcctgtttgttttgtgcctagtgcaccatgccataaaattttgcatgcctcgagcaccaaaatcgatggccggactcaggctaatcacgtctccccatatgtcaatccaggcgggagtgaaagagtcccaggctaggaaccaaacaaagcttagaataagccaggctagtctcaggctggcaaattcttctcaagttagaggtagacacacctattgggtggcatggggcaacctgcctagctacggctcacgtcgcctcacacctcggacccctctcatactttctggtctaggcttaggccacatattatctagtacacaccattggcttagtccattgatcagctattctagcctttcaagcatgacaaaatttttgattgattcatcttctgcagtccacactcgtcacgtcgcgtctttggcatcattcgttcgtattctcactcggtccactaagcctggacacaccgttggtgccgcggtccagggaacgagcttgcaccgtgtgcaggcgcgggcgtgcggctcgatgattgtgcctttgttgcggcatggcagaagtgcgccggcgctatcggcctagccaaacggttgcagcagcagctgcaggcagcattgcaatagaccccaacactagcgctggtgttgttgccttatatgtattgcaattggaatatattgagtgtacactgtttttatgcaatctatctattatattattaaaggaataaaaaaaaggagcctccacgttcgctctcatggtctataaattctcatattaatcgaagaaaaagaaaaggcagagtctatatagaaatacaatttagaaatagttgaaatttggaattaaaaaataatgaatattagaagaggagactagagtctgtatagaaatacaatttagaaatagttgaaattcggaattaaaaaataaggaatattagaagaggacactagagtccatatagaaatacaattaggaaataactaaaattcggaattaaaaataaggaatattagaagtagagtatagagtccatatagaaatacaattaagaaaaaaaatagaaattcggaattaaaaataaggaatattagaagtagattatagagtctatataggaatttaaaactaactaaaattcagaataaacataacaaaattaaaagtagagttttaagtccgtataaaaatacaatttacaaataactaaaattcaaaattaagaaaaacatgggaagaagagtttaaagtcaatataggaatacaatttagaagtaactgaaattcgaaattaaaaattaaagaatattgagagatgaatttagagtctacatagaaatacaattagaaataataaaaattcagaaataaaaataaataatattggaagaagagcctagagtctatatagaaatacaatttacagaaaattcggaattaaaaaaaatatgaaaagacgagtctagagtccatataggaatatatataatttacaaataactaaaatttgatattaaaaataattaataactaacacgtatataaaatacaatatgaatattacacatttgtagtttcgtaaagttattgcaaaatttaaaaatttgatgtcattctaaaaaaattgaataatataatgagaaaacatatatgctattatatgagagaaaatataatgatgcttgccgcgcaatctgtgcgggccaccatgctagttgtaatataaactagaaaggtagcccgcgcatatacgcaggcatcttatttgatgttgcttgaatttttattttggatgttttatgtgtgggttaatttttcttttatgttttatgactctcttataaatttgtttttgtcaataattagtttggggttgctttgaacattacatcagtatattggttatgatactctttgaactacccttgcaacatatgaattctaaactaatattacttgaaccgtgcaatcttaaatttatgagaaaatattgtgtcgcaataatagagttgattactattagactatcatttgtactatgtgtgtatcttttttgaatatttagcatatcttattttatagaactttcggttacaaaatttcttttatagtacagattatttgtagattttaggatatatttacttacatttacttctacgcccttctttctttcacatcccatcttctttttgaaaaaaacaatttatctgaaataagtatgtgtggagcatttgtaattggtcagtcaccgcggactaaagtataattttgtttggttaattcttttttttacatcgtatattttcattgcattgattctgatatataagcttcgtatgatttatgttccctaatttaccaaactgagtatgaaacacccatgtaccatttgtttttaataggaattaaagagaaaaaattacaagccctatactccgaatactttaggttattcccatactgtcctaactgctgaataaaatggaccccacattttgagcttgttcatatgatgatataatccatatcactaatttttcatgatttttcataattctcgattgccatgcaaagcaccaatatgacttgctacttttggacattgtagatttaatttaatggtgcatatttatgaaccaataatggatatatagtgatatacctatatactgttctttttcaaacttctcaataatgtttgtaacatacctgtgtacgtccacgtatagagcctgggtggagttgagtttgggaggttaatttttttcctttaagacagatctgatggttgtaaataatagatccattttacttttatcattgtagagttaatttaatttaattattgtgaagttatatgaaagatgataaaatctatatcattaattgtttataatctttataacagtttaaatactatgcaaaagtcagaaaatataacaaaaaatggcatatttcttttcgaagtgaatatggatatttaacactaaatttaaaaagttacatgtatggtttagatgttacagttgtttaattttgtaacacaaattttctaacttaaaatagcttgaaaataggagaaaaagataatgaaaggattgagggagaggggagtacgtactattgtgaatagaattgatttagcgagagagagaattgaacacaagaatgtagagggaatgaatgagcggatttctttattgatcaatgcggtacaatttatagatggggaaggggtggcaaccggagacgcgatggttgggaaccatcgcgtccgttgccaaggagcgcctagggaagaggcgcggttgccttcggttgtgatccatccttttatatggatgagatcaccctgttgtttcataacactccccgtaaagataatcatagaaataattatagttaaatacatcacgtaaaactcctcgaaaacccagtgggaaaaataaggagagaaccgtgatatattattgactatttttagatctctatgagtaaagctcatagtatgatccaaaatagtataatgtctacggttatcatttagtaaaaactctagtggggaaaagccaaatgataagacatataatcttatgttgatattacctcgttaaaaactttggatgagaaaacctaaagggtaaaactcatacaaagggaaaagagtataatatgacgaaaataggttattttccagaggaaagtactccccctgaatcttgcaaatttttaagtcgtctcataccaattccttcgacacatttaaagaatgtggagtatggcagatattttgtgaacaaatcagcaagattatcacatgacttagtttggaagatgtttatctctccatgttgctgaagctcatgaggataaaataatttgggagaaatatgcttagtgatgttgctcttaatataaccagtttccatctgaacaacacaagcggcattatcttcatagataatgctaggttattccaatgaaccaataccacaagatgttaatatgtggttaaccattctgcgaaggcatacacattcacgtgatgcctcatataatgcaattatttcagaatgatttgtggaagtggctaccaaagtatgtttagaagacttccatgaaatagcagttccaccttgtaaaaatacgaatcctgtttgtgatttggcgttgtggggatcaaatagatagccagcatcagtatacccaattaaagtcgaatcctggttctttctaaagaaaagtccaagatctcttgtgccattaagatatcgaaagacattcttaactccggtccaatggcatttggtaggagcagcgctgtatcttgctaatagatttactgagaaagcaatatctggcctcgtactatttgcaaggtacataagtgcgccaatagcactaagatatggaaaatcaggtccaagcacatcctcaccatcttcctttggtctaaatggatctttctccacgtttagagatcgaaccaccataggggttttagaaggatatgacttgtccatattaaatttctccaaaattttctgggtatatgcactttggtgcacaaggattccagaaggtaaatgctcaagttgtagacctaagcataatttggtttgacccaaatccttcatctcaaattccgtctttaaataatgacgtgcttcattaatatcttgtgtattgccaatgatgttgagatcattgacatataccgagataatacaaaatcctgtgggggactttttgataaagacgcacgggcaatcatcatttttagtgtattcctttagtgaaaggaattcacttaatcggttgtaccacatcctgcacgattgttttaagccataaagtgacttctgcaacttaacacaatacatgttacgatttaccttctgattcgggatgttgattccgtcaggaacctttatgtaaatatcagaatcaagtgacccataaaaatatgctgtcactatgtccatcaaatgcataaatagacgattttgtactgccaatgatattaaatatcggaaagttataccactcataactggagagtaagtttcgttgaaatcaacgccaggtttttgcgtaaaaccttgtgctacaagccttgctctatatctcatcacctcattgttttcattctgtttctagacgaaaacccatttgtatcccacagaaaagataccacgaggagtaggcattacagccgagaatacatctcttttgtaaagcgaggctaattctgcgtcaattgcgtccttccatttgttccagtcagagcgcttttggcactcttttatagacctaggttctggatcaacttggaggcaatcagcaattttttcagaaaaattaatgtcgacaattgtagctcttctatcaaaagattctccagtttcagagtagttgatggcaatttcatcaacccttatagactaatcgtgatctatggaaaaattaatgccgacaattgtagctcttctatcaaaagattctccagtttcagagtagttgatggcaatctacaatggttccgaaacaatgtgtctatggtcttccgaattcttagtctcagcattgtgcaccgctgttggtatttcttaacgacattactagaaatataattcccagcaatggcgcagaaacacttatggtatattatggttacagagttcatccgcaagcgcacggatataccattgtagcatttcacctgagagtattccaagggtatcgtatttattttatcccgtgggaagatcatgtagagagaactcaactagtatttatatattacttgtgataatcat

SEQ ID NO: 73626 - DNA, 5891 bp, Oryza sativa
atcgcaaggtgaaccggtttgacattcacaatggtggcgcaccgtgcgctggatctgcacatgacggagttgaggaagatccgatgacgaagtgcaccaggtgacagacctccacctttggggccgggtggaacagatcggcgaggcggccacaagttgaaaattatagtcagtacaggttgtggtcatgtatttactgagaatcctaaatattaaacatgttgttacaagcatttctccaggtggaacagatcagcgaggcagccacaagttgaaaaatatagtctgtacaggttgtggtcaggtatttactgagaatcctaaatattatacatgttgttacaagcatgtggtcaggtataccaactgtagttcacatccttgttcaattcattatatcaaacaaattctctaggtgcgataacgagatcaactatccactactgtaaataatctatattataatgtaatcatccatcaatttgccaatgatgccggtgacaagtaaaagatttattaatgcagccaaaatttaactgtgtaaattaatttggctagcatcaaatagaacataaaaaattatttatcaaagatttatttatggaattaattaattatgaacataaaaaacaagttagcataaaatagaacaccaacaattttggaatgactaatttgaacaggaaatacccctctttactctgaagtagaatatggattctatttcacagtaaacttggcaataatatatacatggatagaaatattatgaatcaacagtgatataaagtccgctccctttccttcgtaccatgtgcaattaagaatgtggtatcacattatgacaataacccagtgattgcaatttcggttcaaaatttcagaaatttctgaatgctcggttcgaaattttcggcagattttctcaattctttgttgaaatttctcaaagtttattcaaattctaaaaaaaatcaatccaaaaagttctgaaaatcaaaaaatttcataaattttggtcctaccaaaattcgcaccaagataaaaagtgcaaaccctgcaataacttaatttgtatttcaaattatgaatagcagagcacatatacgacatcatcaaaataatagccagcactggtatatggataatggtcagaattattgcaggacattaagaactatatgtgcgcttgaaatgaaaaaccttcgacatgaaaaaatagttaacctttaacctagtacagatcaattaccaaaatatttgatttttacaatctagacagactcgagttcctcaaaaagctaagatgatgtgctgcttggttgctgactcagtgactctagtagtctagtttcatacaacagtagcagagctcataaaaaacaacacagtaaaacaatatgccaagacacttgaatggattggaaaacaagacgatgtagaggaggggctgcaagaagttaccaatgaaactgatcttgctaatctggcaatccccaagcagacctgctttgtggctgaccatgtcgttaattcacattcactgccttgcaaatcgtgggcaccactatggctgcaacagtcatggtcgtcccttgggagcagggacagctgggccctgccaacggcgccggcaccccttgcagcggccaagcctgcagtaccagccgatgccctcgccagcacaggaagaccatgcgagcagcccatattcatggagttggacagtacaacagctccctgcagtcctgcacctagggacatggagttgagcaagctgactaattatgtttcaattaagcccgagcaaaactataaaacaaaaccacactgcaatatgaaaaaaactacggagttaagcgtagaagtatcaagcggcgtgcctatgttatgtttccagggatcctttgggaccctgggtaaattagtaaattctagctaaagtacgccatgttaactactataccggtaaatagttacataattcatatgtattggactcttggtattttttgagttcatcactgaaaatatctattagcacaatgcaagcacgtggaaactgtcggcagtacacgacgaccaacattcatggtactaagtgaaagcatcataatacagagaatatcagaagaggcacctttggtctcctcgacaatattatgaagtttctttctcttgggcatctcttcatagtacttcagtttaagatcttcacactgcacaactgcagcaaaaaaaaacaaaatgtttacaaactttttcatcaaatactctaaaacctttacaataatgcaactgatggatattacctaatgcttgaacagcccctaccatcttactcagttcaggaacagcgtttgcatggccatgtgcttcaagagatagcaatgtttgctcttgtttcatgacctgaaaattaaaaagtgatataatcagtaaaacatagcacctaatgtatttatcaattcagtaaatctgcttttaccttgattttattttccaagttagatatggcagctgcccataatttattggcattttcatacttttgggaaacacttctcagttgatcagcttgtctatcaaggacttgttctgtcaggaacgtaaaacagtggtgagcatacagaaacatcttatctgaaaattagaccttgaaggagtaagttgaatctaatatattgtgtcttacctgctattgctaccgttttcgaatacaaatggcacaaaccatgggactttcccttactcctttgaagtttatgacaaaggtgccattactctcaactgtcaccctaatatcatgcatatgaaggggtctgttacctcccaccactgcatacacatcaaattcagacaaaatctgtgcatcaatcaaaagtcaaattgtttagctaaacctgaaagtaaattgtgatacaaaattaagagtctcatgaatactgtgtttgcattttcttcttgcacaaggacatcaaatgccctaattccttttggcccgtaagtgttcactatctcagcaaatgcagatgatagaaatagtctccaggagcaagaccatcgattttctagctggaatttccatatcgaactgagtggtaaagcaagggatagtcaccacttcaaattatatcctcagatgtcaatattgcatcccctccttcgaagaaagattcgtcagaaagctttgaagagggttcacaaccctcaattgcacagccaccggcattaatgaacagaacaaagtctcatcacaggcacaagaaggataataagaaacattgtggaactatgatggcatgaccaattaacatttcgataaggtacttccaattttcaatttagaattcaagattatgaaatatccattttggaagcacatgactgatgatggctatcgaagccccttctactcgatattactacagcaccacaattgatgaaaccttgtactctgacatagaaacaatcctattttcttcaaccaatccaatgcccatgactttagtactatatggtgtattattcattcactttgagagcatcaaatgaggccagcacactgatccacttaaaaatagtagctaacatggcagagaatcaagtcaatgaagaacccacaattttaagaagagaaacattactctatcaaatattcaaatctactccaaagaacctaaatcgacgcataaaagttagagcagtatgcaaatgattccacatatagatgattcctgttacatggagataccttattaagctcctagcataccacaacacctgaaggcctcaaaattgggattacaactttggaaccgatgtaggtaaagcaccagaaaataccaaatctgggtacatccaacctcctaaatttcctctgccacatgcgcacacgcacacacacaagaaaaataagagcaaatttggaagcaaactttctagggttttctaccagagccaaatcgagtactccaattcgaccatcctaaacgctcatttcccaaaaaccctttcacgaacatggtgggagggttaggatttaggaatagatcctcacctagctgctagaaccaccattgctgatcaaatgcacatagatttgcaggaatcccaccgcgggaagagggagagaggaggggacgactccgccgccgccaccgccgccgccgccgcggcgccggcgcagggccaggtggtggccgcctccgcctcgctaggattcgcggcgtgaggaggagaggagagtgagagagaggaaaaggttttttctttctttttttttttgacgggagaaaatatgaccgttttttttttgacgggagaaaatattaccgttgctttgagaggatagtgatagagaggaaaaggttttttctttcttttttttgacgggagaaaatatgaccgtttttttttacgggagaaaatatgaccgttgctttaagaggagagtgagagagatgaaaaaggttttttctttcttttttttatgaggactagaaagaaaatatgaccgttgctttaagaggagagtgagagagaggaaaaggttttttttaataggactagaaaatatgcccgttgcaacggattcattagaaactaaatatttagctacttaagaaatctaggatgtttttctcagttgttcctctgaaggtcctttgtcggtcatatatgtgcgatgtgtgtagagggaccgggtagtacagtccgacagagtctgcaaccggaccattccgaaattctcaacttgagcacgaaggtgaaagaactttaatttgtcagcaaattggaccctaaatccattcaaataaaatcattagatagatccacgggatttcaccataaagaaatagataaattgaagctaaaattgtgcatgagtgcgagtgacaagagtgtacgacaacttatgtcgagacagcttcggccaagtagaacttgtccgccaccgcaactgcatattgcagtctttcacttggttatctgtctcacacaccaccgctatcgcaggcccatggcagtcgtgctagtagcgccatcatcagcgaggtgcaccgcacggatctcctaggccactcgacgtgggtgatgtaagcggatatgcggggaactgattgagcagggctgcggtttgcgagggactcgactggtgtttgatactaatgaaaatgaatattaagtaagggcatgaaaaacaagaagctattagcatatgattaattaagttttaattattgcaaatttgaaaaatgaatttatttgatattttataccaacttctatatagaaagttttcacacgaaacatgccattgcccatttagtagtttgaaaagtgtgctaatagaaaccaaggtgaaatttgcatctaaatgaaaaaagaaccggctattgctgtgtcagtgtgttatcctgatatattttgtcgtggattgatcgagtattcaatcaagtttcatacgtattttgttaccgtcgctacaatagaaaccatctttcgtagcaacacccttttattcgtactggcggatttaataaatgcgcgcttgtaaatatacttaagacggattgcggtcaccaactttcgctggcggccacttaagatatttttacaagcggatctcttaagcgactgccagcgctggcggtcactaaagagcaccgcctttaaaatcggccgtggtgcattaaaaaaccacgcatagcaaatatcctcagatccactcctcattctcctctcctcagatcgacacctctcctcttctcctccctcactaacgcaccaccgcctcactcctctcctcccttcccaccggcggcgggtccaatggcggcggctccggcgacgacaaaggggaggggtggtggcggtgaccggtggcg

SEQ ID NO: 73627 - DNA, 1925 bp, Oryza sativa
attttttttctcctttatttttcgttgacgaaagccagcagaaatgaaaaatgggtgagcagtgagctcatttattgtacaaaggaaaggaaaaaaaggggttgctttcctctaattttaaatttgatttatcatatttgcaatagcgtccaaggaccaagaccataaaacattcccttccttttttaaatgaggataacctaaaaaaaatgtcattgacaagcgtccaaatacaaaaaaatatcatcgataagtgtgagttctaaaaaataccattgtacaaacaattttatcaaaaatgtcatcgtcattatgattcctttcattccgctatgttaagtgtaataggacgaacaatgtatttaacagcgtagaatagacggaattttaacggtgatggtatttttaggataaaatcgtttgttcgatggtatttttttaaaacccacacgttgatggtatttcttagatttaaacgttcgtcaatggcattttttaattatctcttaattaaacctcatcaatcaaagtgttgtgttaagcatacatgtggatatgcaacgatgtccacatgcacgatcaaacagacatgtaactacagcatttactcctacacacatggataaatagacatgcaactattgcatttacttctgcataaataaacaaatagacaggttagatgatgatcaatttgaaaagatctcttaagagtgtggtcagaaggaggggttgggtacgtattattgcacaattaattaaatattagctattttttaaaaaaatagattaatatgattttttaaaacaactttcgtatagaatttttttaaaaaaacacaccatttagcagtttaaaaaacgtacacgcggaaaacaagataggtgagttaggaaaactgagataagaactctgtgcaaaggattaaaatgggatggagtactgctgtgcgcagtttcggtttccaattatggccaaacagagattatgacgagtgggaccctggataaggtgtcgcaggcgtggtggttggtggggccaggtccaatattttgttttttttttgcgaatattgggcctcattgggaccgttgcatgagtagaccatcttcttattctacatgggccaccgcataacccactaactaagtttcctgcaaagtgagctgtagccccgtgcactgtgccggcccatctcgtgtcagatggggccgtcagtcacgtgtacatccgaaagcgaattttttttatttttaatttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcgagggggcctggaattttgcaggcggcccccttgccgccctgggggagggcgattttatactgtgctttatattttttataaatatcaatagttatcaaaattttttatattgaaaactatataagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgttttt

SEQ ID NO: 73628 - DNA, 9815 bp, Oryza sativa
  unsure (1)..(9815): unsure at all n locations
agatcgaaatcatcatcaacaaatcaatcggcatagccttgtcttcaaatcgagtccgattgccatctcgtcggctgatgcctcaatatctctcggttggatttggacaagtctcagaggaatacgagccctgcatgtacagcacgcacatgcacacaagtgctgtatgcacggctgtgcacgtggaggccaacactcagagcaccgatacatacgatgaccgaccgaggacatcccgacgtgacacatgcacgtcatccgaggtaattagtgagattgattttttaaattgatctactaattttgtagatacatccggcatatatgtacaaagatatttttcaggaacaactgagcactcgagtaggttgtggtcaagtacaccgtattatcgagaacgatctcgacaaatgcaaagtcgtcgcgcccccaacccaccaacgaagagcaacgacctatctcatagcaccggtcatgcctggactactcgaggaaaggttgttaacggataattcctcgcgaacgccgtcggcttgatcaccagacatgattgcgaacggacatccggatatgctacaagttgggtgtgtgagtcatgctggctatatgagacgcacataataaaccaactctagcacttccattggtgttggagagataactctacacgttcgctggtcctcgaaccagtacgtagcaatctctctcaccgcaactttcattagtgttcgagagataactctacacgttcgctggtcctcgaaccagtgcgtagcaatctctcgcaccgcaacctccattggtgttcgagatataactctacacgttcgctggtcctcgaaccagtacgtagcaatctctcgcaccgcaaacgtccattggttttcgagacataattctactcgctcgctggttctcgaaccaatacatagcaatctctcgcaccgcaacctccattggtgtttgagagataattctactcgctcgctggtcctcgaaccagtacgtagcaatctctcgcactgcaacctccattggtattcgagagataattttactcgctcgctcgttctcgaactagtacgtagcaatctctcacaccgcaacttccattggtgttcgagagataattctactcgctcgctggtcctcgaaccagtacatagcaatctcttgcaccgcaacttccattggtgttcgagagataattctactcactcgctagttctcgaactagtaaaacgtagcaatctctcgcaccttaacttcagatggtcgaggtacgactacagcaataatgcagcggtcctcgcaccatgacttcagatggttgagaaacagctacgactagtcttcgaccggcagcgttgcggtcctcgtaccatgactccaaatgaccgagagacacctactcactggttctcaaccagtcaatcgtagcgatctctcgtacatttacttctagtggtcgagtttagactacatctggttctcgaccagcggtgtagcgattctcccactatttctacttctagtggtcgagtttagactacatctggttctcgaccagcggtgtagcgattctcccactatttctacttctagtggtcgagttgcgactaccacctggtcctctactccaacaaagttgacatcagatacacaatatcaccaagggttttacccagagatcccttgccacgataacacctagcgttgaaacctatcctactgtccctttacgccgtcttgacaaggcctccgaggaacctaagggaacttcggctggggacgcccagagccgataaggccttgtcggatcctgtagaaacaaaagaccatgtaagatctggtcgtgtaagagttctcgccgtgcgtattaaccaaaccgtgtaatcggaaattgagttttccaacttcacggctgggagctaggatcagtgcttattcaactgaggcaggtcaaaggtccaagagccttatcatccgagaacgattctccgacgacaaggctgggggctagggagagtgtatgactctacaaactgactggtcggagtcggtaagagagaagacgctcatatacaaaacactggaaaattctattcgacattgacgaaggctccatgtctcaatggttgtacaccaagatcgactaaggcgagtatgacaaatgtcgacaaagctccgtcgcaaattctgtgccttctcgatcactcgagaacggttggtggatctcgacaaggaatacggaatggagagatggtgtacccgccgagataaatttcttgacttcaatccaaattctcgattacagcaagacgggagacttagtcgtacgctctgtactttcttggttgacgtcggagattgactcagactaaccctttaggtgtccgcacgaggctgataaaggaagtctaacattatctctaaactcaccgagaacggtcacgtaagctcgataacagttcctccaaagtctgcggttgagaatatgaactcgttcatttgcatcgaagtcgggggctactgtcagggttatggataccacatacctaatagtagttgactaaatctcggcaggatccaccacataccatgtcttatacggaaactgacgtcgagggagttccggataaggaaagacaactagagttctacatggaaacgacaaggactactcggattgtatccatattgatttccctagttctacttggacaaggggacacctatgggtataaatacaagacccctaaggaagagagagggggaccacctcaatcaacaccgccacaatctacggaacaatagatcaagacagaagatcaatatagaagcctacatacgccaagacacgccgccggatatcgacttcagggataagcatggctagtaccctacggtgtctctggatactgtcaggagagacgaaaccgctatctctgatctcgccgggcacggattcgaggaggaaggctaccctgttgtcgactacgagtcagatcgtcagactgccatgtcgacaacagttagataggctacctcaaatattgtacttatatgattatggtgaataagagcaacgaccggctttggccaacaggatgtagggctattacctgacaattcaggggcccgaacctgtataaaaattctcgtctccgtctcttttacctcagtctcgcgtatatcctagcaccgacgatccccatactatgcaaatatcagaattgcgacatcaaacgtcgacagtgtatgatatcaacccttcattggaggcaagtgaatgtagctgtggtttgttacgtttttaacaagttatttttccaacctccaccttgagactttaataccagcaatctattcctatactaatttggcactttttagaagctctcacgttaattagaaagatctgaccattaatccacccgatggtaatatcatgaccatatattataacgcgtatttaacatgggctttcgtttagaacgaatttattacatacgtgttccaaaagcccatttgatatacaagtgtattgaccaatccatatcgtatctcaccatctctaacttcctacgtacttacacggtcgtttcaattgtttccagtcgcttttcatcatgatcatgcacacgcggccgttaagatgttgccatgttgatcaacaaaatcgatacttcatggacgatgcatcttcctgacgatgattagatcgcgggcatcaaactcggcggattcttgcagtagtagtttctgctgcagaaacaccgccttcccgagcgagcggccgctgagatgaacacatctccttcgtgatcgccggttcgaatctcctggccacacgccggcacagtgaagtatagtttcgttaatcattccagattccaccatctataatttaagtgacgcttctaatgacaggcatatgcttgcatcatgtatgcagttctgctgcagaacccgtgcaacaaagccatggccatctagaaagcatattagcatagatcaatgacatggtgatcgtggaagatttctttaaaaatatggtcataggcgggtgaatgaaggatgcaaaacaggagtaatagttgtgattaatttaccaattttgtgagcaaaccaggttaggtgcttttcttccttttgtcttaatttaaatatgcattttcctttgcaatcttaactaataaatttcaagcgaaggcatcattagttggttgtgtgtgtagttcacaagcacttactattagtttggtttaattcatgcccttaggttttctttatcttgcttttgagctacacccatgatcagagctattattatattgtaaccttagcttctcataaaaatttaactctcagaattactaaattttcaaattactgaaccatgaagtatgaataaagttgcatttattaattcatttgaactataaaaacatattttgtaactattaatttcagaagttcatttgaatatgaatactatacgtatccaaatgataatttctcatatataacttgcattaaaattagtactaatgttaactttacaaatatatgaaattttaatagcatgtgtgaaaatacatacatagaaccgtcttccaaaataatcgaccatctacccactttatgcagatcgatcaattaaaaggtgtgaagaatcaaataatttcaaactaagagttcctgttaaataattaaacatgccatataagttttggttactggtgtgaaatatggagttctatatatctatcttggtttctcaatatggctcttcgttaatttaatttcgaaattaaaaattaataattaacaaattgtaacctacacgactcttctttcactctacttcataatccgctataatatagatataaatttagcattaataaatagggagttgtacctatcatggattctcattaccaacatattcagcacaaaaaaatccacaaaatcaatagtaatagcccatgcaatgcatgggttggcggctagttcacatcattttttatggtctgagaataaaccgtacaacananactcaatatttctttgtgcgtgccgttgttgtgtctgttccaatcattttggatcaatactaggcaataaacttctactttaaattgttatctatctttacaacaactatatttcaaatttcttagtgtatgtttatcccacgaagctccataaagaaatcgccatttacgttaatttgggtatattgtctttgcttaaccacatcacacaattaccggctcacatattaattttgtaacccatagggaatacataaaagctttgattggtcagagagggtgaggatgtgagagttttcacatctactttgctacttgctgtactaacaatggcagaaagaaggtacactgatcacacattttataaaaaagaactgatctcgaggtgtatcttgaatgggtaaatcaaatggagattgaacatgactaccaatgcttttgtgaagagtagttgcaacaagctactattgaatttcaaaaatatgcatgtacttggtggaaacgatttcctcataagtgctttaccaagtcttaggaagatttgtagaaagtgatgagaaaagaatttatcccaagagagtatgcgctaatttcacttcgccatttgaagcatggtcaagcaaggtagtaaatctactcaagcttattatggcaagttgtgttcttccatgtgtcgagcaaatattattgatgagataaatgcaattgagtatttcaagacatatatcaatcctagaattgttgccgcaattgatgaaaaatatgtaagaagtgtgtgaggtttcttaagctatgccatcaacaaagaaaaaatatgtccttatgcgcaataaatcaaagatgttatagaattcctcctaaaggattcagtagccatagcatgaaagaatttagtattctccccaccaaattttgcccacctaatagtacatattttctgccaatatgtttgcttatacatcaagtaggtcatcagtttgcttctgataaagactatgtattttcaccccaagacagtaagatctccgagctcttctatactgtctataaaatgaatggttgcattacaattcttgatcaattcttgcaaccttgaaagatttttgctctattttttaaggtcttttctcaatgccttaagcttagcagtaatattcctagcaggatcaaggggactgccatgattatcccaaattgtttgcaccaagtcaaaaaggccctcatgctccacccagtaactctcaaatctaaaggtatgtgctttaggtatatttatcacaatatgcaccacacaagggatatgatccgaaaaactattcttgacaatggctttaccattgtgttagggtaggaaagagtccaattcatgggagagttcaatagatacaacaaaggttgatgttgcatgtaacttcaggtgtaagccatacctttaattggaagttcaaaaaacccaaagagctaatgacctcattaaaaggaaaaatatcattcatgtcagctctaggtctatttctgttcagaacagaacaataaaagatgatctaagtctccaagaagaagttgtacaatcttgtcacattggtaaaataatgtgattcagccaaagcaatgcgagcaacctcttgagcttgatgattagtttattttgagtaaatttcactttaggttacattttattactattttttcattttggactaccctttaaaattatttattgaaagatcttgtttttttaaaaaaaagtattaaaagagttgaataatttagtaatttcttgtccaccacatgcatcaagcaaaaacaagcccagatccatgcatcttctccttgacgatggtgtcaaaacactccaccatttccggcgtcatgtggattttccagtctccggccttccctttccggaagtatgacgcattcgggaaggcgaacgatgcctctcccatcttattcacctccaagctcttcaggttctcgaagctgcacagcctcacaatatctgtcaccagtccagcttcttcctcggtcgatgagaacggctggccaagaaagtcggcgagcttcctgacgatgtttgccggatctcgcagaaggtcctcatagaccagaaacaggaccttctctgggttcgccttgcaagcattccagtagccaataatgtgatcccagatagcgccggtcaagaacttgccatcgcaggcagcctcgaacacttcttgaaatgaaagatcaggctctataattctgaagaagtgccaggctgagaccaggatatccttcggctccctgcaatttgctaatttgttagcaattttagaagagtaaaacccaacgaaaaatatgagaatcatgagacagaggttcgaattgtcaatgataatctggtgcctggtatcagtactgatatatcatccaataaaaaattgtttgccagcagcgaagcttgaatgttgaaatgctaaaagggcatgtttgatcgggccaatagcgttatttttttttttttgaaaatttgctaaagctaaagtaaatttagtgtaaaattttgatgacatgggaaggcatagcccctatcgcctcccctctgtctccgtcattgttgtttgcactatgccggtcatcaatcatccatgttgaactggctagaagcatgcccagatcgatacaaaagaaccagatataagagaaatattctgaaagagggtaccaactagatataagaaatttacctgcaaatataaacaaccttgcagccaggttcatctgcaatggacttgggtagagcagcgtgctgcatgtgggtggacatgagcctcggcgacggcagctcatcaatcttaccaccccatccttcagagatcgccccctccatgaacgggacgcagtcgtgcgggttaagacggaggagcggatgccggtcactggcaggggagtaggcgccgcgcgccaagacggcgaaggcgagcgccttgagccaggtggtgccgcacttaccggggctcgcgaggacgacgtcgccatggcggcgcggcacgaagctccgctggatggccatgatccctggaagggtgtactccatcagccacatgccctggtagtgccgcaggcgcagcttgggatagctcgggaggctggacacgacgccggcatactcctcctccggtgaggatcgctgtgccattgcgtctccgatgacgtccttgaacggcacggggccaatggcgccatgttgtggcttgctgggggctgccattctgcctgcatcaactggcaagggaatggaccaataaatatagaggagacgatggagagtaccaaacaagatactgaagatagacttatcaacttgacattggcattgatcggtttctgaaaatcttatgcacccatgtcaaatgtcggatgacacagctagcttaattaggctgtgtttggaaaatgtggttaggaactaatcccctgtgcacgtaaaatagagcaatcgttagcatatgattaattaagtattagcttgaaaaacttgaaaaaaaaaattagtacgattttttcaaacaactttcatataaaattctttttttttttgcaaaagaacacaccatttagctatttaggaaacgagggagtagtagttgagaaacctagattaccaaactcagccatatagtgaccacctctgtcacaaaattaatcaattactactatagtttaaagttagtctcaaaataaatcccttttacattttttatcctctcaactatcctcaattcagcaattaactgttttatctcttcaaagctactcacccaccaatactacttcttattaacaatgggcagggtaatatttttttttaccactagagttttcatcggatacaagactagctatgatttattatggacagagggagtagttaggacattttggctgtgttctttctagtgagttcccaacatcaactgcaccatgtggcttgctggggctgccatactgcctacatcaactgacacgggaatggaccaataaatacagtcccataatataagggattttaacttttttgtttacactgtttgaccattcgtcttattcgaaaagtttatgcaaatataaaaaacgaaaagttatgcttaaaatactttgaataataaagtaagtcacaaataaatgaaataaataataatccaaaattttttgaataagataaatggtcaaacagtgtaagagaaagtcaaaatctcttatattagtggatgaagggagtagtagtagagaaaacggagagtaccaaattaaagatagacttatcaacatgacattggcattaattgatcggtttccaaaaatcttgtgcggccatgacagatgacagctaacttagccactgccaccgtcagaaacacgggtggaaaaaccatctttcgtcggtccggcaaaattcacaatagtcccggatccaaaaagaatcgggactaaagattgtttttagtcccggttataaaaattttgatctaccaaccaggactaaagacgatctttagtcctggtttatcccttgtcagatgtatgtcagggggtcgaggatctttagtcccggttggtgtcaataaccgggactaaagatcaccactttagtcacggttggtactaccaaccgggactaaagataaagatgatctttagtcccggttggtactaacaaccgggactacaattaaacacgttgtatataatccctatcccttatcc

SEQ ID NO: 73629 - DNA, 20166 bp, Oryza sativa
ctcagggaagattcctcaataagggggtgaaaggggtaaaaatcaacaaaggattacgccccatttaaaaatggaccttcggttccttcgtagttcaccatgtttcatttatcttctttgatggggttataaatctggccgattcttaatcctttattggatggtaccttcgaaccttttccaaaacctttgtattaattttattgtggtgcttaaacttcccattattttcttacacttgaattttcccatattggattccccttttgggtttgtgcataggcttatctttatgcaacttgccttgattcaggcttcgttggagtcaagctccaagcctttgccattgcccattggcatcacaagtagcctaagggtgtgttcggacttccaggttcccaacccctcttcctcgttttccgcgcgcacgtttttcaaactgctaaacgtatgaaagttgcttaaaaaaacaaattaatccatttttgaaaaaaatagctaatacttaatttatcacgtgctaatgaaccgctccgttttccgtgcgctgagataggttcccaacttcctccagcgaacacactctaaggaggactcaatcattttctatactctttttaagtcatgttctgcaaaatgctgataaaaggtgtaatttgctcattcttgtggggcttcttttgcaaaatgggatgagtgaacgcactgttaccacccatgtattttgtttatagtctttataaaaaaaaacaaatgcacgagtttaagaaaatctacaaagaatgaatctaaccaactgacctacacgactttggtcaagattttatttaaattcatgataagatcatggaactacctatatttcagtctacataattctcaaccaaaatcagtccatttttattcttcatggttcacaacaaactattatatagaaataatatcatgcattaaaaacataagaagttgtaaaatcataccatcaaactataatcaatagaaaagttcccaagtaattaacttaaaaaatcagtaaaatattccaagagctaaaacacaataagtgtttctatcaatccaaaatcctccattaaagagttataaaggacacctttcccaatactttcccaggagatagtgaggacacctcgcctgcatgtagggctgtcgagctcgagcgagctcgtctacccaagctcgagctcgacacaagctcgagccgagcctattacaccttcgagcttttaggaaagttcggttcgagcttgttcgtgctcggccacaagtagtataatatagtagtatattttaattatcatttctggataaatataattattttctatttgatcactctaataaaagagtagaaaaggactaagataaatatattatactaacacatgctaatttattgtctaaatatatactaatataaattgatatattagtttattaaattaataggaagaataaacaatatgaactatacacagtcaagttcggtagaagttcgagctctattcggtaaagcttgcaggcttttgctcaggctcggatttggctcgtttggagctcgagcctaggacgagtctagcttgagctgctcgcaagccttgagcttttttttttgacagccctacctagatgacacatatcccattagatcagatatatttttctattttgattagaggagatggttccgaaatcacatcttatagttacggtaatatagctttgttattcacatgagaaatgatctttcggacaccatcgtctgatttttggtatatacagttagtcatgaagcgctgcaagtgttagcacctatattctatatatactttcctgcaatttatttaccaaccgtctgtttgcatgtgtgggacataatcttattgttaataacatagtaagatgctaattgcatgagtaccttactgctagtcatgcccttcattggaaacatattatgatataacgaaaagttaaccttgcaaataatactcgttgttagttttttttttcttgaagaacaatcatatatattggccatgactgcatgatccaattgttaaaatgcaatccgatttttcccaatttctcctatgccactagattcaagtgtgagtgtgtgacttacagaaatgtcaacttgatgttataattaacagctcaggcggttggatgttgaaaaaaaaatcatccaaaaaaccctttattccttttcacatatgaataaggtgttagattgatctcttgccaccgagtcagagaattgcgctaatgggcttgcccacccacgcccacacgtacctaacgatgaggactgattccctcggtcctgagcgcacgttgctctctatcgcgcgatgatcggacgcgctatctacgtaacgtcgcccccgatcccctcaacgcacacacaattatctttttttttctttatgcaagaaacattatactttaggacggtagatagcactatacctcatacctcatctttttcttaaattaccctaacaaacctttttcttaattttttatcattattttcataggtcggaagcacctacggctaatttaattatcgagatttaaactacatgaaacatttcatgaagaatcttgaaaatgttttttttaacatagattaattatgttgtcaatatggatatacaaaatttgaacgtaaattttatattgggaaaaaaaatcaaacaatgctgcacggaagcaaagtggagccactttatttagtttaaactccagtggtaaaaaagctcaaaaattgtcaagctaaattacatagacttgcatagttacatagtgcgtgcatctccttgcgaaaatggttagcgaaaactgtctagagagattcacaagtttaaaattaattagagagtaagctcatcaaaataagagaatcaatcgacccactgaccactatgtagtagttgaacctaacaaaacaatgtgaacggtcaatttcgttatacataagtaccacaactatttgtttttctccgatatctcatatggcacatgtgatttcaaagagagatatatctgcaaatcaaaattacatctccagcttcacctttatggtgtggaagaagctaactaaataacctcatgctttgatggagcataccagccagctactctgctcatctaagttgtgcctaacgttcatgatcactacgttgatgtctatctatggccaactctcacatctttcaggatgtgtaaccttttttcaggtagctagaatatacgaagtagaacgaagtgtgtgccactctcaaatgcagacagacggttggacatgggtgatgatgcgatttgtctagttatgtcttctgccggctataacatggaggccgctcacatatccagttcgtgccctgttactaaatactgacctcccataagtgataagtttgtcatttgtcattgataactgccggctataccatcaaggtgacctaaagattggattactaagaaaatatggactaacaaaatggaaaaacacatgccggtcaaaaaaaattaaggtggactaggtatccataaccttaatatcaaaaatagatgcttgtgaagcaaatgactttctagttggttaatggtggaggtgtatgacaagactttttacgaaataataaatacatgaaggataaacttctctctatatgtctagcaacacaggtatttttttagtcctggaccggtctaattaaagttaaagatcaatttctaatatttgggtcttttagatgtggcaatgagacaaacataagattttggaaagacacgtggttgggattgcgtactttcaaagttcaataccctactttatataatgtgactcgaagtctactgccgcagaggttatgaccacaatgctgttgaatatttttttggagagccattgttggctaaagctaattgagtggaatggtttgattcttaggctagctaatataactgtcaaatgaaaaatactgctttgttggtagctccataagaacttatggccaattttcagtctctaatgttaggatccaaatgaatattctatgggactttatatggtttctttacaagaaagtaattctaacgaaggataacctgactaaaagaaaatgggggcagacaaacattgttccttctgccatgcacaagagataatccaaatcttttctttgagtgtcatattgcccagttttttttggagatgtgtgttttttttcttttaatatgcctctaccccgtaacacaaaaaatatttttggtaattggcttaaaggggtatctacgtctataaaaaagatgattataattggagctaatgatgtatatcggtcaatttagtgtcgttgtaatgatcaagtttttaattgtaaataattatctaaccctatgcaggttattttcatgtctttctattgtcttaatttttggtctacgatgctacaataggggaagcatgatacaatgtgcaatggtgctatacttttggtatcggtagctaatggtctcttattctattataggtgacttagtttcattagaattgctagctaataaaatatatgtggtttaactctagtcaataataaaggagagttagggatttgtcccatcaccttatgttttatttttacctttaccttttttttttaacaaacttatgcctatatatcttatgacaaaaatcgaaggtgtaatacattttcattattaaaaaaaataacatcaaaggctgctcacggctcacctcgccagttcatgcgctgttactaaatgaatattggcatccaaaaagtttgtaattttttactcaatacccaactgcttggatggagactactcacctgcgctgccctgtttgtttggctccgacatctataaggccaaataggccacctggctcggcacgacccatgcacgaccaggcctgggccgaggtcagtcggccggcacggtccgacctacacgtggggccagtccgtgcttgtccacgggctgcacccacggtccaataagactcgggccgtgccgggctggtccaaaggcacgacaacttatcgtgcttttctatagaataagtctatttttcctctctcatctctttggatggtgtcttatatggttggataagtctattttgtatctctcttttctttgggccgtgcattttatagctgaattaagtttattttggtcccttaactatttttcttgatcgcgtcgggctgggccggcccaccgtgctaaggctcggctcaggcatagcccaactgttggcatgggcccgacaccagtcataccgtgccatgtttgagcctggctctcgagccttatggccatctatgccgacatcttatctcactggatagaggaaacactcgtagctagcttaccttctggcttcatgaacaaaagatcgatcagatcaaagaaacgcttcccctcgagacttctatcataattgctacttcaatgccatctctttctacttcaattgcggtagacaccgcctgatctagatatcttcatagttcatcgtcaatccagttgcctcagggttttggctaacttagctgcatgtaaaaaaagaaacgtaataagcatatagttaattgaatattaattattaataaaaaattaaaataattctttaaagcatcttttatctacctctataaccgtgacgccgacgccatggcgtcatcacgcgcgtatacgcctaaaccgcggttgcccgcgtggctcgacgccacaaaaataccaactccgtcgtctatgtcaactttagtagcattgcatgcaagacgcccaagtacttgttcaaggtcggccatggcctagaggacaccggcaagccatttctatgggtagtgaagaagtcggaggtagctgcgtggaaacgagccgagccgtaaagtaaaataatcgatataaaaagatggtggtctaggctccgaaacaagcggctcacaagccagcttgggctcggctcatttcagcaacgagctgaaaaggaggcttggggttgtctcgtttggcttacgagccgagccaagcccgagctgagctcatgagcctgagccttttttccatcactgcatcgaaggtagaagaatggatgtcggccctagagatgtttgggatgacactcaccacatgtaagttgggtccgcgtgctcacgtcttactttctgtacccaataaaaggaggaagaaacagagaaaatgttgcaagtggcatacactcgccacacgcaagttaggcctgcgtgctcacgtattactttctctacgcaataaaaggaggaagaaacaaagaaaaaaaatggcaaaatttgttacaggacacgtaaaaaacgtgtaattagctgaggaacaccgcaaaattatgacactgccctaggatactacaaaatttgtgtaatttgttgaggcacaccgaacgcattattttatcatttcccggctgaaagtggcgatatttttttgaaatgcctagattgcccccgcgtcactccaccgaacgaaaaatccccagtccctaaccctagcttgcgacggcgacggtggcggaggaggcttcggcggcgcatgctaacgcggtgatggaggaccaggcgtaggtcatggcgtcacccagcgacacgcttgccggcgtctatgatggccatggcggccccgacgcctcccgctttcttcgctcccgcctcttccctttcgtccatggtgcgtgcgctcgccggcgcgtgcgcggcggagctccatcttttactttgatttgttaaggttctgagaatctttagttgatttgttggcgccaaaaattgaacagagttcgcggcgttgtgcaacggcgtggtggacgctgacgtgattaggaaggcgttcctggcggccgacgaggagtactagcagctgttgcggtggtcactgccgaacatgtcccgcgcggccgcctcgggctcctgctgcctcctgggcgccatctccggcaacatgctctacgtcaccaacgccggcgactcctgcaccgtcctcggccgccgcgcggcagccgattagaccgtctccgagcggctctctactgagcacaacgtggcctcggaggaggtccggagggagctcgccgcgctccaccccgacaacggcgaggtcgtggtccacgcccgcggcacgtggagggtgaaggggatcgtccaggtggcgcgtgccatcggcgacgtgtacctcaagacgccggagttcaagcacgacccagcggtgtagcggctttgtagctgctgtgctggcagcgccgccgccgtcgagctggggcaacatatagtatagagggtaacgcaggggcaatctgggcatttagaaaaaaaatatctgtcacttttaaccgggacatgataaaaataatatgttcggtgtccctcagcaaattactcaaattttgtagtgttctagagtaatatcatggtttttcggtgtctctcaactatttacatgtttttttacgtgtcctatagcaaattttgcaaaaaaaataaaaatcctgtgtttatcgtgttcactgtgattgtttgtgctcttctccttcgcgtccaagctcgtgtgtgttgcatggtttcgctacaaccgccgggtttcgctgacagctgcccttttcaatggggaagttgtactactccctccataccctaatataagagattttaacattttaattgcactgtttaatcattcgtcttattttaaaattttttggtattattatttattttatttatgacttactttattatccaaagtattttcagcacaacttttcattttttatatttgcacaaattttttaaataagacgagtgatcaaacagtgcaagcaaattaaaatcccttgtattaaggaaaggagggagtagtaattttcgttggcattagttatttaaggcttgttcactttgctaccatttttaactttacattttttttgataaagttatcgaaaaagtggctatatttagtttgttgctaaattttagtaagtacatatgaaatcttaccaaaattttgataaccttactaaaatttagaaaaatggtagcaaagtgaataagctttactttcatagatgcatgcatttttgctggctgcagagaattcatcatgcacatcaattgagtcacccgtcattctatttggatttggggtgtgtttagttctttgagtgtaaatttttttaagtatacggatacacatttgaagtattaaatatatactaataacaaaacaaattacagattccgcctgtaaaccgcgagacgaatttattaagcctaattaatccgtcattagcaaatgtttactttagcatcacattgtcaaatcatgatgtaattagactcaaaagatccgtatcacaacttacatccaaactgtgcaattagtttttttttctcacatttagtgtctatgcatgtgtccaaatatttaatgtgatgtttttggccaaaattttttaatctaaacaaggccttgacggcgtctcaccttcattgcttcatccaaatggtcaccttgaaattaatgttgaccacattcaattcatgcacgtagtactactctatccgtcaaaaaaaaaaggcaaaccctgagtttccgtgtctaactttgactgtccgtcttatatgaaattcttttataattcttatttttattgttgttagatgataaaacataattaatattttatgcgtgacttgtctttttaatttttttcataattttttcaaataagacggacggtcaaatattgggtacagaaaccaggatttgtctttttttttttgacggagggagtaggttctagcaagtctgccagtcctgccactagctaacggagtacagtgacaaattttagatgtactccatattaatctaaaattaatgcacttgtacaaaactagaacatgaatatatttctttttaacagaacccccaacaaaggaactcctgcaccatccgtcatccacaaccatatatttttaataaaagttaaacgacacaagatatgaaaaaaacagaaaacaaattcccgataataagttactggtaaaatgaaaacaataaatttgtaaatcataatagtagtataactcggtgaccaaaatatcaatcttataccctccttccctaaatgtttgacgccgctgactttttaaaatatgtttaaccgttcatcttattcaaaaacttttgtgaatattattaaaaaacttgagtagtagtagtatatttaacaatgaattaaatgataggaaaataattaataattgtttaaattttttaataagacgaacggtcaaatatgtttaaaaaagtctaacgacgtcgaatatttagtgacggagggagtatatgggtctattgatatagtatcgcgatgacacaccgatggacacgttggagcaacaacgataatgtagtgcgcctaacaaaaaaaagtttagaagagagcgaaaatgtagtgagggcaagttttataataggtgactaccatatctaattttatgcatgacatatataattaaattaagatgtgatatgtataataggttacctctaccacacaatctccaatttctttaacactctcacatatttattgaagtttgtgtaggggctgccccttgcatgagaggtgactatttctctctcatccttcttctctcctccacctcactatttagtcctatgtggcatcttggggcttgtgcttagatgcccatagtacttgccctaagagcaaggataatagtagagctcacttcctactattagtccatcttaaagccaacatatataatggattagctataaggttggttacaactatcttctcctgtctctatctctaacctatgtatttaatatatttatctaggagcttatgttaagctagctcttgcatgagagccaacattcttgatttttttgttatctctctcctccacataagcttgtagtagacttatagctcactattatacttgctctaaatcagcacccaaccgcttggacatgaatctctaatgcttccccacaatggagcaataatgataatacagctggctatgataacgaatacccaaccgctggctgctgtaagaagtttagaagagagcgaaatcaaaccgcacccgtcttagagcaagtttaataatatagccaactactaactctaattcatatatagccaatttaatagctcattcatacaatagttacatatcacactattaatacatggtcccacctgtcatacacactgtgtcttggagtccgtgctacagccagctacaaatctgtagcccgctgctattctctctcctcatttatctacttaaaatatgtttacagctggcttataacctgctattgtacctactcttaagcccgattagcctgatttattttgctccactatctcacaacctatcttaatttccgattgctctagctcaaccataaaaataatgtcctttaatttctcccatcttataccatccaatttataggactatgcaggcacgggtgtcatgaaaaccattaatccaattcttgtaaaccaccacatttaatttgctatgtggttatgcattcttgcatagatctaccaatagtgccatcaacaaatctcatgcgaaaaaactatcggtgtaattacggtgtaaaaacacatcatagttacaccgtatactatatatatacgactagtagcattaaaattgagttcaagagaaaacacagcgctagcttggtggcaaaaggagcactcgtgtgatgggggtgggtttttataaagaaaaactcatgcatttattttatatataggttagaaacataatatatgatgagttgttacagtgcagtgctaacagtacggatcactgggacacttccagttttgcgaaaaaccccttgtgaatgggcaaattacacttttgctcaacattttgtagaaaaggacttagaaagaaaaaaaaagcaatcgagtcattctccttcttggcctttgtcaccgatgaagaagatctgaagctcacttccggtggagggtgaaaccaagtgagctgaatgcactcaatccctaatgattcctcctatgtatggaggctaaggtgttgatgagcaaagtgaaattttagcaacaccacttgagatttctactattgttcttgagagaaattagtacaaagaccatagctactccaaagacaacaactagatgtattttgttggtgaagaaagcaaaagaaacgcggtgagctacataagaagccaagaggcatacagattcggtcctccacgagtgggaggttgagacatctttgatgcaacttgaaaactccagccacctagtgaagatttgtcgccaaggatcaagcatgaggccgccttccttggaaagacctcgccggagatgtcgatgtagacagacgttacctctctttgcacagatctggaggcatcctaggtagcagctgggagaagaagcccaacagggagtgattcgtctccgtggagaagcccgacagcgctcctagacacaaggacgaggccaaccgacgccaacaatcaccatgagaatcaaaagggaaaattaaaaccacgagaagaacctgaaccaacgggataacccgactattgctactacaagtactagaggagcagggaacctagtccctatcctaaccttcaccagcgatgagccgatggtggggagagagaggggttggaaaggggtgaactttactataatgagtattcatgagaggtcaaggaccaacgagagagcgttttctgtcacttatgtgtggctgcaatagggaggttgcagggtcgattctcaccccaccagcgtgcgcctgtgcacgaatcttgcaacgaatttaattgtctaaaattagcagatttcttccaaaaaaaaccatcacaggtactagaattaaaatctcaaagcaggaagagttgagcgatatggttaaaaatggctagaaaagaaaatcttaatcatcaaaaagcaggttgcaggtgtacacgtccattctcactaccataaacaaggggatgtattccaagcgaacagaaaattaaacaaagtcaaattactaagttgaaaacaaacttacatttgttatccatagattttcattggtaccattaatttcgcaatcactttaaaatcaagattgctcgggtgttcagtgcactgctcatgtttgatgctaatatagattggaccgagaaaaataatcaatgcaaaacccataaaagaacgtggggaatctatgcgtacgaagtgagttggcgagtagacaaatggaggggtggtttagaccgtgagaatttgtaatttattccaaggaggtattgtgtaatctagtgatgaactcataacgagggaatgccatgattttttttttctgcaaaaataagaacatgaaagaatttctgaaaagaaacaagcagtggcccgtttcaatggtgcggaccgtgcggtcgatgccttggtgggtctcacattctcactggcccagcctcgacccatggttattactatttcacatttctgggtgcacttgtcagtaggataataaaaaagctcgagactcgcgaaccgctcgagctcttaacgagccgaggcctaagctcatgagctttgtcgggcttagctcgatcttctcaccagcataggtgcacatttaatttttatcttttatataataagctagtaggtaattaatatacattcacgtgagaacttagtatatatattttgtagcagaaagacctctagatggtttaaaaaagacgcgaatgacctaatatcaaataattaaaagtggtaaggcttcgagtctaaattgtctagcccaccaccttgtggagctagctagaaaacctatgagcgtaattaggggtgggcattcggtctaaccgaaaatttcggtctcggtcttcggtctttcggtcatttcggtctttgaaaagtgaagaccaaatttatgtgaaaaactatcagaaccgacaaattcggtctcggtctcggtcctgactgaaattcaacaatattttcatatatgcaaagaaataatggaaattttcaacacaaaaatcacaataaaaattcgtaagcatttatgagtaaagactcttattaggttgcatgcctagaagaagtagggatgtgaaaattagagtttaatcctattaaacatagtggattgtagattgtatttagacattttttgataattcggtcttttcggtctattcggttatccgaggagactaaccgaattgaccgaacaaaattcggtctttcactatctaggaccgaattgatgaccagatttctcggtctcggtctttttggtctcggtctcggtctttccggttcgctctttcggttcggtccttttttttcccacccctaggcgtaatcactccatatatccaacgtcccatgttagccacgccatcaaagcttttggctggtggctgccgctcgcaccggctgcaaacgctcgtgctcaccttgtccatggcgcccacggctgagctcgatactgctacgtcaccgccgccgccgcacttcgtcatcgtcccctttccggcgcagggccacaccatccccatggtcgacctcgcgcgcctcctcgcggagcgcggcgtccgcgccagcctcgtcgtcacgcccgtgaacgccgcgcgcctgcgcggcgccgccgaccacgccgcgcgcgccgagctgccgctcgagatagtggaggtcccgttcccgccgtcggccgccgacgccggcctgccgccgggcgtcgagaacgtcgaccagatcactgactacgcccacttccgtccgttcttcgacgtcatgcgcgagctcgccgcgccgctcgaggcgtacctgcgcgcgctgccggcgccgcccagctgcatcatctctgactggtccaactcgtggacggccggcgtggcgcgccgcgccggcgtgccgcggctgttcttccatggcccgtcgtgcttctactccctctgcgacctcaacgccgccgcgcacgggctgcagcagcagggcgacgacgacaggtacgtcgtgccgggcatgccggtgcgcgtggaggtgaccaaggacacgcagccagggttcttcaacacaccagggtgggaggacctacgggacgcggccatggaggccatgcgcacggccgacggcggggtggtgaacacgttcctggacctcgaggacgagttcatcgcgtgcttcgaggcggcgctcgccaagccggtgtggacgctggggccgttctgcctctacaaccgggacgccgacgccatggcgtcgcgcggaaacacgcccgacgtcgcccagagcgtggtcaccacgtggctcgacgccatggacaccgactccgtcatctacgtcaactttggcagcctcgctcgcaaggtccccaagtacttgttcgaggtcggccatggcctcgaggactccggcaagccgttcatctgggtggtgaaggagtcggaggtggccatgccggaggtgcaagaatggctgtccgcgctggaggcgcgcgtggcggggcgcggcgtcgtggtccgcgggtgggcgccgcagctcgccatcctgtcgcaccgcgccgtcggtggctttgtcacccactgcggctggaactcgattctggagtccatcgcccatggcgtgccggtcttgacgtggccgcacttcaccgatcagttccttaacgagcggctcgccgtcaacgtgctcggcgtcggcgtgccggtcggcgcaacggcgtccgtgttgctgttcggcgacgaggccgccatgcaggtggggcgagcagacgtcgcgcgggcggtgtcaaagctcatggacggcggcgaggaggccggcgagaggaggaggaaggcaaaggagtacggggagaaagctcacagagccatggagaaagggggctcctcgtatgaaagcctgacgcagctgatacgccgcttcaccctgcaggaaccaaaaaactcaagttctataacagtagagtgcagtgcaaataggcacatttgaatccacagattgcagtgttttcctgaatattttttttccattttgttggcattaggtttgattgcaatgatttatttctccatgcatggacatccatgcacataagtcacctgtcttttcttattctgaagaagttaatggatgatgtaattctatttgcggacaactttcttcacaatgtggacttggaagttggaatattccaatgagaatccaagaagatgcatgcctccagaaatcagaatattcctaggccgtgtttagttccaaattatttcatcaaacttctaactttttcatcacatcaaaactttcctacacacacaaacttccaacttttttgtcacatcgttccaatttcaaccaaacttctaattttggcgtgaactaaacacacccctagttgacttggaattgttggcttttgtcaggatcccaatctaccctatagttcaacgttgcttcgtctgaacattttatcttggccgtgtttagttcacccccaacttccaactttctatcacatcacatcacatccaaaactttcctacacacataaactcctaattttttttccaaacttctaactttccccaaacttttaacttttttcaggaacccttgttgatatcaggctagctctatcaggttgtcagttgccacctttgtggcctttcatatttcacctttcgccacttatgatcatcttgcaatgccatccacattcagatgatctgtatggtgtaacaagtctgccacaaacaagtgagttcagtgtttaaattcatcaagaaaatacacttggtgatgtattggatctcgatcgatctgataaaccaacgatgaccatttgcttgttttctctctgtgtgtatgactctgctttaggtttgcctgtcattttcatgagacactagccaattagtcgtgcgttgcacaactttgggtgcctgtaatgtacaatcatacttaattttgattttttttcttacaaaatcatacaacttgattttaaaactatagattcagctcaaactatatttcaactgaaggttcaaatattatgtccaggatcaacctcttaccgtatacggtgaagaggtgagaatgtttactcagcaatacgatgcataaggttcacagttatcaaacctaacgcaatacacagtagcaaagtaaacggcaatcaagtccatgatttgaaaccaacacaaattgctcaaagatcatttggcctccgagtatctcaagaagataacataataaacattccaaaatgaaaatgtacaatttggttatgaagtatagtaaaaaatctagagtgatcacaattacagtagtttgtctatttatgcattattgccaaccaaaaatccttcagcccaagccaaggaggttttctcttctctgtaggcctgccatcaaccacaactcattcatttcaggaaattcgcatcaacaaaaatattcttggcttgcaaaagcaaagcaaaactttgtaaatcttcaggtagtttctcctagacagcaaacgaatgatgacaggttattctcatccttgtaagtgatggttctgccctgaataatagtttcagaaaatctagttcatgtttcttttctttgaagttggtaagctccacctctgcgagtaacttcatcagaacattatgagctccctagcttgttgattgatagcagatgcaattcaaagaacatgattcttccccctgaaatgaaagaatatttaggtgtagttgaagttttagttttggaacaaaaacaaaactaagatatgaatagactgattctcttatgagatgttaaggtggagacgtcataagtagattatacaaaagagttacaacatagaagaaaaaaatattttaagggtaaactcagtaagaaaatatcttctttagattccatctaatgttgtcaactaataatttttctaattcaacgcaactgaaaatgcttcagagcaaaattgtctcgttaagtgtagtacctcaggtcccctttcaatttttattctctcatttttttaatacctattattttatatcaaggagcaaacataattccttggcgatctctaaatgaaagtttaacgtcttgttagttttgctatataacttggttaaaggagactgtataatagcatgccacttgcaatttagtagtcttgcttctgtgtaatagcacctgaaagtatataattgaattttactgttggatggccttgaagatggaatcactacttaaagcatatgattatgtagttatgcattactaattaacttaaagaagtgattttagatataacaacatttgcattctgccttgaccattgcacaacaaataattacctagatgcgatgcctattctagaaaataaaaaacaatgaagaattaggcccatctttaaatcccacaaatccttgatatgactcacaaagcctcaaaatcctatatatgaaagaatgagatgtagtgttttgcataaatagtagaacgaatgcattctattgacctttgcttcctccacaccattactcacgatttatggtgatcctacaccagttcattatagtgtgctgacacatctatcagtgtgaaaatcaatgtacttcctccgttctgtattataagaccattacccacatttatatatagatgttaatgaatctatacatttctagcacatctatatgaatgtgggcaatgctataaagtcttataatacgaaacggaagaagtaatatttaccatgattgtagccatacagaaatttgtgcctcgctcttcatcactccatctttggcatcgtctcttttatttgagccgatctgcagtggtaggccacagcgtgggaagacagataggaggggatgggatatattgattatgtaacttattaccagatacctgggatgggatcatgggattcagtgggcaagggaggaagagatggcgacagtcttgttgcagtacttctgcttgaatttgcgatctgatttttgacctcgatccaccatcgtcgatctcgatcttgttctgttctttgcagctgtgattcggatcaatggggaaacacggcagcggcggcggcggaaaacgctgcggtggaaacgatttgaagcagtggtgcggatggggaggtgcggtgggagggtggcagtgcaaacgaggaggcggcggtggccagtggaggcgacggcaatacgggcggagcgcgaagacgagagaggcagtggtgcacacgcgattgggagtgtgggctgtgttttttttttttttttgccgggtaaatccgtgagaccgatcgggagtagtgcggtgggccgtggacacgtgggctttatatattcacgaggcttccagccttttcagtccaagactcaggaagactactcatgttacttcgaaatccaatggtccgtgttgatcacatggttgcatccgacggtcatttttaatccgatgacgtggcacattctggtggtgaaaaactttacttttttcactactttagatactctaggattaaaactagattgattaccgtttctcaaaaaaaataataatgaaaaactagattgattattgtgttgcaggctagatgctaagtcggtacaattagatctctgaagcccttttctcgctctccacattttcgatcagaaaaagggtctaattcgcacatgtagattttaaaaatttccattaataaaaaaatactcagttttttataatgagaaggtaggagtgccatttgattaaatgaaacatttgattctcttgcaaaatttgtaccatacgttatgaattgcagtatgcaagtatactaatttcatagttgcaaatatttgtcccaaaatgtaatttagtagtatgagatattttggatgcacaagagtttatcaccaatcattatcttgtgatggttagagaggtcaggattcatgagactgtagctccattactgaaaagagaaaaacgcagcttgtgatggctgcagaggccattccctccttcaatcttcagactgtatttttcattggagcagaatcaaaaagtgaaaattgattgacggtgcatgcctgcttgcttgggtgtgtttcttggcttgtgctttcttcctcatggagcggacagtatcagtaccaattaatcgagcagttcagctgcagctagccacatctgaacgtcttgagaccagatgttgattggcataattgtggactacgacaggttgatttttgcactattcgttttcatcttgccttcctaatgcagtgtctggatgagttacagaggtcgcgtagtcaaatctgaagatccaaccgtgtggttgaaacctagaacacagtttgtttcagatgtcgtaattttgtttcctggcgttctttgtatattcttttatccagcctatacacttctccaatgcaaatagtcgatcaacatttctatgtgatacatcacttacatagaattacagaaaatacatatatttatatttcgcgtcgtaccggtgctacgtgatcatgcgtgtgggaaacaacgaatggaggaccgggactgacaccatctctggcaacatatacgcgatcttcagagaaggaaaaaaatagaggagattgacgatgacggacaaaagaacgtaacactttactccatgctaaaaaattacctcagtcctagaataaatacagttttatgagtagaaggataaattaacaacgagggaaaatcatctagctgttccctatcaattggggggtggttgaaagtgtgaagatagttgggtgtaaattagagaacatttaaattagttgttattaatgggacaagtaacaagtagcactataagttttacttattttgggacaaaattaaaatcgagaattgcactttttaggacggatatagaataagacgtaaaatcgatcttgaatatcgtaatttaaccatttatttcttttataaattattatccacaa

SEQ ID NO: 73630 - DNA, 9301 bp, Oryza sativa
aatcaaaccaattaagaattcatattctcccatcgaaccccccctttctttataaagggaaactcatggacgttttatcaaccataaaaaaaatatcattatggttgtcaaatgatcatggtttttccctttataaagtatggaatgaatttcaaaattcatattaacgaagggtggataattccaatggaaaatcaaaaaattcaaaaggatgtaaatgtaagttctcaagactaccttacattccacttgattaacgtagaacccaaaatgcaagaactagttgcagcagaaactaaaaaagccagggcaaaacttcaacgagaaatcgtagccattattaaaaatgctggatatcatcgtgaagcgacgcaaatgaaagctatgtttaatctgtaatttctctcatcatttacttcaaaaaaactccctttatctatttggataaaaggagtttttttgttaagcgcaaatagttttttgaatataaagattttttaaaaaaagattatttataactaacacttgtttaataatgttaatctattataaaaaagggtgataatttgtcaaaaaactcctataaatatttaaaatatgtagcattacttcttgtcatatttcaattactgtatttaggaattcccgattctgtgaagcctgtgttggtttatgagtacattatatttttcggattagcttatttatttgctattcttcaagatttttttaatccaaggaaaaaaacagatctattattacgtgtagctatcatcatcagtttaattgtcttggctattacatctatctactataaagccacgttctcaattgctttttctgtaataatgtttattgcgttcagtttttcattatatgtaacaattaagctaaacaaaaaaaacaagcaaaaggattaataccttttgcttgttttttaaaattaatggtacgaatattttgtttgtgttgagtaagtaatattgttaccactcgcacctacatactccactaagtctgtagttgttaaaatgtgagtaccattacgcttcgcacaatcgtttaaaacggattgtaactggtttttattcggattttttaagaacattgcaacaaatccagttatcgtaataccaaagccaacaacttccaaaacttttgccatttttggtgcaatatatttagcaaaagccgttgctactaaggctacgcccaccgaagcaatgcctaaccctaaatcatctggactgattttactgttttctttgtgtgccgcagcgaggaaactttgtactgttacaacctctgtttctcgtcttaccacttttgatgttgccattatatatatcccccctatgttgtatgaatttgttagagttgaacaacctaacactctataaaggggactttcaatttgatttaacaactttttttaaaaaaagttttattcacgttcatacattttaggtttacataacattagaaaaaggcaggaacagctaaaatcaatgctgttcctgcctaggcggagccaagtatttcggtgtccccataaaaaagtacatttctacaggttttctatacaaacatttattcgtttctatatgttttctacatagagtatccagtcattctagttctttcaatcgtctcataatagttgcttcagaaacatctagtattcgcgcaatttctcgattacttttcccagtatcctttaaatgcatcaatttcaattcattgatggttaatttaggacgaccatttggatttccaccttgccatttctcatcatttttttcatctttattatttttaaaaaatctttttagcaatactctccctccactaagtgcgtcttaactctaaattttaagttttgacgcacaaaatatcaaccttcagatattttgtaggactcaataatatctaaaagattagggaattcaaatattcaacaagaaaaaaggaaatggagagtgcaattgtttagaagttgcaaacaaaacagatgaatcagtatagaagtaacctggttatttttgagtggtaaatggcctgattttagcgaaaaatcgtaggaagaaaacaggaagaacataacaaatgttctttagaaaaaaggaaatacagggaagaaaataggaagaatcgcactttttcatggggacaccgaaatactaggctctgcctagtctatcaccccaagtgatagcagatttcccttatgctctttcagtaaatagcgttattctaggagcaacttttgatgacagagatataatcaagctatttaccactcaaaaataatcttgctacttctatgttgattcatcttcagtagcatctaagcgtttttgtttttgtcatagataaaaatacacgccaaaagaaaacctttaccaaaactctcaataatggtaacattagtaaaaaaaagaggtttttatgttgaaaaaaatagtaagtctgcttgcttttcctatttttgcactaggctttttatctactgcacctagtgcgtttgcagaaactgatgagttaggttatgaatatacaacgaaaaaagcaagtgaaatcgattttgcagacggagacttttacatagtattactttcaggtgatgccaatagtgaagacgctacttatgctgtatatgaaaacagtgaagtagaaaagtatgaagaagatttacttgctgatggacaattggataatcatgaaacccaaaatctattaaactctgtaacacctttcgcatccctacctaccaaattttctgaatactatagtggttctcaatggatttcaagagatgagggaccatctttatctcttaaccctttaaaaccagcatatgactcacccccaggaatggcacaagcacatttacaaaaatacagatgggatgtagtctactctaaacatagtggagatgcaaaatggaataatacagccagtatgaaagcacaattacattgtcatgctgatacaattaaaggtttaaaaaatccttggaatatagaaccttggcgtacaacaaccaattatcatgaagtagttgcaaaagcttgtaatccgaaaaataagtaaaaaaaaaagcctaattcttttgaaaagaactgggctttttttaactttttcaaaaccactaaatttatgtgaactttttcagacgtgttgtataaataaatccatttaatatacatagtaacaaaataattataaacataattaaagaaatactatcttcaccctcacttatttcgtcgcctacatagccggctattattacagtaatagctgaaactgcaatagttactaaagaaaataaacctaatgtaataccattaataatttgggtagattttttttgtacaaaaataaaaaacgtaattaaaagtgatgaaatggtgaaaatagcaagaataatgtgtataaaatcataaatttgtaaacttaccataaaattacctcctttccaaatattataacgttttatggtgttttaaagtttctccattttgaaccatagacagatatcagttggatacgtgcaaaaccacacatggaacagccgcaaaacacaatacatcttttctccaaaagcaaaccatacaaagaacccccctctaccttgtgcagaaggtaaaagggggttacgtaccctagtataccattccattaccacgatagcccaaaattttatacatgccccatacataataagttgacataataaccaaaaaaggcagtaacgatgaagggcaaacccttgtcgttactgccttttcatttaaatcacaaattattgtatatgcagcattttatacatggttgatttaacagcattttggctaataaaccaccattgtaacatgcataaaatactgtataaagttactctttttatttattttgagttacttattttatttaaagttactctttttatttattttgagttacttattttatttaaagttaccctttttatttattttgagttacttatttagactctgtgtatcttcgttcaaagtttttcaaattatttcacgtaaaaaaagcgagcgatttttctctgcctttgcatcaaattgttcccaatcatccttcgtgagtgttagagagacttttttagtgatccctatacttggacgtcccacagatcttttcttactaaataaagccattttacaggattcacaatacgtcactggtacatcattaacataaataattgcgacattcatgccactaccacaacgttcgcagacagactctttacgtttattcatataatcacccctttaagttactcttaattctatattttgagtaacttaaaattattccttatatccagccttaaatttactcacccatgtagcgcatagccaaagcccatcgattcttgccatgccctaattctgaatgaatttgatccattgctctttttgctgttgtatacagttgcttatcacgctcacttaaaatgccatagtctgcagcacgtcccatttttctattttctaacacacggttcatcatctgtttctgttgattgttcattattcgattcattcgattacgagcataggtatgtctaaaaccatgacaaccacgtccagcttgttctactccactctttttacatgctacgtttaccccatctcttaccgtagagtaagatacgttcactatccgttcttctggaggtttgtcagctatccaactttctagtttcttttctaagtgttgcggcacattaagttgtcggaaacgccccccctttgttattcctgaaccattagaaatcgccaaacaccagccagtgcctttgtcattgggaataaaatgttctactcgtacattgacagcctctttcacacgcaaacccatttcatgcattaaatcaactgcctttgtgacctcctcagagcaattctcccgaattaattgcacttcattttccgtataagaacgatttttagcatcagagcctgtcagaggcttttctaagcgcctttccggacaaaaccttattgaagtaaagagatgatccgaaaaacgcttagaacgctctttaaaccctttttctaataaccgaagagatgtttcaacatttactcgatgtccttgagaaacgcccttttcactcaaatgggcaaggtatgatacataatgcctttcattcagttcacagatagactttattccatgttcactacggcaccatttcacaaaattttgagcatcagacatcgtgttggtcatctgctttatagagtgaataccactagttcctgcttttttcgcatcacgttttgattcaccaattttatctattgtctgcagtgactcttttacctcacgaacaatggatgtgcgtcctcgtctcgccattgtactcctccttttcttctcacttcaaagtccgtttgccctagctttgctcgggcgctccaccttaggagatccgttgtctacgccaacagacctcctaaggtgtcggatgcatttgtgctccgatatgtattcgattatcaatgtgcatacttcaactttccgcgctttgttatcggagtgcgccatataatctccgcccgtttttgcgctgggagcgcaaatggatttgctagcaaatccactatggcagcttaacgctgcaagcaatctacggattgctctttttacaatcacgttgtgatggccctttttctacatcctcctcctttttttgttttttctttttcatttttagacgcaaaaaaaagcacgtctgcttaccctccttgtggtagtgacctacttatccttaaaaatatttaatttttttgtattagccgattgctctaatggggtgtactctcccaaatacaaaatcattcttcccgtttttttattattcagggcatatttcaccctacccattcttacagcaacctgaattactgtttcaattcagcccaaaagctcgtcattgttcactcaacttcctcaccgtatggttgggaagaaaaaataaaataattatatgcttttagcctagcagaatcatcaataaaataaaagcatttcatttttgtagagcgaagacattttataggacctatgagaccaatcgaaagatcatttattgggtaatggttcatctcgattggtctcagaaattgaaaaaaccctcaaatgaaacaattaatttaaaaaaatgaacaacaaactagaggttcggtattaaccaatcctcttttaattaaatactacttaacatagccaatattcgctcacgttcttgtgcaaagcaggctttcttttcttctgttaattcttcttcttgttcatgacgagtcgcaaaccatgcaggcacgacttctacttttctagttttctctttttctggttctgcagatgaattcgaaaccgttaaatcgttgattttgttgcgaataaccgcacttaataaagctaatcgatttgttttgacgtattgatcgttcgctgaaatggctgcatctaatgattgatacataatcgtttctaattgcacgtgagacagggttaacttgtcctctgctttaatcttttttaatgaaccataaataacccctataaatgatttaaagccttctaaagagcctgtacgggcttgatagagattttttaaacgattataaagattatttttcttatcagacgactgcttagtagacgtctttatatcttttattattttaatttggttattatagttaaaatctgaatttgggccatttaacgttgatataacagcgttttgagccaaatcctgatgtttattttgatgtttatttggttgtttaaattcatctttaacgatggcaatttcataagaattaagatgataaacttcacttaaaatgctttcaaaattcacatgttgcacgtccaagatgacacgacaaccactattcgttttccctgatctgtttctagacaagataaatagcttggattgctccatatacttaaaagctgttgaaattgtatttaatccaacctctaatttttcgctcagatgctctcggcttactttgataataccgttatttgtaagatcataaatcattttttctaacactctatgtactttcccaccaggataaattccttgggttgctagtacttcttctaattgctgcaggcgttcttctttgagttgtcgattccctttttgattgccgtatgtaataaatgtttggactgcttggtttggtgtagtttttagtttatttttcatggtagttgctccttttttgaagcaaaaaagcgtttcacatcgtgtcttctgacgatgcaaaacgctttagattataaaataatcctcaatgacatagtaattaactgttgaccattattaaaattcttaatagaatgacctatagatactttgtatctctataacaattaaaaacagtcatttcacgataagctgcatcgtatctgtatcatacgataaagcgattaacaaaggacggcaatccgatgttagtcactgtggaatggcttttttacgttcgatttagttattttcaccatacgctaaagttagcaacttgtaaatatattctatgactattagtttctattagtttattgaatagagccatgacgcttgaaaaattctagtagtgcaacctcgactaactgcgatttttttatatttaactcatctgcgacacgatctacttctgccactaactcctctgaaatgtaatacgttttattttttctacttctcgtatttaatttcgcaatctcattaaaaattggtaactgttcatgtggctcctcttgctgaatgcgttcttgaatcatcttttttaacacatgaaactcgttttctgacaggccaatggcattcagaacctctaggtcttgctgtctattagtttctattagttcattattaggagtagtgacggctacctctttattagtttctattagttcattattagtttttattagctctttattaacttctattagttttctattcactttaggagtttgccttggtgatactgcttttaactgtgccaatgcttcattaaaagtcatatctttatccggaaaattagcgtcacgttgccatttatgttgcgatttattatagacgggccctaatgaattaaatacttctcgtatggttgtatcacgtgtatttaaaacctttctaagctcttttaacgattttttactcgcaataagctcagaaacgttgttgtcttttgtcagctcccacatactattcactctcctaatagtttctaatatattagtttatattagttaactaataatactattacttttctccaggtaactgtacaaatgctgcccatttccggagaaaaaagagtggagcgtttttatataattttttcattttcaataagttcgaagaacgaaggtacttttctaaattgttttgttttaacaaccctaatgatcattaacgaaatttcctgttccaaatccatcctattttgaaaactggtctgatgtaaaactgatttaattttaggctgcaacatatctagaacctcctgttggaatgccgtacttcttaattcacttaattcatttattggcatcaacatcacctcgattttttggaatactcctgcctaattttttgaaaagcctggtttttagctttattgacagcttgttttgaaatacctagtttttttgaaatttcttcttccgttagattatctacaaaaatagaatgcagaatatatttcttttttggtcctaatttcgaaacaatattataaagttgcttgtcctcgaaaattacttccaaatgagcgaagtcagaatgtatccattcagaatcatcatcaatactttcatctggaattaaatcgatgaatttgttctcaccctcattaatgtcattatctaatgttaactgattaacttggttaatatgacggatttgtttgtcatatctttgagattcaaaatacaaaacatgggaaaaataactaagtaattgaatttttctaacgtggattttgaataatttttcaatagtgtctctcgtatgagtggtaggattctctaaataacttttataaagcttacttactttttcatcttctaaaaaagattttaatagacgattttgaaccaaaaaaatcaactcctatataaaaacagaaacatatgttctattttatagcaaaaaaaagagaaattacatccatcattgtgttcattttacatttcaacatcgcaaaatagc

SEQ ID NO: 73631 - DNA, 5819 bp, Oryza sativa
acttgtgtgcgttaggactctcactggtgatgtttgaaatatatgaagatgaagatgaagatgaagtccttgcaacgagaaagccgttaacgtcttcttttttgcgaggtttttttttttgaaacaggaaagcaacgcttcaccccttctccattatcggaaaaggaacagtgacaattcattatacgagctactaagaaaaaaaaaacaaatgcaggggaatggaaccccaccaagcattgtcatcatctcttgaataaacctttttccttggcaaactaatggatctagactatcacaaagatctactgaaaactaagtactcattgaactactagtgaaatctgggatttcagcttccataaagcagcaggggttcttgatcactccatcatgtgcgtcaggcatcttcaagtcttcctgtcccaaccttccaaccgtgcttcgagttgtagacatcatttgccacaccggccccttagcagctccaccccccagagtaagcttcttgtgtttggtccctgtttctgtaacaccacccaggagacaatcaaagagcagatataatgtcccacagaactgctgccaccccaacagcaaccatgcttttcatggacaatacaggaacagctgttctattgtttcatcagcctgacaaaatagacacattctaaacttctaacacctttttaggttaaaagcaccaaaaaggtgttaaaagtttagaattgacccaaatcaaaagcactattaactagtacattccatacaaactttgccaagggacaatacaggaacagctgttctattgtttcatcagcctgacaaaatagacacattttatctcttcctttccaccctctcttaagcaaattatctttggtggagacacttttattcagagtcagccaaataaataccacttttgcaggaattttgaatttccagattttttcctattagggcactttatttgttgaatctgcagcgctctatagaaagatttcacaaaaaagccttttcttcctatccagttcccagaccaaactatctttctgattattcaaagtgatgttcatgaaattctttttcaaattttgctaggaaatttatttttttccctccatctttcttctaaaactcagcacatccaacgttctctcgaaacttttgctactgtgacattcttagtcatagccacattatacaggttagcatatttaacagcaaaaggttccttcccgttccatctgtactcccgaaagagagtgttttctccattaccaatttcttttgaacaggattttaagaaatcatctctcacttgcattaaaccctgccaaaagatagaatcaccattgctgagttttttttttttgtgtctcaatgttgtgtgatataaatattttgctttaaacaaatcctaccatgacccttcttcagtctcaagtttccaaagccatttaccaagtagtgatttattcattagttccaaatcaaggattcctagtccattcaggtcttgaggtttacacattttcggccattgaactaaatgctactttttaagggcatccacaatgttggtaaaaagttagccttaagcaattaatgttgtacagtaaaacaccttaagcattgtgcaagcacaccataagaaccatagagcaaaaagaagccttaagcttacggtgcggcaacaagctaataaaatatgcagtgaacagaagatggaagacttttcattgcgccaagtgtttcacgaaaggagtgagtagtgatattttttcccctcgatgggacctagtgggccccaccttattttctctccgtgacacaagcattgtaggcatggaaacaactgctgcttactgtggtgggtcccactcttatgtttcatgtaacctttaacattggcgttgccctaatgccatgatcttcctgccttagaaacctatacctgaactagtcaatttttttcttaaccccttgaggtagaagataaaaggacatcataaaagtgggaatactactcagactagaatttaattattagtgtgagtctcccacaatagcaagtagtttccccttccaacaaccaagtctaccttccactttatttttagtggatttccaatccttattatgttttcttttgcaagtatccctaagtattcttttgcaagccattagcataagtttagttgacttttaattattacaaacttaaaaaatagatttatttgatattttaaagtaacttttatatagaaagtccttataagaaacacattgtttaacggtttaaaaaacgtgctaataaaaactaaggtaaaatatgtatcttaattaaaaaagaacgggcctagtcatacgcacgctagtttcaacggtaccccccccccccctcttataaatacttcgtatttacttggacaagatttaaatttttataactagtttattagaataaatataaaaataagttcacgatattatcatactagttaatttcaaggtaaatctatgtgttatattttttttacttagcatttgataagttatcgacagtcaaaatttttaaaagtttgtttttactagagggagtagtagtactttgttaaacagtaactaattattggattctgcgtttaatccggtattatatacaatacagagaaagtagttaagagtctccagtagacattccaagttccaactccaaggaactggatcttttcatcaatcatcaatgccacacgccagtagggtacgccgatcaaaagcctatacaagactgcaacaaattaagttggtgatgcaactaacaaacaatcacaagcaagaaatcttacggtgaataatttccaagtgaatgagagcgataagaaagagggattttcttgattcgcacggtgatggcaaaatggcaattcctttcttgatggctggtagacttcatggattgaggcatcgagctgatgcagctgggcctacattgcccccatttaggcctagtcatcgaggggtcgcaggcctccattttcgctgggctggtaaccaggctctgctagctctggcacattttgttgggaataagtatactttaactctctcaattatagctccaatctgtttcgtaccccttaaccgcaatgttagatatcttgaccctcatctattaaaacatgtgcaaaatgattccctcggtgattttcgctgtggcatccacatatcgcatcgacttagtctttatgatatgatgtgacattacagtaacaaaaatagtaaaaataatgcatgggacctacgggtcagtgaccactacttttcatctttcctcccctttctcctccctctccctccacctcttctctctttctcactctctgtgctgaaatcattcaggcaaggagaggcaggagaggatgacagtgacgacgccgacgagctcaagcaggggacggcggtcgaccacttaggcaggccaagagctgggcagcatcatggccctaggcggagccgtctcccattcccgagcagcgatgctggctaaggaggccaccttcgcctcctgggtcgtgggcggcgcagactaacgctgactaggaagaaggtactcaggttgaggagggagctgacgagggtgcgatggtggtgctggaggtagtcaaaggatactatgtcggggatgagatggaactggagatggatgttgggcgccgctcctcctctccattgataggagacaagaaagaagcttatgccaccgacggcatcgattgcctaccttcggcaccccctctttgttgtcgtttgtctccccaaccaccaccaactggtcttcccttgttgtcatcctctcccacctcttcttctccacctccccgcggggatcccatccttctcgtcgcttccgagggctctccaaccattgtcgcctcactttcctcgagcacgctagcaagctttgccctcattcaggtggaggtgggagggtgccgtggggagatccgagaggacgccgtgggcggggaatgctgcccaagggtgagactgacgacgccttgcgctagacgcctagacttgagctccctgtcgtcgtcttcccctgcctccccgcttggttgattccaatcgcctcccactcttctttcgctagccgccgcatctagtcgtaccgatgcttgtcatgtctccgtcatcccggccagagagagagaggtggagggagagagtgaagagaaatgggaagaaaagaggaaagcaagttgtaaatgttcagtaggtcccacgcattattattggtttttttaattgtaatgtcacgtcggatcacatgacaccacgtcattgaaaaccacctcaaaacccccaccagccatcaggggagtaatttggaatcggtttttaatagttattgaggtcaagatatttggtactgtagttggggatatgaatcagactggagctataattaagggagtcaaatgaacttattccttttgttggagctctctcaccctttcggcccaacgattcgacagcggacaatgcacatagcccaactcctccttgtcgcaggcgttttgtttggtcagttttgctaaaaattgtacagaacttgccaatattttggtagtggtaagatttgccgttgcaaaatttttagtaaggtgtgattgtttggtctggcaccatttttttttgtatttgtttgagccctttgtttggttttcttgccaaaacattggcatagccatttttattaagtagcaaattaaatactatcctaatttattgatattaatcaattttttggcacggatagctggggcataaccaaacaagcttatctgatttacgctaataagatgatatgttacaatatgataaaataggtttctctaatcgccgtgttaagtaaatgtttttaagcctaccgagcaacaagccacaaattatatttatttataagaaaaaaaaacctagattcatgcatcagttgtggtcggatagctacttttcccgttcttttttttccccaacggtcgaaccattgccgacgttttatatagagaagttgtcccatttcaaaaaagaaaatgagaccaaactttacagtacatagttaattagagaaaattgtgcgaaaaccacaactaaaacaaacagaaactgataaacctaaactacaacccaggttcaatacttagcaaacgctattcaccacaagatttgcaaaaccaagtagtaagctagaagatcaaataagccccacccccccccccggcgcacgagcagatatatagtgttaattatcatcatcacaccattgttgatgtaaaaacacgaggcctgggagatgcacttaactccagtgcaggtccaaaagcttgcatttaggtgtgtgatcgtgccagttgatttgatcctgcaagtaacaagaaataaagacaaaaaaaaccgcggttaaatccataaacgatagccgatcggctagttgccgatgacatatcatttatttttgagccgatgtcatatgtgaatcgatcggcaatcatgaataaataagaaataactaaatctatcggctgtagatattaacaatatataatctttatgtcgatatatacttaaatcaagtgattgggatagatcggtcaccatgctgagacagtataaatcacttagatcgaaatatatattaacaacaagattatatatgttcatagcatagccgatcagatagatctagcatgtatcggctaatactccgatactactctatattaagatattaaagcaagtggaatata

SEQ ID NO: 73632 - DNA, 21103 bp, Oryza sativa
tcaagagctgactggccccaatcaaagaaagatctcgcacggcctttgaattcgacggcaagcatgaccctaaccgtgaagatcctgaatctcttgaatttaaggttatgaaggagagaatgtataaactcttctcaaatgcagtcgtagttagctattcacacttgctgccagtggtgccatacaatgccttcaacccccctccagcggtatgtatttaaaatttcagcctttctcgaaagcatgcttttatcatctacaaagttgattgaaaacgtgaatcatcatgcccaggaattcgccttgatgaagttagaccctccaactgctcaacgccgctcaccccgtcgtcaaactggtcaagctggcggaggaccaaatatccggtctgattctcaacccagcaccactcaatcagccaaccaatcagacttctgcaagaggaaattggttctgagcgacgacaaaaatgatgactctgaaaaagttggcagcaagggggtgactggaaaaccaagaaggcaagctaacccaaagaagaaaacatccagtcgtcccatgccgaaaatcaggaagtcctccaagtacaaatcatttagccctcttccttgtattgctgctcactaactatcgaaatagcactgatagcataactcaaatttgtaggaagccatctgacatagatccttctggaaaagactctgagccgactgacatggagacgggcccttcaaaagaaaccgagccgaccgccgaagatcgcccgagtgataatcaaccagcaactgacaacgtagagaccagcgacaagcccccgactggaaatcagtcggccgaagcaggagttggtgctaatcaggagccctcgactggaaatcagtcgggtacagagcaaaataatgacatctcggaggtagagacccagcctgatagccctcccaaggcgagcgctggcgccaactctggaactaattcccctgttagggtgcaaggacctgctcgtccccgaccagaaatcataacaggtaagcaaatcctccaaatctattttgatccgacagactttcttcaattgtttcaccattattcatgaatgcctaaggcccgatggtcggcgacgaagaagaggtcctccggatacaatcggctgaagattctcgcccacccatattagtcaagtggtgggatgacgacatgcagccctaggggatcgtaataaataaacaaaaagaggacaaggaagtatgtctgctgaaaaagacactcggccaagctactcgcctcgtaaatgtaagtcttcttatactcagcttcaatcatcctgtcagccactttgctcaaatacggataaatttgcattgcagagaatccatctcaggaacgaggcgaagactgcgactcttgagaaattagttccccatcttggaacccttgaggccactagaaaccagctacacgaagctaaggagcttgctaggaagactgagcatgacctaagagaccgaatcgccgagctccaagactccaactttgaactgagcggatcgtcaaaaggtaaatacaatatttgtctgatttatttatgctaccatccatgtgatatcaaccaacaagaagcaatacagtgcaagctgccaagatatccgagctggaaaagcggatccaagctctggagaaagacaaggccgaattggcaagacagagggacttggctctgaaagatgttgaaggtactggtaactaatacttcaaaaaccattcctttctttatgcccactcgttgatataaatctatttatgttgatataaggagcttgccaggaagactgagcatgacctgagagaccgaatcgctgagctccaagactccaactttgaactgagcggatcgtcaaaaggtaaatacaatatttgtctgacttatttatgctaccatccatgtgatatcaaccaacaagaagaaatacagtgcaagctgccaagatatccgagctggaaaagcggatccaagctctggagaaagacaatgccgaattggcaagacagagggacttggctctgaaagatgttgaaggtactggtaactaatacttcaaaaaccattcctttctttatgcccactcgttgatataaatctatttatgtagatcgcaagatcaaatctcaggctcaattcgatgtcttggtcaacaaaattaagaggcttgagggagctagagatgaagtcgccaacgccgctacaccactcgtccaagccatgttcttcaataacaatggtccgagtacattcgatgcttccgaaatcttcgacaagctgagaattgctctggatacatattttaagaatatcaaggaagctggaagtatgggagcgagcttagcgttggcaatgaccaagtctttgtacccgaagattgacattgacgccgttgatggctttgcagacgggacaagcgaagaagccgcccttgaccttatcaatgatgcgcagaaagccgccgataagatagtcgttgatgtagttgagagattccaggacaacgacctccggccgactggatctaataattccgatgatgaaaaaactgatactgattgatgttgtattataacaatgatgatgatgatgataatgatgatggaggcacaatttgtacaatactgatgaatttatgctatgcttgatgatttaaactcagctcctgatttcttaaaagtttttgtcaaaccttattgagcctagaacccgcaaaagttcttaaaaactttcagtcttcattgactgagccaaaaaaccaaacaaggcaatgataaatcaagtaagcaaattgaattgataaaaatcacactccattattattatagtagcccccgactgataactcaaggaaaaacttgatgttagtagtcaaagagggaaatacaaaagtaatgcctaagcataaaaatgacgaagatgttcgatattccaagagttgtcgataggagtaccgtcttcacgcttgtgtcggtaagaacctggccgagtgacttcagaaattatgaatggtccttcccacaagggagataacttgtgccgatcccatgtagtttgaattgttctcaaaaccaggtcgccgactaaaaaagctcgtgatcgaacattgcgattatgataacggcgcatcccttgcaagtaccgagccaactgaattaaggctgcttcgcgggcttcttccagtcggttgagatcatctactcggtcttctccgtagcgctcctcgctgaagttacgaaaacgtagagattcatattccacctcactgggcaacattgcttccactccatatactaggaaaaacggtgattggcccgtagcccaactgggagtggtgcgcaaggaccaaaatatagacggcagctgtcctacccacttgccggcatagggatgcagtctgtcgaaaactcgtgcttttattccttggagtaccatgccattggcgcgtttgacttgtccattgctcataggatgcgctacggaggcataacaaattttgatgccgaagtcctcagagaaatctttaaataccccacccgtgaattgagtaccgttatccgtaatgatcctgttgggtaccccaaaccggtgcataatgttgatgaagaaatctctaaccttgtctgccgtgattgtgatgaccggtttggcttcaatccacttggaaaatttgttaacagccacaaagaggtgagtataaccaccgactgcctttttaaatgggccgaccatgtcgagcccccaaaccgcaaacggccaagacaattggatggtttgcaactcctgagctggtagatgagtttgtcgggcaaaaaattgacaaccctcacatgttcgcacaattttgtcagtgttggacacggctgtgggccagaaaaaaccttgccggtaagccttacgaaccaaggatggttcgtgcggcagtgtgattgccacagatgcctgaatgtatatctcttagcaattgtcttccctcctccaaagaaacgcagcgttgcaggactcccgatggactcttcttgtccagttcagtctcatgaatgacataaagtctgctgcacctggagatccgctcgacttcatctttatcttgagggagttcttgttttgttaaaaatattatgaggggctctctccagtcggattcaatcatgtttacgtcttgagtgtccgtggcctcgattgtttctttccttggtacggttggctcatagagatgttcaataaacacgtggaaggagctgcttctcgttttgaaccaaaattagccaatctgtcggctgcctcattgttgtgtcgaagaacatgggtgagcacaagtccatcgaatttgtcctctaacttacgtacctcctgtcagtaagcggtcatgttatcatcaaggcaggaccactccttcataacttgattaaaaaccaactgagaatctccacgaactatcaaacgccgaattcccaaagagattgcgatccttagtccgtgaagaagcgcctcgcattctgccatgttgtgagacgcagaaaaatgtatccacaatacgtagctcagtctttctccagtcggggaaattagaacaacccccgctccggtgcctgaaagcctcttcaacccgtcaaaatgcatggtccaatacttcatcttctccacgggcatgttgtcaaaccgtgaagtttcccccccttttcttgccttaaaaaaattggttaaataaattgcccgaagaaattatcttaattaacctagagctaaatccctaattaataaatgcatttaataatcgaattcggcgtggtggaatttttcttgagttccccatgctccaatacattaacatgatttttagtggaaattttcagagaattggaaataattttaaccaattaaaattgagcaagtgcaatatttttaatcctaggaaaatcctttttctctttttcttttcttttccctcctttttctttgttgggccgtcggcccatccctctcccgtggtccctcctccttgtgggccgacccaagccgcccctcctctctcgggacgccgacaggtgagccccacctgtcggtcgtctcctacctccggccgttacagccggagctccaaccgccgctgccgccaaaaccgccacgccgccgccgtttcccgccttctccgctccacgtcgcgcctccactccgcgcccacacctcgtgcccacgtcgccacccctcccccgctcctcccgcccccacgtgcgcccgagagtgggcggggttcaatttgaatccccctctctctcttcctccccactcccccacatcgccggccaaatcggccaccttcccggccacgtccgccccctcccgcacctttaaatcactcccccgagctccctctctcgtttcccacatttgccaccctctcccgtgcccctatcgccgccacacctagccgctgccgctacctatctccggccgcgcgccgccgccgctagagccgccgccgcgccgcgcagtcgccgccgtcgtgctcaccgagcccgcccgcacctctgccgccgcttcgttgccgcgaatcaccaccggagctccgattccctcgcgccgccggtgagcttgccattgtttccatctccagccatttctcctcgccgtgccgcggctcctctcttctccctaaccccttcactgccttttcccaggtcgcgccgctcccgtccgccgttttccgaagtgctgccaccgctcattccctcccgctccggtcgccgtccctccggtgaggactccctccccctcccttttctccccttcccgcgtgcgccgccgcctttggccgtgccaccgcctttggccgtgtcgccgctccggccgtccgccgcagcctttcgcgccgtccgccgccgcctttcgcgccgtccgccgccgcctccctccgccagtcgtcgccatcggcagccgcgcgcaccgccgccgctcgccatggccggtcggtcggctttgtgccgagccaagccgtgcctagccgccgcccgcgctgtccgatcggcctcgggtcgatccggaccgtcggtcccgtggaccggcggtggaccacctgcgtggtcccggtccacggtagaccagccaccttgtgccgctgccagtggggcccacttgcccgagccccctcttcctccccttgtgcgctgacaagcggggcccacctgtcggcgcagccgcccccccccccttggatgacgtcagccctgggatttattgcgcaataaattgattaaggacattttctttattagtaaaaacacagtttatcttctaaaattcataagtaattcatccgagcttcgtttaagtctattcaagtctcagtaaattcataaaaatgcaaagaatccattaaaaatggttttgtttcctgtttcagtagtcttatagcatgttttgcttgtgtgctttgtttgtcgcgtagatttcggccatttcatcgatccgcagtttctcaaagacgttgctgaggtctcatcagtgcgagagcaaggcaagttatcctttacatttgatcatattgtacccaatttacaaacaccctgcatttctattaaatgttgcactcttttacaatgtcatgtgggatgggtcctattactcagccatatatcatttaccatatgccattgataactggggtatcaaaatgattagatgttggtttaggaaatgctcagccatgcttagttattacatagactttgactatgagcatagttctggattggtgccaccgcaatggtgttagttatttaaaatacaccgaatggtgggttgtgggtgcatggttttgctggtcgcacccatggcaattaaggaccggttcataggaaaccctgggagacttaccgtgcttaccacaagcgggagtgggtaactgcttgatctgaggtatagctcaaccctttcctaggcaccggtggcgagggtgggcgtgatggagttgggtcggccggggtgtccggttgtccagctgccttttgaggggtgggggtgaaacctgtcacaccctaaaaatccaaaatgtataaattgttgtttaattggaatttttagaaatgattttaaaagcctagaagagaagatctaattttaattaataaattccaatataaaatggggccagataaaatttcattaaatactttgcttaattctataattcctagattcttctgggatttatttgagctaaggaagtatttttaataaatggaattgcatttcatgaataatttaaattgaaaaaggattttaaaagtctcttttggctttgggccgaaagtcggcccaaaaccttctctctctctccccagcccaagtcggcccagtccgtagccgagccgcctgcgcgagcgctcactgccgctgacaggtgggtcccgcctgtcggggtcgtcgtcaacctccagccgccaccggccgaaaccctagcgccgcaccgccgtcgtctccttccaaattcggccgcccctttccttctccggtgaaatcaatagaggggaaatgatctccgggatctcctccaccttttctcttttggaatcatcgtttaaatcgctttggaagttcgtggattcgagttcgattcggatcggcctctctccttcgaaccctaaccttccatcgcgtcgccggtcgccgtgggccttcgccgccgccctccaacccctataaaaggatccccaagcccgtcgctacccgccgccacccttgctttcgcctctcgccgtcggtagcgtcctagcaccgtgagacctcgcgccgccgtcgttgccgccgctccagccgtgcgtcgccgtcgctccagtcgtcgccgtcgctcgggaaggctgccgtcgtggtcgccgtcgcgtcgccgtcctcgtccaccccttcgccgtcgctgaagaccgccggagcaccgtcgccgtcgtcaagccgaagagtgccgccgcttcttcctcgacgccgtcgccgtccgttgatcttccgccgccgttttggtcaccggtgagttcgccgcgtcgccctctacgtgctggtgccctccgttcgcgtcgtcgcgccgtcgttcgccggcgagtttgcaagcccgagccgccgtcggtggtgacgtcaccgctgacgtcatcatcgtcgtctctcgtggtccggccgtggaccggtcgatctcggccgtccgttttggatggaaagatctcggccgttcgtttccgtgagccgccaccgtgcgcccggtccaccgcaaccctagccgctgacgcaataattccctttttccttttcaaaaataattcattattgcgtcataattcaattaaaatccatataagtgatttaaatcgatttaatctttgaaaattcataactaattcatcttagctcggatttagttggttcaagtctctaaatttttctaaaattgagatctacatgttaaaaatatccacatgtactgttcatgcttgtttatatgctgttttggtgattttgctcttttctgtttagattccgacgtttccggagagtccgttttcgcaggggaagattttgaagagttccagggccagcaaggcaagtcacacagatcccaaacaaccctttgagcatgttgatcccgtttaaagctattgtttctattcaactattgcatttattttcgaatgtcattgggtggaattaacctattgtttgttataatccttttgttcttgattactttattccttgataccttgggtttttataacttgactagttgggctatatatatattggttcagctagatattagatatgattgcttagccatgcttagaaacattagcacactattgggataacttatgattcactattatttaatgatggcttaatgatagctcacgatggccaatcgtgattggttaattaattacttgccaactaaaacttgataatggtgggttgtgagcacatggttttgagagacatgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataacggggtgattatgatccaggaaaggtgccctgtggtggattgtgttgtgcgaggggtattgtcacagctcctttccgaggtaccgtggtggtattgaggcacatggtgacatgttgtggggctgtcttgtgggtacagtggtacacctctggccagagtaaaactattcgaatagccgtgcccgcggttatgggcgggtctaacaatgtctttcgtgattagtctcacacctctcatcatgataacagatgctataaatggtaataatttgtttagctcctggtttggaatggtatattcctggtttggagatagatctgtacagccgggtatggttgttcagaatggttgggcctatacaacagggtatgttgtatagcgttggattaatagtgtttaattattacttaaccgttttattaaattctgaaatgtttattaaatgttgtttatgcaaatgaaaccctactatgccatcctttggtatcctgtgcacttgcatatttgctgcgtgacttgttgagtatgtcatatactcaccttgcaatcattcatcagaggaagagttctacaatgatgctgatggtgtggaggattaggtgtagccctggtcaagctgcctgtggagtggagccgtctgcgccgtttatcttctttccgctgcttagatctttattgattgagaggaactatctacctctggaatgacattttattcgcttattaattagagtaataattgtactctattatcaatttgttattgtgtgcctcggctgattcctggacgagggttcacacacatgtaagcgtttggaattttggatagaaattccgggcgtgacaaaaccttagcgtggtgtggatggttagggaagggttatgcggagggtcttgtcacgatttccccctttgcagtatcatggtgatacttcggggcatggcgacatgtgtggaatcgtgtcttgtgggtacagttgtacacttctggccagagtaaaactattcgaatagccatgcccgcggttatgggcgatcaaccagattcaccgtgattagtctcacccctagtttagcttaataaactggtgtagttcagatggttggttgggcctgttgcaacgtggtgtagcgttggacagtgtttggttaatattgattaattactataactgttttactgctttcaactactgtttttaaatgcctactttgtgcaaagagcctttagcctccttaggttatatcctgcatcatacctcctcttccggtataacttgctgagtacagtgggtagtactcagtcttgctatcttttcccccacaccagagctgaagatcttcctagtgggaggtgtcttaccgaagttggtttcgtcgctggcatcaaggattgcctgtggagtggagtcgccccgctgcagaagtcaagtttccaagtctagctcgtttttcttttgcgctgcatttgtaatcttttccatttttgtaagacgtggatctgtatgtcaacaattgtcgtttgtgtaccctggctggtcctggacagggatttaatgcacattcagcttcgaaattctggttcgtgaatttctgggcatgacaagttggtatcagagccgagactgaccgtaggacaagccaactggaaacctaagagccctctgaaccccttttcatatgcatatgcctttttcacttggatttgtttcgggaaaattttgggttttgcctctttggtttgtgggaaaaatcttggtccttcattcggatcggatctttaaaattagctcagtctagggttttagtaaaattttatttggagtttatttgacagtcagtcgggaatctatcaggtgatatgcattaggtcgtgtctatgttcgatggggcaattttatgcgcattattttctatgcatctaatttatgcattaatttattgtttagtcagttgcattagtgtctttatctgggttcatgaaaaacgttctatgcataaaaatcagtcatgctaggttatttatttgagtcatttgttgctttgtttaatttggaatttagcatgaattggttcttatcccttgtctactttagatgtcagtcctatccctcgattgcaatcgccgctccgagcttcagagtcgccgcccttagttttatcgtcttcttagttttgtttgcttgctagtttccgtgcttaggtttgttgcttgtgggttagttggcggtcgatatcatgtgtgagtggtatggctgacttaattaagagttgcgtgcctctttttcagtgttttaatcaagattaagataattgcacctaaatttataagaaatattagtttctgagccccctgtttttcttccttttctcatatttctacctatcccccttcagatggtgaagacaaggaatggttcacgtgactctagcaatgtcagtggcagcgaagagcagattagtggagcacgtgccaacagtgcatctgacaacagtccatctccaccgcccgagaacccaacgatcgctcaggtgttggacaatcagactcagatgatgtcaatgatgatgcaacagatgcaacaacagtaccatcaggtgttgcagcaggtgcagcagcaagcacaacagcagcagcagaacctgcagtttggtcttccacctcctcaatccaaactgttagaatttctccatgtcaaactgcccactttctcaagtaccaccaacccaatcgagaccaacgactggcttcatgctattgagaagaagctgaaccttttgcaatgcaacgaccaagagaaggttgcttttgctacacactagctgcaaggtcccgcttctgtttggtgggacaactacgtggggacccgtccagctaggacagaggttacctgggcagagttttgtcagagtttcaataaagcacaggttcccgagggaattgtggcaccaaagaagagagagttccgttccttgcaacaaggaaccagaacagttatagagtatttgcatgagttcaatcgcctcgcgcgctacgctcctgaggacgtgcgcactgatgccgagaggcaggagaagtttttgtcgggtcttgatgatgaattgaccaaccagttgatctcccgagattatgaggactttcagaagttggtagacaaagctatccgtcaggaggagcagggtaacaaaatgaaccgaaaaaggaaggcatcttagttcagaacttcccaggggaacagtcagaagcctcgcttcacgatgggacatcagggtggaccttccaccatgattatccggcaccatcgtccttaccacccggacaatttcaacagcatcaacaacagtggcagtcacagaaatagtgagcagcacagcctcaaccctactccaagtccactaatgattccagctcagtcagttcagtcagctcagcaagaacagcccaaaaagtttggagaaaagcccgaactctgcttcaattgtaacgagcctagacacatggtacgtatgtgcccgaagccaagacgtgccagactcaagttcgttcaggcccgtgtcaatcatgcatctgcagaggaggcgcagtcagcaccagaggttatattgggcacattccccgtcaactcgacaccggcagtaatattgtttgattctggtgcaactcattccttcatttccaagcgttttgctggtgcgcatgggttatctttagtgaagcttaagataccaatgcgagttcatactcctggaggtggcatgaccacaactcactactgcccatcaatgacagttgaaattcaagggttgatttttccagccaacctcattcttcttgagtccaaggaccttgatgtcattcttggaatggattggttgacacggtacagaggagtgattgattgtgctagccgcaccatcaagttaaccaatgcgaaaggagaagtggtaaccttccagtctccagtgccgcagaagccagggatcagtttaaaccaggctgctggtgaagaacaagaggtagcagtggagaaaaccactaagaagttggaggatattcctatagtcagagagtatccagaggtttttccggatgatctgacaacaatgccaccaaaaagggatatcgagttccggattgacttggtacctagaactgcaccgatccacaagaggccttacagaatgagagccaacgagttggcggaagtcaagaaccaagttgatgaacagttacagaagggatacattcgcccgagcacgtcgccttggggtgctctagttatctttgtggaaaagaaagataaaaccaaaaggatgtgcgtcgactaccgcgcactcaatgaggtcactattaagaacaagtatccgttgccaagaattgatgatctgtttgatcagttgaaaggagctactgtgttctctaagatagacctacgatcaggctatcaccagttgaggatccgcgaagaggatattccaaagacagcattcatcgctcggtaagggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagagcatgagcagcatctccgactagtacttgaaaagttaaaagagcaccagctatatgccaagttcagcaagtgtgacttttggcttaaggaagttcagtttctcggtcacatcgtgaatgctcaaggagtagctgtggatccagcaaatgtggagtcagttaccaaatggaccccaccaaggacagtcactcaggttcagagtttcttatgacttgcgggctattaccgccgtttcattgagaacttctctaaaattgctaagccaatgacacagctattgaagaaggaagaaaaatttatctggtctgctgaatgcaataggagttttgaagaactcaaacgacggttggtgtctgcaccagtcttaatcctgcctgatcagacgaaagttttacaggtctattgtgatgcatctcgtcaggggctaggatgtgtgttgatgcaggatggcaaagtggtttcttatgcttcatggcagttgcgtcctcatgaaggcaactacccgacgcatgatctggaattggccgcagttgttcatgctttaaagatttggtggcactatctcatcggtaaccgttgtgaggtatatacagatcacaaaagtctaaagtacatcttcactcaacctgatttgaatctcagacagcgaagatggttagagctaatcaacgattatgatatgggaatacattatcatcccggcaaggctaatgtggttgcagatgccttgagcaggaagagctactgcaatgttgcatgggtagagcaactatgttgtgaggttcaatgtgatttggaacatctgaaccttggtatagttgagcacggattcgtggctgccctagaggcacaacccacactggtggagcaggttcgcatagctcaagcaagtgaccctaaaatagcagagctcaaaaagaacatgagagttggaaaagcccgaggttttgttgaggatgaacaaggaacaatctggatgggggaaagattgtgtgtacctgaaaacaaggagttaaaggacttgataatgacagaagctcatcaaactcagtattccattcatcctggcagtaccaagatgtaccaagacctcaaagaaaaattctggtgggtcaacatgagaagggaaatagctgaattcgtcgcactctgtgacgtttgccagcgagtaaaggcagaacaccaaaggccagcaggtttgctacagccacttcagattccagaatggaagtgggaagaaatcggaatggatttcattacgggtttgcccaggacgtcatcggggcatgattctatttgggtagttgttgatcgactcactaaagtggctcactgcattccggtgcatactacctactcagggaagaggttagcagaactttatctgacaagaatcatgtgtttacatggggtacctaagaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagattttaattgaattatgacgcaataatgaattatttttgaaaaggaaaaagggaattattgcgtcagcggctagggtttgcggtggaccgggcgcacggcagcggttcacgggaacggacggccgagattgatccatccaaaacggacggccgagatcgagcggatctacggcggctcacggcagacggccacgatgacgtcggcgatgacgtcatcaccggcggcgactcgggcggctcgggcgcgcatgctcgccggcgaacgacggcacgacgacgcgaacggagggcaccaggacgatgcgggcatcgcggcgaactcaccggtgaccaaagcaacggcggaggatgaacggacggcggcggcgttgaggaaaaggcggcggagtccttcggcttgacgacgacggcgatgctccggcggtctaccgcgacggcgaaggggcggacgaggacggcggcgacttggcgaccacaatggcgatcttcccgagcgacgacgacgaccggaacggcggcggcgcacggctgaagcgacggcggcgacggcggctcgaggttacacggcgctagggcgctacggacgacgagagacgaaggcgagggtggcgacgggtagcggcgacaccggggatccttttaaaggggttggagagcggcggcgaaggcccacggctgccggcgaagagaaggaaaggtcggggttcggaggaaagagaccgatccgattcgacctcgaatccacgaatttccaaagcgatttagaggatgattccaaaagagaaaaggtagaggagatcccgaagatcatttcccttctatcgatttcaccggatcgggaaagacgcgaccgaatttggaaggagacgacggcggcgcggcgctagggtttcgggcggcggccgacgcgaggaagacgacgactccgacaggcgggccccacctgtcagcggcagcgaactcgcgcgggcggctgcggctgcgaactgggccgacttgggccggggagagagagagagggtttttgggctgactttcggcccaaagacaaaagagacttttaaaaacctttttcaatttaaattattcatgaaatacaattccatttattaaaaatacttccttagctcaaataaatcccagaaaaatctaggaattatagaattaagcaaagtatttaatgaaattttatctggccccattttatattggaatttattaattaaaattagatcttctcttctaggctttttttaaaatcatttctaaaaattctaattaaacaacaatttatatattttgaatttttagggtgtgacaatcaaatactagaggatatgttgagagcctgtacgcttgactttggtggagcatgggacaaaagcttgccgtatgctgaattctcttacaataacagttaccaagctagtctgcagatggcaccgtttgaagcactgtatggatggaggtgtcgtactctgctcttctgggatcagacaggggaacgccagttgtttggtacataagttttaaatgaggcagaagagaaagtcagagctgtcagggaaagattgagaatcgcacaatgtcgacaaaaaagctatgtagacaaccgccgaagagagctcattttcgaaacagaggattatgtgtatctccgtgtcactccgctcaggggagtacatcacttccaaaccaaaggaaagttggcaccacgctttgtgggaccatacaggatcttggaacgtagaggtgaagttgcttaccagcttgagcttccctccaacatgcttggcatccacaatgtgttccacgtctctcagttgaagaaatgtttgagagttcctgaggaacaggcaagtccggatcaaatcgaaatccaaaaagacttgacgtatgtggagaagccgactcgtatcctcgaaactagcgagagaaggaccagaaacaaagtaatcagattctgcaaggttcagtggagtcatcactcagaagaagaggccacctaggaaagagaaaatgagttaaagaccgcccatccgcacctcttcaccaattcttccgaatctcggggtcgagattccgtttaagggggggtaggtttgtcacaccctgaagtttcccccccttttcttgctttaaaaaaattggttaaataaattgcccgaagaaattatcttaattaacctagagctaaatccctaattaataaatgcatttaataatcgaattcggcgtggtggaatttttcttgagttccccatgctccaatacattaacatgatttttagtggaaattttcagagccttggaaataattttaaccaattaaaattgagcaagtgcaatatttttagtcccaggaaaatcctttttctcttttttcttttcttttccctcctttttctttattgggccgtcggcctatccctctcccgcagccccttctccttgtgggccggcccaagccgcccctccctcctctctcgggacgccgacaggtgggccccacctatcggtcgtctcctacctccggccgttggagccggagctccaaccgccgctgccgccgaaaccgccacgccgccgccgtttcccgccttctccgctccacgtcgcgcctccactccgcgcccacacctcgcgctcacgtcgccggccctcccccgcttctcccgcccccacgcgcgcccgagagtgggcagggttcaatttgaatccccctctctctcttcctccccactcccccatgtcgccggccaaatcggccaccttcccggccccgtccgccccctcccgcacctttaaatcactcccccgagctccctctatcgtttcccccatttgccgccctctcccgtgcccctatcgctgccgcgcctagccgctgccgctgcctatctccggccgcgcgccgctgctgctagagccgccgccgcgccgtgcagtcgccgccgtcgcgctcaccgagcccacccgcacctctgccgccgcttcgttgccgcgaatcaccgccggagctccgattccttcgcgccgccggtgagctcgccattgtttccatctccggccatttcttctcgccgtgccgcggctcttctcttctccctcaccccttcaccgccttttcccaggtcgcgctgctcccgtccgctgttttccgaagcgctgccgccgctcatcccctcccactccggtcgccgcccctccggtgacgactccctccccctcccttttctccccttcccgcgtgcgccgccgcctttggctgtgccgccgcctttggccgtgtcgccgctccagccgtccgccgccgcctttcgcgtcgtccgccgccgcctcccttcgccggtcgtcgccgtcggcagccgcgcacgccgccgccgctcgccatggccggtcggtcggctttgtgccgagccgagccgtgcctagccgccgcccgcgccgtccgatcggtctcgggccgatccggtgtcagtcccgtggaccggcggtggaccacctgcgtggtcccggtccacggtagaccggccaccttgtgccgctgccagtggagcccacttgcccgagccccctctccctgcccttgtgcgctgacaagcggagccctcctgtcggcgcagccgcccctccccccttggatgacgtcagccctgggatttacagcgcaataaattgattaaggactttttctttattagtaaaaacacagtttatcttctaaaattcatatgtaattcatccgagcttcgtttaagtccattcaagtctcagtaaattcataaaaatgcaaagaatccattaaaatgattttgtttcctgtttcagtagtcttatagcatgttttgcttgtgtgctttgtttgtcgcgtagatttcggccgtttcgtcgatccgcggtttctcgaagacgttgctgaggtctcatcagtgcgagagacaggcaagtcatgctttacatttgatcatattgtacccaatttacaaataccttgcatttctattaattgttgcactcttttacaatgtcatgtgggatgggtcctattactcagccatatatcgtttaccatatgccattgataactggggtatcaaaatgattagatgttggtttaggaaatgcttagccatgcttagttcaactagtacacaaaaggggatcacattattacatgagcatagttcaattttgactatgagcatagttctggttggtgccaccgcaatggtgttagttatttaaaatacactgaatggtgggttgtgcgtgcatggttttgctggtcgcacccatggcaattaaggaccggttcacgggaaacactgggagacttaccgtgcttaccacaagcgggagtgggtaactgcttgatctgaggtatagctcaaccctttcctaggcaccggtggcgagggtgggcgtgatggagttgggtcggccggggtgtccggttgtctagctgccggattcaccgcggcacaagaggggaccgcccactaccttttgaggggtgggggtgaaaccttagcatggtgtggatggttagggaagggttatgaggagggtcttgtcacgatttccccctttgcagtgtcatggtgatacttcggggcatggcgacatgtgtggaatcgtgtcttgtgggtacagttgtacacctctgccagagtaaaactattcgaatagccgtgcccgcggttatgggcgatcaaccagatttaccgtgattagtctcacccctagtttagcttaatgaactggtgtagttcaggtggttggttgggcctattgcaatgtggtgtagcgttggacaatgtttggttaatattgattaattactacaactgttttactgctttcaactactgtttttaaatgcctgctttgtgcaaagagcctttagcctccttcggttatatcctgcatcatacctcctcttccggtatgacttgctgaatacagttggtagtactcagtcttgctctcttttcccccacaccagagctgaagatcttcctagtgggaagtgtcttaccgaagttgatttcgtcgctgtcgtcaaggattacctgtggagtggagtcaccccgctgcagaagtcaagtttccaagtctagctcgtttttcttttctgctgcatttgtaatcatctccatttttgtaagacgtggatctgtatgtcaaaaattgtcgtttgtgtaccctggctggtcctagacagggatttaatgcacattcagcttcgaaattctggttcgtgaatttctgggcatgacacatgtcttcttggcactcagtccactcagtgacgaagtcggcta

SEQ ID NO: 73633 - DNA, 20046 bp, Oryza sativa
caacctttcttccttggttcatgtttctttaaaagcaaataacttggtggggagcatccctgagagcctaagtaagatcccaaccctagagaggctagttctcacatacaacaatttgtctggtcatgtgccacaggctattttcaacatatcatctttgaaatatcttagcatggccaataactcactcatcggccaactaccaccagatataggcaacagacttccaaaccttgaagcattaatcctatcaacaacacagttaaatgggccgatcccagcttctcttcgcaatatgtccaagctagaaatggtttatcttgctgctgctggtctcactggtatagtgccatcttttggatccttgccaaacttgcaggaccttgatcttggatacaaccagcttgaagcaggggactggagcttcctctcatcccttgcaaactgcactcaactgaaaaagttggccttggatgcaaattttctccaaggaaccttgcctagctcagtcggtaatcttccctcacagctcaactggttgtggctcaggcaaaacagactttctggggcaattccatcagagattggtaatcttaagagtctcagtgttctgtatttggatgagaatatgtttagtgggagcatcccacctaccattggaaatcttagcaacttactggttctaagcttggcacaaaataacctctcaggccttattcctgattctattggcaaccttgcccaactaaccgagtttcatctagatgggaacaacttcaatgggagcataccttcaaacttagggcagtggagacaattagagaagcttgatttgtcccacaattcattcggtgaaagcctgccaagtgaggtcttcaacatttcttccctgtcacaaagtttggacttgtcccacaatttgtttactgggcccataccactagaaattggcaacctcataaatcttggaagcatcagtatttcaaacaatcgcttgaccggggaaataccgtccactctagggaattgcgtgcttttggaataccttcacatggaagggaaccttcttactggaagcattccacaatctttcatgaacttaaaaagcatcaaggagctggatctctctcgtaacagcttgtcaggaaaagttccagagttcctcactctcttaagttctttgcagaaactcaacctttcattcaatgactttgaagggccaataccatcaaatggtgtctttggtaatgctagcagggctatcttggacggaaactacagattgtgtgtgaatgatccagggtatagcctgcccctttgccgtgaatcaggatcacaaagtaaacacaagtctactattttgaaaatagtaattccaatcgcagtgtctgttgtaattttattgttatgtttaatggctgttctcatcaagagaagaaaacaaaaaccatctttgcagcaatccagtgtgaacatgagaaagatatcatatgaagatattgccaatgcaacagatgggttctctcccacaaatttggttggtttgggatcctttggggctgtttacaagggcatgttgccgtttgagaccaatccagttgctattaaggttttcgatcttaacaagtacggagcacccacaagcttcaatgcggagtgcgaggcattaagatatattcgccatcgaaatcttgtcaaaatcattactttatgctctacgattgatccaaatggctatgattttaaagcacttgtctttcagtatatgccaaatggaagtctggaaatgtggctacatccagaggaccatggacatggtaaaaagagattcctaactttgggtgaaaggattagcttagccttggacattgcatacgctttagattatcttcacaaccagtgtgtatccccactaatacattgtgacatcaaaccaagcaatgttcttttggatcttgaaatgactgcatatgtcagtgactttgggttggcaagatttatgggtgctaattcaacagcagcgcctggtaactctacaagtttggctgacttaaaaggatccattggatatattgcaccaggtgagagaaattggaaacttatactgatttattgacctgtatgcttcagccatcttattaacttatccaatgttacatggattgtagttttcctccattcgccattcttatgttttcaaatgaaaatgcagagtacggaatgggtgggcaaatatcaacgaagggtgatgtctacagctatggagtgttgttgttagagatattaactggaaagcgtccaactgatgaaaaattcaatgatggtttgagcctccacgatcgtgtggatgctgcatttccccacagagtaactgagattttagaccccaacatgctacacaatgatttggatggtggaaactccgaactgatgcaaagttgtgtcctcccattggttaaggtggccctcatgtgctccatggcatcaccaaaagaccggttagggatggcacaagtttctactgaactacagtccatcaagcaagcattccttgagctttccagtggaggaaaagtagtgtgaataactccccggtggtgtgcaaagctatgttgctttgcaactactgtgtaaggctacttctattaccataactaagcctatatataaacaggggcagacacagcagggggtcaaatagggctcaggcacacctactgccgccaggccccctggaaaccataccttattcaggaaccaagtccacactaatacaagccaatctcatggcttcacggtacagtattgcgtataggctgcagccactcgttcaagggaggcaagcagacacatgtcaacacagatttagcagccattgatgctagtattggtcatcaacagatctaacccaattaaaccatttttgctaacttttcttagctcagcccatgacagtataaatcaacaacaaaagctttgataatgttcatgacttagtggtactacgtattttaatgataatcttatattggtcttttaaactagcacctcctaaaattttgttctgcgttctccactgtatataaataacctcatgaatctattatgtgtttaggaattaggacagcaccaaatgcaatgttagcaggctgtcgacacacccaagatatggttacaattccacggtagttagtcagcggcacaactcacaccacacaacaggcataataacgcgcatagagcaaaacgggcacacagctgcgcccgcccaagtgcgttagtgcgtgctgcgcgctactactttcagaggcatttccacaaacacgccacgcgcgttcgaagtccatacacgaaatccagcacacacaggcatacgcaaaaaattcagaaaagcagtagcacgctgaccttggagaagacggcgccggcctggcaaacctgccgccttccgccgcgcctgcgccgcccatcgtctcgtcttcctccgccgctccgcggcggcgcgacagggtcgacgccgtcgaagagttggagaaagagagaaagggagggtgacaaaacaaggttgggtcgggccttgttgatgttgggctgtgggcaggccgtcctcatagatgtattccattctctctcttaattaactttctagtagcaagttttttttcctctcaaaaaaatctcatgtaaattccaaacttttttttcattttattttttaaaaattacatatttttttcatttaagggaagacatacacatgcgcatatacgcatgaatgtgcgctttaacacatcctataagaaacactcttaatatagttacaattttattgaaagcattttcgtggtgtgatatttatgagcagcatgatttgaaccagatgaaccaccacatatcggtctttcctagtttcaaataattttattcgtatgagcagatagttcatctttattcaacagtttcagatacgtttggagcaaatttacatagactcgaatacaaacttttgggcatgaatttctagctatgtgctatttttttaataatgaaaatagattatatctccagtctttggcaatggacacacatcaacaagtttcagaagaatttaaaatagatgtgatctatgtgctacttaggccctgtttgggagagtttgtcccagctgcagcttttcctaaaagctgcttctgctagaagctgccccaaacagtctaagattctgaaaaatgaactaaaaagccagaagatataaaagctaggtttcagagcttttccagattctcagaagctggctaccaaacagctgcttctcaaaatttaaagctcccccaaataaacccttagattggcttgctatgtcctggggcctggccaacgatacattccacgtcgacctacggaagcaaaagcaattcagtttataataatgctgctataaatttagaggggaaaagtgaaggaatatttacatatacttttatgggtacaaacggacgattttcctaccatgttttttcgaggattcttaattatcaactttaaaaatagtaccaagtcatggtactatttataacctaggaaaagttctatgattaatatttagacaaataagttcgatacatcttattagttatatgtatataggattatatcttgtgcacccaagatggttaaagtgtcgtacttgaaaagaaagatggttaaaaggctcttcttttttctacatgtaactacattttctggtggaatacacttgcctgtcggcatgtattggttgccatgcacggacgagattggaggattgtgagccccgttgggaccactaccatatccatctccatgttctacaaagcaattatgtaaattttaaaccaagttgaatttcgtgtattagaatatgttatatttttccttaactaatagctaaccgatgttatatgtagatatttcctctggttctaatatgcagtacagttgagtagttttacagcttttatacaccttttctatttccattccatgtttattaccctttccaaaatgctactactttcaaaaataaaattgtctcatattttaaagaaaactcttacatatttttctagattgataaactattttttctacaagtagctaaattttcaagtgaaatacacttgcctataggtatgtacgggttgttgtacacgtaagagattggaggctcgtgaaccccgccgggtccaccacctccggctccacttccatatccacctccaccttttacaaaatcaacatctttaaataaatttatgcagtaaatttttaaacatggttttgttttgagtattaatatattatttttttcctttacccaataggcagcatatgttcatatatgactatttcctcttatccgaaatgcattgcaagtagtttcagaacgtctatacactattttaccttttatttcaagtttatccttttcataaataaatgtcccatatttctatagtaaaatataaatgaaagacaataaaataatctaatataccattttaaacttctattagtaatgttaaaaaccaataacttcatctgaaaccagagtacaaatcagaggaaatgttccaccggcgtgcgtcctcaccagcgaaagggccaccgccgccggccaccggcggcgcccactgcggagggaagaagggcggcggcggcggcggcgagagcgcgagcgaaagcgacgacggcagcagcagtagtaggaccgacatggccgacgccgctggcgctcgtagcccgaagcgaagccgacgagctgctcccatggccgcagatggagctcgctctactacacttgatcaatcgctctctgaaatctgaagctggtagatcactcggctgtagttctcacgtccaaggctttgccccccatatatatacaagataaacgcaacgacgcggttttgctatgacaatgcagcttctctacttgctacttgctagccagctaggagtgggcagtccatcagtcaatagagtagtatacagttcgaactgtagtgtcaaatcctgctcaatcagccacaggttctgattataatgtatactaatattatgcttgttttgagaggacgaacaagtggattgattctgcgtctgaccactgaaagattaggcctgaagtttccctaaggtataccaaacagaatctgcttgggatttgtaaaagaaaatgagccaaagagccttccaagttccaacataaaaagctctccacaataacgacggtgacaaaaatcaaggaggaagtcaagacctgagcttcaggtacaatagcaggctataagtcagctgcaaacatattttaaggagataaatgagaaaagagaagagcagcggactacatatttgtagccagctgtaacacgaactccaagacacagtgtgtacgataggtgggatcaggtattaatagtgtagtgtgtaactattgtataaatgagctattagattggctatagatgaattgtagccagtagttggctatactcctaaacttgctcttagccagagcgaaacgtctctcgaagctaggggtagtagtgaattagggcccgtgggcgctttcacaacccacttcagcctttaaatatttttagctaaaaaatgtattaatttttagtacaactctttttgaactcagcccttgcattttgccacccctgctcatagctcatccttggttttactttttgtgcggttctcctttttacttatacaaaatttttactcctactttattcaatgaaattaggacatctagtactggttcgttaaaaaaacaagaagttccccaacatcttaggctactccaaccatgagatgaacaattcttcatggttactgatcaggccacggaggatgatgcactgtcactctccctggcaactctgatgaagacatcctccagcgttgtgtcagccaagccccaggcaagaacgttcatcctgagcttcgcatgctccatggcccggaaaacttgagagatcctcacctcctgcttcgccatctcgaacttctgcgtcccggagatgtggtacacaatgttcatggtaggggagatggactggaccagtctcctcatctcctccgcctcgcctgtcgcggttgttactgtgaggacatatgagcctccatattttgctttcagctggaaaggcgagattttgggggttcaagttactaagttagcatttgggatcaatggccatatatgaaatatgtgatcagtttacatgtgtagatgtacctctttagagttcccgatgcattgcaagctgccgtttgcgataattcctatccgatcgcatagaaattcagcttcttccatcgaatgcgctggaaataggtgaaagtatgatgtgataatatgatgtggtgcaaaagatttccatggtgattaactggactaaggttatactgttgtatcagagttgaaagcaaagtgcagtacttgtgagaattatggccctgtcctgcttggcagacttgacagcattccacaagtctttccttgatgctgggtccaaccctgagcttggttcatccatataaactacctgcagaatgttaaaaaatgcatgatttatacatgcaagaatgttcaaaatttccctgaatttgacatatatgaattgtaccttagggtcaccaattagagagattgcaacactgagacgacgtttcatgccaccactgtatttgcttacaagcttatcggcaatgccaccagcaaacaggcgcacacttttcaaagatttctcaatggcctataaaataagaaatatgagatcttagatgattgcttcagaacttgtattttataataatttctcgtgaaatcataaccacataagaacagaataactactgggaaaatgtttgttgaaccagtatttataataatctgtgctaaagcgccttggacgataatgtgtcttggatcttatgtgcagatgataagctcatctttcacttgtaaatagtgtttgaagtcgaatccatcatgttcatccatggaaaaaaatcaccatatattacttcttccgacattattgactttattgggtcaaacttttaaaactttgactatcaatagctctcaagatatttagtttgaaaacataaaaatcatatgggtagaattttacttataaattataattgcttttacaatattatagtttcgttagatattatcgctatattccaaaataaaaatagtagctaaagttgtgcactaagactggataaaatcaacaaaattatatatttaaatacagaggtagtacgttatttaccaaatggtcacatattacctgagataatggtgcaccccgcaaattcttaagtctaccatagaacaacagatgctcgcgaccagtcagtgtttcccatagcaagctgcaacaagaaaataaaagaagggggaaatttaatttaagttcaccaatactaaattgccttaaaggctgtcctaaactaaacaaaactgtaattcagaaacatcagagtgagattagattactcatgctgtggacaaacaccgattcctgcataaatcttgttcatctcgaattgtatgtccattccttcaatgtacgccgtgccagacgtaggtttagtaaatccagtcaactgttgtcaggataagaattaacccccttaaccaataatgtcatgtgaccaaatgaaacatcagttatatttgtaagtaatctatatagggatcatttgtgacaaacagaaaatctggatcatttcttactacctagacatgttttcagatttttagaaatgtatatgcctgttcctggccttgaaagtggcctgtactttacatactagagatttatggctatctaaatatattatttatttcttttattattaagatctaaaattaaatcatacttaccatgttaataagagtggtttttccagcgccatttggtccaagaacaccaaaacattgcccacgtggcatagaaagagatagccctctgacagcaattttttttgcattcccatcttttccatggtacactttcttaaggttgtcacagatgatcgagtagctattctttgattcttgtaagatctgttcaaccgtttctctctgagaaatcatgatagaacaaaattaatactcatgatgctctgtgcaaatacatacatgcaggactaatttcaacatattatgcttgtttaaactatcttatgtatttgtattccatacagcattgaagtttggtaaaaagaaaaaaggaaggtaaaaataagataaagtgagactccaagtatccaagctaacttttgacgtgccatactataaaggataaactgacatataagctgcttctagcctatgattagaaagcttaacataaatggtcagaaagaccaggagtcttaccagctagcaccacaagttggtgggctagccggtctgggttcgagacttacccctgcttaataccatcaatatgaatatccttcctttcatatccatcattttctttagaaattacaggaatatacagaacaaaagagcatacctctttgataacatctgtcttctcattgtcagcagaagctttgaactcttgaagctggatggtctgctgagtagcttgaaaacgattcttatcaatgtgcgagtgaaatagtactgctgcttttcttattcccttttggaaggaaccgaagtgatccaaatagaatgccaataaaaggaacagaaaccattctagtaccattatggtcaaaacacttctcattccatttttgggatcattcaagtcaacccacttcatcccggaagagttcatataattcccgagcaatgcagattgtgcaaactcatagataatgcgatacaatgaaaatgcagggaaaagctccaaaagtgtaatccagcttccttgagacgaacaaatacaaaatttccacaaaattattggaaaatagtgatagacactgacatgagaaaaacactaaaatcatagatattggctgcataaaaatatcccacatatttatctttactaattagacaccaccattttaatcctacattcatcgggtataaagaaccatctgttatatgcaaaggaaaacatgcattttttttagataatgaaacaaaatacagctttgattcaaaaagacagtatgtttttattgattattaagtagattcaactgaaaaaaaatgatttctattaaaggaaaactaagaaagttaccatgacgacagctcatagcctcatacacagccaaataaaaagaaagatcctatggccactatagcaagactagcaagagaaaaacataagcacaattgtaataatggaagggacaaaatggatacagcgaacaaagaattacggtatcattgtaaaagataaacttgtacatacttgagaggaaaacatcttcaacataggacctgaataagaattctcctaaaaggccagaaccaattatgtagaagtatcctgtcactgaggcacaatatgccaaataatcaaagtaaatttcataatctgacaaaatggatatactgagattacttatatatcaaagcataccagtagctgtgctcacactagaaaagcatgacgcagtaagaaatgcgaacgaaatttgtaaattcatataggcgaagtaatacacaaactgcacactgtagtcgttcagtcgaaagaatcttaaacctgaaaacagataaaggtacaagcataagcaacttgcctccaatttataatttttccatgaggtttcttttttcttgtatcaaaccaggaactaagaaaaataggtgaaatatcagaattctgagaccaaaatcactgaatacatcctagataaaaaagattgtcttaccaagaacagaaccaaataatgtgaaggacatcacatagagcagcgaaagaagaaaaaaatagcagtacgagatagtccaatatgaaaaatcaccaagaccatgcatcttcatcataatccttagcttcttttgcttctcgtatacaatgttggtcaaaattacctagagtattaattcattaaacattacaaattaagcttgcagctcagttatttgcttgtaaaagtgtcacaaaaagtcacacatgattcaaataaactggtgcaatattcataccgggaaaagaagttccatagtccatacataaggaagttgccctattaatgaggatatatcaattggcctcattggtcgagctgctctgggcatgtctttgacaaaatcaaatgagatcttgaggccactggcccttaggtgaaggtatgcatttgaagcctgcaatgtttaaactatatgaaatgcagagcagtgatgaagcataagaaatcatcaaatagctagtaaacagaatagtacacaaatgagtggtaaaatacagatttgagaatggtatgcgtgcaacactgataaggttatatatgcgatgatatatggacaaatattcatgaacaattagggaggatataatgaatgtaaattatcgacatgtccaacttttcaacttggaaaaaaggataccatattgattagtcgtgaaacttgaaccaatctaggtgcttgccatgctccttgattaaaagtgagtgagatgtcttgttcataagcatcaaacttttttgttgagttatacgagatgaacacgttaaagttgccttgatcagaacttaagaagtcataagctgcaaacaatgaattcaatgttaatgagtggcagatttgaagaactgattgagggcacattggagattacctgcagcgatttcattggtcttcttcttattatttccttggtagtaacctctatagagttcatcgttgatgagccacaaactgtcacgccagagcattaatccttgggtacattgcacatctattccatgtccaagtaaacattagaataactaagttgtaataacattgctagttttgaaaacagagaaaatgtctgtaaatgaatttattcacttttccatgttcattagaaccttaatagaccagtattgagaatagttgacaccattggtacggcacatttttctactaaacaatgtgcaacccaacttttgtatcttacatgtagaaaaacttacgtttagtctcggttgtattgccactttgatatgtaaaagaaagtgtctggtttggggtgcatgtcttctgaagaaaggagctgacttcaaaggaattgaaatccaactcatcatctgcctctgcctgcaattatagatacatcacaaaatgcctcaacacttttccatcttctaaacatacgcagcactaatacatactattctttaaaaaaaaagatcaaccagaacaaaggtcacactgaaatcaaggacactaaccagaacataatcagacaaagcggaaatgtcagacggtagtttcgccgaagaattatgagcagggaacatattgtccatcacccctgcatgcagatcaagctatcaaagactgaaagactgttcaccgtcagagtaaaactacaagtcaacatatgcatgtcaatagagatcggagatgtaaaccattttcagtcttaaaaaaggagaaattttatagtccttaaaaagtatccggatgtacctagattttacattttagtacctcgagatacctactacttagagatatcaagttttacatttgaaaatatgtttatatccagactcataatgctactcgttagtatcctattttatactaggtaaacactcctttaggacgatcttgtaaacacttgtaaccctcattttcttcttaataaaatttggtcggccaatccttcggccgacccggtaattttatactaggtagcaatattttaggacgaagatagtacttcccgatacatttttaaggatggtaaatttttttttaaaaaaaataaaacaacgggacaagagcacaaccttgtaactgcaccaaaagaaaagaaaaaggagcatacttgctacaaacgatcggttgccgccggtgacaaggaaggcggcggcgcaggacccggcggctctgcacgaggcggcgtcggggagatcgccggcggacgagaggaggtccccgtccccgacggcgcggcgctccggcggcgggatctgcagaaggggcggccacttgggggcacgcggcagcgcgcaccgcgtcgggcagtccaacccccccgtggcgttcgccgccacggcaacgccgccgccgcacccgccgcagtcgatggaggcggcggcggcgaactcccgcagcatctcgacgttgatggcgatctggaggcccccgatggccgagaagaggagcagcgggaagaggacgatgcagcagttcgtcttccccgcccgcctctgcacacaagaacagcaaaatcgagctccatgggtgactaatcttgacgaagaaaaacaatcttggtatgaacaaacatagcaaaatgggtgggaaatcgaatcttggaatcagaaaaaaaaacaaaaaatcgtgcagcatcggaatcaccgcattgaacataacgagaactaatcccctgaacatgcgacttcttttcacccaaatccgcgagcagaaaaaaaaccaccactaaacaagaagcatttcttcactgattctaagtttctgactactgaatcatccaagcaagataacgaagaagccacaaaaatgttctttcaaagaaaggcataattctgctgataaaaactctacggctcgacgaaatcgagcccgaaaaacgaagagcaagatcgatcgagaggccatcaggccatcacctggatgacgaggcttttcctgaagagggcattggtctgcgcgaggcagctggctgccatggcgctcgcagctcgcagctcgcctcctccaacctcggagaagccgaagcaacaagagaagagacgcagacgctacactctcaaaccggcctgagtgtgagtggagcgaggcggcaacgttaatacgggggaaaagctttgcctcagcgaaatgacggttttgccctcggagagaggcggcaacgttaatacgggggcaagctttgcctcaccgtaatgacggttttgcccttgggagtgaaggaaagtggccgcaagtgggtcgtcgtcaactcgtcatcagtcgtcgcgagtcaaaggggaaatgacgatcacgagttttttttttcttggtatgaaaagaaagaggaaatgtgttgcaaatttgggtgacctgaattaatacgcggtctcattgttgggtgggtatttgctttttttatttgggggaataaagatggttttggcatagctatctatctacagcattgaatgtgtgaggacttgagaatgtgatttgaaagacattattggctaggcctgtgtgagatgtgatttgtaaaccattattgattttaaatttcaaaattaatttattgtttttaattttatgtttttaacctcacacatttaaacaatgaagaatactggtataaaagttttgccaaaattatttttttcaatgttcgatcaaataatttgtggctgagttcgtttgctgcagttgggaactaatctcccgtgtacacaaaacggagaaactcattagcacatgattaattcactactatacaaaagatttttcattgcagaactggtcgcgtttaggaaaatatgacctatttttacgtgcggtccatttaagaggaccacatggaaaaatcgatttttccgtgtggtctttggacagcatattttcacgtaccgacctattaagagaactactcggaaaaatacccaccctctctttccctcctacccactttctctcctctcctctttttctcatctcctctattactgtctccactttcgctcctgccctctgctctcctcccctccccttccttccctccccgacgacggtagtggcggcggcgtggcgacggcacgcgggatctggcgggtggtggccaagccccacaaggatccagcggccagctgccctcccccgcgggatcccgctcccctcccctccccttccttccctccccagatccagcagaggggagggcgttggcggcggtgcggcaggaagggagcgcggaggtcggcgggagggcgaatccgtcggccggcggcgcagaggccgccgccgccgatgatgagagcgggagcggcgtcctcagccgccgctgacaatgaggaagacaatgaggaggacgacgatgacgaggaggaggaagaggcgatggcgccgccaccggattcgtttttttgaaaaaaaaatttccggatttttgtttttccgtgcgggcaacataagcacctgcacgcaaaaatcgcgattttcgcagaccgttggattcgtgcgggccgcccacccacacgggaaagccggtctcgtagtagtgattaagaattagcttttttcgaaaaatagattaatataattttttaaaacaactttaataaaaaaatttatttagccgtttgaaaagcatgcatgagttggaaaaggaaacaaacaaacacaacctcatttgtcttccaggcgtacttttcacattggcacgttgatcccatatgaatcaagagcataaattccaggttgcaaatttagcatccgaattgcttatttcatttcattcatcaaaatatcttcacaaaataggatggaagaaataaaaatctacacgacgcacgcgtgtcactctctgcaaattatcttcatgtcgccacgggcatgtcgtactgcctgtatccatctcttcaccagcctagcgccgccggcacggcggcgcgggggcggccggacggcgcgacgatgttgccggcggcgtcgtagttgatgacgccggagaactcggggagctggcacttgccgcccatgaggatgttcttctgccagacgcacgacggcggcccgcccagcccgtcgtccgccagctcgccgccggcgccgacgccgacgacgccgggctgcacctggtggatgctgacgatcaccggctccgtcctccgccggctcacgctcgccagcgcgcgccgcagccgctccggcgccgcgtgcgacgcgcacagcgccagcgccagcgcgcacacggccaggaacgccgccgccgccgcgccgagcttcccgcacgccgccgccgcggccaccgccggcgtcgcagcgtgcaggacgaggtggtggcgcgccattgctagctagctaattgcaattttctcgtgtgcgagagatcgttcaggctcgcgtcgttggtggtgtgtcttcctgtgatttggagctcgctagatttttatactaggtgaggactagctagagtttttttttttaaaaaaaaatgttcccgcgctttttgtggagttgttttacttgcttgcaaggagcagcagtgcatggagttggtaagggtagtttgctagctcaaacttgcctaactcaacctgaaccatttcacttttcaagtcttgtggattgccaaggtgaggtgacactgtacatatctgtaagctgcaagcctgctcctactagaaattgatgtaggtcttgtttagattcaaaaatttttggcaaaaaaatataacatcaaatgtttggacacatgtatagggcattaaatatggggaaaaaaactaattgcacagtttgcatgtaaattgcgagacgaatcttttgagcctaattacgccatgatttaaaaatatgatgctacattaaacatttgttaatgacggattaattagacttaataaatttgtctcgtagtttacagacgaaatttgtaatttattttgttattagtctacgattaatatttttaatgtgtgtccggatccttcaaaaactttaaacacacccttagtactgtagcttttttgtggcagatgtaagttaagggtgcaggatggctattgttttgcttcactgggagtgagcgttaactgttttgttgttttcacatcatcaatactccatataggaggaaaaagtgatccatatctctatatggtcttgctcaagtactgtggaagtgagccacatatagcagttcatatgtatatgagcagaccataagaataaaaaagtaataatattctcttctaagttcccatcatatgctggtgggtcccatattaaagtttacacatcataaaagttgaaataacaagagctcactgcttggtaaatacagcactgcttgtgatgagataaaaggaaaccttattgatcttaaagaagatgatataaatactccaagactacctctagcctctctacctaggatgcacttaacctatatttattgaaaaattaagaatgaaaaaagaacgacatgataacgaatatcgagctacaagcctacaaccacaagcgattttcatcctcataccacaccgaagcaacactcggactgcttcgtgattattgcccaatagtgaacaaatagaaaatacctcaaggtgttgccatttttgctgttatctctcaagcaatccaatcctagttcttgttcgacaagaagaattgtgatgtttgacatgcatttttcatttccatgagtgtgaggatctagatatatcatatatcatggttttggttttctttattcatgattactctatctacaacacaagtctctgcataagttcatcatattgccgttttgccattccattccattccaaacaagaaaaatactagtgaccaaggctgttttccagttcatacggcgcataataaatcaattggagtgacaaatgctaattcaaacttcaaagcacataactattttacgtgcaattggttcgtcgtatcccctgcttcttatcacttaactttcaatttggggcaaaactctctttcaagatcctgagggcttctccaatcccgtcctgcgaaaagcaacatgaaaaaaagttagctacagagttccttcaaagaaaaataagcatggttagcattcgtaatctgttagtgaagaacacgcctcagaagaaagtttgttagcgattctggttgcctgagctttaatttcaggtgataatgccgatttgatagctccaatcagcatatctgcagcactgttgatgcttgaggcattgtcagtatccggaattagatgttgtcttcctaggggctcaggtgccactcctagccagtgtagcctttctgcccagtaaaactgatccagcaggaaaggacatgaaatctgcatgacaggattgtgtgagcaatctgaaaccatctaataacataattttataacagccatgtaatatgttgagtatagaatatagaacattatttgaatatttgcctgtcaccctggaccactccataggttgtttctaagtgatgtcaaaaacaagagtagaaagaacaacattgaaccacccgagtgatcaaacaatacaaaatatatcggtgcaaagctgctgtatttatcacctgagggatgccggcaaaaagtgctgcagctgtagatccactgttatggaagtattggataattagaaattctgtagagtaatgggaaaaaattttcaatcatatgctgggccacagtgagaaaatgtaaatttattttacctgccagcatggtgaatagcaactgcacatttaggaaacagccaactgtatggtattgatctgaaaaggtagtcatgtcattggccagtgcatgtacaggtttccagcaagaataaagagatttgtgatattactcacccagaaaagcaaaagagtcgaccattaaaaaggagattgctgtcacaatgaagagcagatgcctgatactcacttgattctgctactgaaggagcaaaatattgtattgcagaatctaatggctggtatccagatgagaaaaggataaatctgtaatctgttttctctatgacagctttaagcaccatcagaaatgcttttggatttctaagaaaacccatgctgcaggaggttgatgtcatgataagtataccaagaaaggcctaattcaaatttttgctaatgaaatagaagaaatttgactcctaaagttatgaaaataagcacaaaataagaacagtgagcttgtcaacagcagattcaaaatgcgcatttgtgagcggtcgatacttctaagggcatgagcgagatgtcaacttcatcaagggtgattctcgtatcttagtaaggtacaaatcagataacacttatggagaaatcatacagctctaaagtctaacaaaccaaatgttaaatatataaacatatcaaggacactgcactggctaagagaaatgtcgttgtgaaatagaaaaacagacataaattcgttagaataagaaactcacctaccaatggaacttaatcctataaatataggtaaggacgaataagaatttcccatggtaaagtgttctaggccagcatgatttacacagagagcaccaccagaattactggcatttccacacagtaactccttgcatttattacaagaaaattgccaagccataggaagaaaccaaaaaccacaaacatgagcgctgaatggccaatatcctgtcatgatgttacacaataaatatcaaactttggtttcatgtgaatgaatcctatattattatatagttcattcccactaagtatagttaatgctatttctctcttatctcatgaagctacatcatcccaattatttctactctttggatgatagatctatggtacaaacacttctttcttctctcataaaaccatacaatctcaattatttttaggctcaaaattcataagtatcaattacataaaatatgttcaccttgcattatatttgcaaccatgtgtaaattatatagaacataggaagtcattttgttttggcttagaaaatatattacagcttatttgtatatattttcctgcagcaaatacggcggggtattcatctagttaagtataaacatcctgtaaggatttaaggtagatacaaagacctcagc

SEQ ID NO: 73634 - DNA, 12540 bp, Oryza sativa
ccgctcgtcactgcgcccatctcggcttggtaatgccaccctccgttctcccttcttgctcgtccactccctccctagctcgtgtggtagctcggctagcccccccgaacacgcatggacactgccccaggtctcgccgccaaaccgccgctcgtcgcccttgcaccgcacgctagctcgccggtcgccatgctctgtcccggaggccgtctctcgtcgccagccaacctcggtgccgctccgtccaatccgacgccgggaacggattccttgaaccccggagatgctcccatccctttgaatcgaaccctcgtcgtctcgtcgtgttttcccctttttgctctccggtgattgccgccgccgcaatccgccatcgtcggcttctctcgcgtcgattcctctcgccgccacgcccccggggatccccttgacctccccctggctgccccaaggccgtcggccttctcctttgtctccgcgccgtgtcgccgcttccgccgccgcataacgccgccgtgcgtgcgccgccggtgaccatcgggtcccgcgtcaccgcgtgcgcgacgcaacaccataccggttcggctaaacccgagcccgcgcacccttcgctctcctcgcgcgcggccacgtcggcatgccggcgagattggccgccgccgccggccgtcgtcgcgcgtcctcttcctgatccgagccgtggaatgagttccccttctcctcctcctgccgccagtgctagccgccccttccggctcgccgccgttcgccggatcccgccgcatgccgtgagccgtcggatcagcctgcccggcctcctctgcctccccatctgacgtgacttccacgtggacgccacctcagtcccgggcccgcttgactgggtcaagtcgcgcccagtcagcctcctctctccgtcttccctcccgtgcgcgctgtccacggcaagccgtgcggctgcacgtgggcccgccgccatccgtccacccggcgcgccacgcctgaaccgcgtgcatccgaaaccctagcgcccacctccgcgtgcaccctccccaccgtgaacccaaccactgccatgtgggtcccgcgcggtggaccgcgcccaccccgacgggccaccttctctccccgcgcgccccttgggccgccctcctcgcggccgtgccggcccattaggctcgcccgagctgcgcaagtccctcgggccgcgccaatgccacccgagacaagtctgattgacatccctccatccttttctttttccagggatttaataaatcctttttcctttgtcccataaatcaattccttattccaaaattccacaaatcatttcctttggtcccgcgcgtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcatgccaaatcgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataaccaaagtgcaaccacaaggtggaatgggacaccctggctaagtaactagacggttcagggaaacctcgcatgccaatagttgggaacgccggggcggggtcggacaaaccgggttcctggtaaggcaaggacgagaagcttgctcacttaccgatcaaggtggttggagtttgatttgtgcacgcctaaaatggcctatgtttatgtgaggatttgatccttctatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacaaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaagcatctcctaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgttgagtacgaaagtactcacccttgctctatataaatatatatatatagttcctccgccctgaagagaagataaagtaaagtgaagattagggtttcgtcctggttcccagccgtcgcctgtggtgttgggtgttagaccgttggttccgctgctgctgctgctgttggtgtttcctcgtccgcgtcgtcggttgtattctcgggctgtctgagcttgtcacgcccggaatttctatccaaaattccaaacgcttacatgtgtgtgaaccctcgtccaggagtcagccgaggcacacaacaacaaattgataatagagtacaattattactctaattaataagcgaataaaatgtcattacagaggtagatagttcctctcaatcaaaaaagatctaagcagcggaaaataaaataaacggcgcagacgactccactccacaggcagcttgaccaaggctacacctactcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttcagaatttaataaaacagttaagtaataattaaacaatattaaaccaacactatacaacataccctgttgtataggcccaaccattctgaacaaccatcccggctgcacagttctatctccaaaccaggaatgtaccattccattccaaaccaggagctaatcaaattgttaccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacgatatctcggaaaggagttgtgacaatacccctcgcataacacaatccattgcagcgcaccttcctggatcataatcacccccttataaacaaggcatggactcccagcgacccccgtgggcttatctccgccacttctcagtctggtgccccgcaatgaaccacgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtgaatcataagttatcccaatagtgagctaatgtttctaagcagggctaagcaattatacctaatatctagttgaaccaatatataaagctcaactagtcaaattataataacccaaggtatcaaggaataaggtaaacaagaacaaaagggctataacaaacaataggttaattccacccaatgacattcgaaaataaatgcaatagttgaatagaaataatagctttaaataggatcaatatgctcaaagggttgtttgggatctgtgtgacttgccttgctggccttggaactcttcaaactcttctccggcgaaaacgaactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttaaatcggtttaatttgaattatgacgcaataatgaattatttttgaaaaggaaaaagggatttattgcgtcagcgggctagggttttggtggaccgggcgcacgggcggcggttcacgcgaacggacggccgagatcgatccaatccaaaacggacggccgagatcgaacggtccacgaccggctcacggcggacgaccccgatgacgtcagcggtgacgtcaccgacagcggcggcggctcggcggagcggacggctcgggcggcgcacgctcgccggtgaacggcggcactaggacgcaaacggagggcaccagcacgtagaggacgacgcggcgaacacaccggtgaccaaaacggcggcggacgaacaacggacgacgacggcgacgagaaggaagcggcggaaaccttcgggttgtcgacggcgacgctgctccggtgatctccggcgacggcgaaggggcgaacgaggacggcgacgcgacggcgaccacgatgacgtccttcccgagcgacggcgacgtctggaacggcggcggcgcacggctggagcggcggcgacgacggcaaagctagggcacacggcgctagagctcttccggcgacgagaggcaaaggcgaaggtggcgacgggtagaggagactccgggggtccttttaaaggggctcggaggcggcgacgaaggcccacggcgaccggcgacggcgaaggaaacctcgggcttggagagaaagaaaccgatccgaatcgaactcgattccacgagcttccaaaacgttttagccgatgattccaaaggagaaaaggtagaggagatcccggagattgtttcccctcttttgattcggccggagaaggaaagggacggccggatttggaagggaaacggcggcggcgcgaactagggttttcggcggtggcggccgaaggaggacgaagaacctgacaggtgggacccacctgtcagcgaccgacgcgcgcgcgcagctgcggactgggccggctgggccgaggagagagaaaagagattttgggccgactttcggcccaaagccaaaagaagactttttaaaactttttcaatttaaattatttcttaaatgcaattcgatttattaaaaacactttcttagctcaaataaatcctagaaaaatctaggaattatagaattaagcaaagtatttaatgaaattttatctggccccattttatattggaatttattaattaaacttagattttcttttcaagacttttaaaataaattctagaaattccatttaaacaacaatttatatattttgaattttcagggtgtgacaaacctaccccccttaaacagaatctcgtcctcgagattcggaagaactggcgaacaaaagcggatgagctgacttcaattcatcttctcgttcccaagttgattcttcttccgagtgattactccattgaactttgcaaaaacggataactcgattcctggttcttctctcatttgtttccaagatacggattggtttctccacataggtcagatcctcttggacttctatctgttcaatattagcttcttcggtaggtacccttaaacactttttcaattgcgaaacatggaacacattatggactcctgccaaagattgaggtaactccaactgataagcaacctctcctcttctactgacaatcttataaggtcccacaaaacgcggtgccaattttcctttggtgtgaaaacgatgaacccctcgaagaggcgtgacacgaagatacacatactctccttcttcaaaactcaaatctctacggcgattgtcggcataactcttatgacgagactgagccactcgcaatctttcttgaatgacctttaccttttcttctgcttcccttaggatatccgtcccgaaaacctgacgttctcccgtttgatcccacaaaagcggagtgcggcacttccgaccatacagtgcttcgtacggagccatctgaagactagcttgataactgttgttgtatgaaaattctgcataaggtagattcttatcccaacttccaccgaaatctaaagcacaagctctcaacatgtcttccaaaatctgattcaccctttcggtttgtccgtctgtctgcggatgataagcaatgctaaagttcaacttagaacccatctcttcctgaagtttcttccaaaaatttgaagtaaactgactgcctcgatcagacactattttcttagggacgccatgcaaacacacaatccttgccatatacaattctgctaagcgacttccggaataggttgtttttaccggaatgaaatgagccactttggtaagtctgtcgactattacccaaatagagtcatggcctgatgacgttctgggtaaaccagtgataaaatccataccgatttcttcccacttccattcaggaatcttcaaaggctgcaacaaaccggcaggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcgggaacacagattctctcgcccagccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctactgacaattcctaaatttaatctttcaaattccttgcataattccagtggcaactgtcgtccttccgtagcattgcaatagccttttctactaagagcgtctgctacaacattagcctttcccgggtgataatgaattcccatgtcataatccttaattaattccaaccatctccgttgtctcatattcagatccggctgagtaaagatatactttaaactcttgtgatcggtgtatacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacctggaaacccttctttggattaggcaaaatcaaaataggagctgatactaagcgacttttcaactcttgaaaactctgctcacattcttctgaccacttgtacttcacatctttctgaagcagtcgtgtcatgggcttagcaatcttggaaaaattctctataaatctccgataatatcctgcaaggcctagaaaactgcggatctctgaaactgtcttcggttgtttccaattggttacggattccacattactaggatcgacggcaactcctcctgcagagatgacgtgaccaaggaacttcacttcagacaaccaaaattcacacttgctaaacttagcatacagttgatgttctcgtagcttctccaatgcaaggcgaagatgttcttcatgctcttctttggttcgagagtagataagaatatcatcaataaagaccaccacaaacttgtctaggtattccataaacaccttattcatcaagttcatgaagaaagcaggggcattggtaagtccaaaagacataacagtacattcgaacaatccatacctagtggtaaaagctgtcttaggtatatcttcctctttgattctcaactggtgatatcctgatcgaagatctatcttggagaaaacagtggcacctttaagctgatcaaacaaatcatcaattctgggtagtggatacttattcttgatagtcacatcatttaatgcacgatagtccacacacatcctctgggtatgatctttcttttccacaaaaataaccggagctccccatggtgatgaactcggtctgatgtatcctttctgaagcaaatcgtctacttgcctcttaacttctgccaactcattggctgccattctataaggtctcttatggatcggagttgttccaggtaccaaatctattctgaactctatatcccttttaggcggcataccaggtaaatcatctgggaacacatcggaatactcccggactataggaatctcttccaaagttatctggttcagtcttgaccttaaagactcagatgacagtgcatgaacagttacaacttgaccatcattgctggtgagagttacttttctgttggcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactaagttaacagggaacgtacccaaaatcacatctggagcatcttgagcttctgcagcagcaacatgattgacacgggcctttgatgctggtgcggtagagttgctctgggcagggacaaccttcacgcgtcggggcttcggacacttgtcagcgtaatgtcctgggtctccacagttgaaacacaccacgggcttgctgccttgctccctcttgacaggttgttgctgtgctggagctgcaacaggacgtggagcttgattgcggatgttgttgccagcattgttgttgaagaactgacgctgcggacgaacaacagacgaagaacctccctgtggcatagactgggatcctaaagtaagacgcggcttctgattattcccctgttgtgccttgaagtgagcaatccggcatttcttctgttccatgcgattatacttgtcctcctgacgaatagccttatccactaacttctggaaatcagaataatctccagtcatgagtgggtaagaaagctcatcattaagtccttccaagaacttctcttgacgctcttcatcattgcgcacatcttccggagcataacgagcaagacgattgaactcgtgcagatactccgtaacagagcgagatccctgcgtaagcgacctgaactccttcttcttgagagacaccactcccgatggtatatgcgtcttccggaaagcagcggtgaactcaagccaagtgataggttcagcagtagtcctattaaggcggaaatgatcccaccattcagaggcagggccatgcaactgatgcgatgcaaatgagaccttctcctgatcagtgcactgaagcaaatccaacttcttctctatggcatgcaaccaatcaccagcttcaacaggattagtggtactagagaaaacaggcggccttacatgaagaaattctgctaacttattctgaggaggtacatggttatttccttggttctgctggttctgaagttgctgcatcatcatgttcattagctgtgtctgttgagcaagaacttgagcaagagtgggattctctccattgttattgttattggggttgttgggaccattcccgttgctgcgagtgttcaccatctggcatggacaggataagaagagaaaccgggggaaactacttaggacagagaattactttaacttttattgatcttaactgagttttattataacaaactgaagactctcacaccactaaactcaccaacttcctaacactcaaaagcaagcaaacgcatgcacttacatcccaccactgatgtaaatcacatgcaagacccacacacacaaccaaacttaaagcaagcaaactaacacaacgatctaagacaacgacttaacaagtcactctagttcttccaagcatcggaggtcgattgaaggctcattcggctcgtcttcatcatcttgggttgctacccactcaatcttggaatggttgcgctcggattcttcttcttcatcactacttatgatgatgactggaggatctgctggggcaacttctttctccaccacacgaacctttggcgccaattgatagcgagggacaaatagagctctcttccttgcggtaagacgaatcctggccttctgcggtggtgcttctccctttaatgcggctagttccttctccaaacgatccaccttgtcttctagcttgcaaatcttaccacgattccgatcttcacgatcttgagctgctaacacagtctccgcacgactttcatccatagcccacagcatctcaaccaaatgccttgtggtagcatcattctcaattccttcagtctcaagatagctgccacggtcacttccctggggttggcgaggatggtagcgatactcagtgtctgccaactgatcactgtagcgatcacggagctctcctatggcgatccttgccacctcctgacatgcatggatgtagtttcttcctccagcttcgaacatcactgagggaatatcttcactattactgttcaaggtgactttgactcggcacttctcttcatgacgatcatgacgaatctgggcataaaaaggggcagtcccaaatccaatgacaaaggacatcgtacgcaactcctggacaaaaccctcaacaccaaacagatactcaggcttgtagcgcggcatctaaagacaagtgaaaggagggagttaagacatttatccaattaatagcacaagtttttggattaatttgaataaagtttagaaaatccaagtaaaaggtaagtaaataaaataaaccaagcttgcaagatgagttgaaatagttgaaaacgaggtcacaagttttgtacttttgaataacaggtttcaaaagaaataaaatcaagttataaaatcatcatgctaaatttattatattgcagcaagactaaataaaacaatattgaaaacttttgctgataaatgagccattagtacagtaatagatgtacagtactaataacactggaataaattttgagtgagagccattaaaagggattatgaagtgcatgtgccattagtttggtttaattaaaagagaaagggaggagaacagttctacttttccaatatttttagagggcttctatgggtaaccatttggcataacctagggtcaaggggctctgataccaacttgtcacgcccggaatttctatccaaaattccaaacgcttacatgtgtgtgaaccctcgtccaggaatcagccgaggcacacaacaacaaattggtaatagagtacaattattactctaattaataagcgaataaaatgtcattacagaggtagatagttcctctcaatcaaaaaagatctaagcagcggaaaataaaataaacggcgcagacgactccactccacaggcagcttgaccaaggctacacctactcctccacaccatcagcctcattgaagaactcttcctctgatgaatgattgcaaggtgagtatatgacatactcagcaagccacgcagcaaatatgcaagt

SEQ ID NO: 73635 - DNA, 44933 bp, Oryza sativa
agagttttatctcttcaatcctcttaatccacccagccactaatactacttcctattaacaagggacatcgtaattttttttctcactacaaaagttttcgaagctttcatttattagtctagaggagtagttagggcatctcgagttgcttctatatatggaaagagaattcatgcgctattgaacttttgaattaaagagcaaacaaagaaatgcatgtattgcaggtgcactaagtacctataaatcaattaatttagaaacatgcaaaatagcatcagggactaaaggtagtactacggaaattatttttttagatgactgataaccgaaatgcagtgaaccacatgtgatttaggccctgtacagatcagtgattttcatatataggtgcctatgataaaatttgcagtgtttttatttatgtaggcgccaaaaaaatcaaaatattccacattttactatgtatctatacacggccgtgtgtctcaacttataagtcacgcaatttttcgtgtaaaatattcacgtgcggaatatataatttgaacccaagagctctcattccatgcatatgctccccttgacatcttacctgtcaaaactttcatgactataaagcatattatgaagtttttaacttgacctctataaaaactacttgtaatacatatttggtacttgaaatatcatcaaatgagaaaagtaatcaactaaaaggttctctatccaaggttgtctgaaaaagtaaccaacgaaaagtaatctcgttgagctctacaactttaagtagagcatgtctccattcgaggtgttgtgaaaaatgaaaaaatatggtttataaaaaagatccaagagcttttgatgaatatttaggcctacactaattaattaggtagtatatataggctgttttctccgttcgctaatcggtttttacaggtggcacttgaaaaacttcctctacatattaccctttttaaaaatatatcttaaaaagtatgatcgatatttggccccaaaacgatctgaaatgaaaaagaaaatttaactaaaatgttgtatatctcaggagctccagttttcatgtggaagttgtcatcaatatcgtgaatttcttcaataaaaaaagtgacttcacaaacaatttcataggaaaaccatttgtggaaatagacctatttcataagcacattatctctttgaatttgtatttcgcaggcagcctcagccatcttcataaaagcgtctagaaatttaatcgtatgctcccataaaaaaatcattttcaaggatgaacttggacaagcatatgttcaaaagtttatccctagaagcatatataaaaactatatattttgtatgtataaatggtgtctatatctatatttatatatacactaaaataaaaaacgggaggttcactttttattagagtaaattgcataggcgctaaatttgtacacctatgttgtctacataccaaaactctcgaaatgcatatttatattcagaaatttatcccggacgtcatcatagatctcctctgaacttatcccagacttgtatgtcccaatgagggtcgggcccatatgtcagctgtggagattatggataccccatatctatatgacagttataatttagtcggatatacggtaccaaatatagatagaatatctttacgaggactcgggttagtttctaacttgtatgtcaaagaaatacccgagatcttagtcggttacgattgtattttacctgtaatcgcatattccgttagggatatggactgtattttgtaatatggatcccttcccctatataaggaggggtccgggttcctctcgggacgatttttttccctagatcatacaatcaataatctactcggcggaatcatccccggacaggagtagggtattacttcttgaataagaaggcctgaacctgtataaaattccttgtctccaaacctatccacttttctagcttgatagctaccccttttagtattgccgaaatcttgtttcgacagttggcgcaccaggtgtcacgcccggaatttctatccaaaattccaaacgcttacatgtgtgtgaaccctcgtccaggaatcagccgaggcacacaataacaaattgataatagagtacaattattactcaaactattaagcatataaaatatcattacagaggtagatagttcctctcaatcaataaagatctaagcagcggaaaaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaggataacaaaggatggcatagtggggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattatagcatcatttaccatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggctggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaaaagtgagctaatgtttctaagcagggctaagcaattatatctaatatctagttgaaccaatatataaagctcaactagtcaagttataattacccaaggtatcaagaaataaagtaaacaagaacaaaaggggctataacaaagaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttatatcgatttaaattgaattatgacgcaataatgaattatttttgaaaaggaaaagaaggtttattgcgtcagcgggctagggtttcggtggaccgggcgcacgggcggcggttcacgcgaacggacggccgagatcgaaccaatccaagatggacggccgagatcgatcgggtccacggcggctcacggcggacgaccccgatgacgtcagcggtgacgtcaccgacagccgcggcggctcggcggagcggacggctcgggcggcgcacgctcgccggcgaacggcggcactccggcacaaacggaggacaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgcgacggcgaacacgacggcggccttcccgagcgacggcgacggctgaagcgacggcggcgcacggctggagcgacggcgacgacggcggcgctagggcacacggtgctagagcttttccggcgacgagaggcgaaggcgaaggtggcggcgggtagaggagaccacggggagccttttaaagggactcggaggtggcggcgaaggcccacggcgacggcaacggcgaaggaaagctcggcttggagagagagagagcccgatctgattcgaactcgaatcccttgatttccaaaccgatttagccgatgattccaaaggagaaaaggtagaggagatcccgaggatcatttcccctctattgattcggccggagaaggaaagggacggccgaatttggaaaggaacggcggcggcggctcggcggcggcgcgctagggtttcggcccgaggaagacgacgggcctgacaggtgggacccacctgtcagcgaccgaacgcacgcgcgcggcgcgggcggctgcggactaggccggactgggccgaggagagagagaaggcggattttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattattttctagaaattccatttaaacaacaatttatataatttgaatttttagggtgtgacaccaggtaggggcagcgtcaagtttttgccgacaaagtgcgatgggttccgtctccggcgtcgacgacctcgccttccctcctgggcaggcgttccggttcagcagcctcaacttcatcacgaacgaattcggcaagatctctctccttgactcggattcgaaccagtcggggagagatcaagtccccacgccgttcggtattctgaactcggccgagaactacttcaagatcatctctcccaagtcggctttaaaccactcggacgagatccaatctactcctcagcgaccagatcaagatgacgggtcctatccctcaatcctgatgagacttcctaatgatttggccgctgtcttcacagccaagacatctcccactcaaagatctaggcgagctccggcttcggccccgatccaatctagatccagagaggttggcgttatactccaacctcttgggacagtcttgacggaagagttggacggctaccttagctcccctggcgtaagttctcgaccaaccgaaatcctcgactacgacgacttcggctaccaccacgaccacgacgacttcgacgatagctataaggatagctacacgcctctctttttcggcgtattcatggctgacaacgaaacggaggaacagcaccgagctcgagaagtggaggaagagcgcgcacgacaagaaactgaacgtcgccgacaggaggaagaacgacaacgacaagagcgagaacgactacagcgtgagcaacaagatcgcgagcgagttgcaaaggaggctgaagatcgacggtagcgcgccttggaatccgggcgacgagcgagagagctcatcgggcaacaagacgtcgatggaacaacggtttttcgcaccccccagcagaacgcggttgcagcaatcactctcctcgacaccctccccaaggaagacgcactcaatcaagttgatcatgttgtcaacatcttgaaccagacgaagaccatgatcgctgcttcggttctagccaactccgcaagcactcgcacgccgactggtagccgggttccccatctccgatctcatgattatcatcagccaagcctcagcatcatcggtacaggatccgtcgcaggagcagggaccacgacgaatgatattttcactcgcctcccgaacgtcacggggaacgccgagtcgaacggcttcgctctccacctcgccaacgccccgtcgatctttgcgacacgatcaactagcgccatgcagcacgaggtcaccgtcattcaccagatcgctacgacgacgacgtggatggagtagctgccttcactaatgacctgcgtcgagtggattggccagccggcttcaagccgactggaatcgagaagtatgacggcaccactaatccggagtcttggctcactgtctacggactcacaatccgcgcagcaggaggagacagcaaggccatggcaaactatctacctgtggccctagcggattccgcccgatcctggctccatggactaccccgtggcacgatcggatcatgggcggaacttcgtgatcacttcatcgccaacttccaaggcacctttgaacgccccggcacacagtttgatctctacaacgtcattcagaagtctggagaatcccttcgagattacatccgacgcttctccgagcaacgcaacaagatctccgacatcaccgacgacgtcatcatcgccgcctttactaaaagcattcgccacgaggacctagtcggcaagttcggacgcaaacctcccaagacggttaagcagatgtttgaaaaagccaacgagtatgccaaagccgaagatgctattaccgcgtccaaacagtcgggcaccacttggaaaccgaagaaagacacgccggctgcaggagggagtggaagtaacaaccacaaggatcgcaagcgtaagcccggagaacttgtggcaacagcctctccatcttcccgacaacgttcccgcgtcaacaccttcgacaagataataaactcccaatgtccgcatcatcccaactccaaccatgcggccaaagattgcttcgtctacaagcaatttgcggaacaatatgccaagaacgcgcgtaagccttcagacagagatcaaggcacatcaaagaagaaagatgacgaagacgatgccccgactggttttcaggactctcgcaaagaactcaatcacatcttcggcggacccctggcttatgaatctaagagaaagcagaagctaacagaacgggagatcaatgcggtttagcctaacacaccccaataccttcggtggtcagagatagcaatcaagttcgactgctcggatcatcccgaccgagtggtccacccggggcggtaccccctggtactagacccagtggttcgcaatgtcaagctccgaagaactctcatcgatggtggtagcgcactcaacatccttttcgctaagaccctggacgatatgcagattcctcacatggaattaaagccgagtaatgcacccttccacggtgttatcccaggattgtcagctacaccactcggccagatcactcttccggttacctttggcacttgggagaattttcgcaccgaaaatgtttgtttcgaagtcgcttatttcgagacagcgtaccatgctatactcggatgaccggctctagccaaattcatggccgtcccacactacacctacatgatgattgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaatagcggaagactagggcgacgaccacaggcgcttgacgacaggcacgagctagacaccaaagccttcatcttccaggggctcctcttctgggtttgggcaaaattgagcaagactgagtacaaccaccgtactcaacaagacacacccacaagtgcagaataaatgcaagggagtacaagggggttaaaatataaagggttagggtttgcagtaaacagcattaaaagacagttagttgctcaaagctattttgtaaacacgatcctagagctatacaatattattaatcaaggccgtgaacccacacgaacctgccttaacccaaggcctacgatgattcagaccgaactggcaacccgaccctaggtcccagctcgtcccaagccaacccaggccaaccattctacattttggttgttaagcaggttttaagaattaaaaatactaacttgggtacattgctcggcttgcccataaccgagggcgcggctattcgaatagattatactctgatcagaggtgtacatctttacccacaagacacatcttcctcatatgtaaccacatgccacataccaccacggtatacggacggaagacgtgacatagtttccaacccatcctagccatagataagagtaccgacccaaccccacctacggccggaacctccgggacaggtaggcaggactgagcccctagcagcaggacaccggccctgtgccatgacatctcgactactgagccgcagctcgtgtagccttcatttgttctagagatgtccatcgacccccgacttcgtccatctccatccgtgtacttttgtttataaccagactgagccacaaactaagccttacccactagacatgtggaagtacggtagtgctttgcaacagaggcctgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaactagcgaagcatctacctaaaatcatactagtggtaccatgagtagataacaataataatatcaataacaataataataaggtcataacaaaggtaaataggtatggctaaataaaacagtgataacgcgggaatttaagtaaagcgataatgcaatattttaaatcaaaataattttataaactgggattcaatatgctcaaggatgatgtgacttgccttgctcgctttcccaaacgtcggcttcaacctccacgaagagcggatcttccgaagctgcagcgtctacacgaccaacggaaaagaaatggcttttactctaataaactccatataaccagcaggaacaaagcacaaaaatgggttattgacttcataaggaaaaattagagacttgaacggtccaattccgagttcaaatggccaagttatggccatttgaagtttatatgctctttaaatgaatatttgcaaatttcttcatttaaattttaattaaaaaaaggtttattgcgtcagccgaggggaggggcgcgcggaccgggtccacgggagtggggcccacgcagcagccgcacccgagggcatgggcggctgacggccgggccccacgcggcagccgctcggtgcgcccggaggcggccacgccggcgcagcggcgtgaggctgcgcgcccgcgcccctatggtcgccggcggcggccataggcacggcggagcggcggccgagagaggggagggaaagggggaaacgaagcgacggtccacggctcaccccgggtcgacggcggcgacggaaacggcagtcggagtggaggaaggcggcggcgcggctcgggtggacagggtcgacggtgctccggcggtcggcgaccgaaacggagagctggacgaggtcggcgaggatgcggcgaaggcgaaggaggcggcgccgaggtgggaggtggtccggggcgacgacggcggcggaccggagctcggcggtgacggcggagagagagagcgatgtcgcgagctcgattccggcggggagagagggcggtgagtggcggaaacggtggtaggaagctcggggagggtttaaattgggttggaagggggagagagcgcccggaggggaaggaacccggtgcgggaggtccggccgccatcaatggcgctggcgagatttgaacgcgagagagagagggaaaaatatggggaaagggagaggggatcacggggagtaattccccccactttattgcacgtggggacggcgggaggcggcgggattcgcggctgcggcggcactagggcgcgggggaggcggcgggagcggcgggaggaaggggatgacgggtgggccccacccgtcagcgagggtggcgggcgggcccgcccgtcagcggcgcgctcgcggggagagggcggatgggccgcggggagaggagagagagagagagagcgggggggagagatgggccgggccggcccaagggagggaagggggactttttagggtttttctttttataaaacctttttaactttgtttatttcttaacaattattatttgtgctctgaaaattccactaaaatttagttacgtattttaggcttctaggaaatatacaaaaatcctctaagcattatttgacttttaactttgcacattttatttgttggagactttcacatggattttaattattctaggcataatttagaggatatattttagggtcgttttaggacgtgacaatgatgaagatgcctgctcctcgaggagtcatatcactatggagcgacatcaagcaagccgtcacatgtgacaaagaaagttgcgagatggcccaaacccgcgagatcacccttgctcgtgaagagatccgactgactacgactatggcaagtgaaggagaagtgcctgcgaccaagctgtcaaagaccaaagaaggcaacgacaaaactaagaagattccactagatccctccgatcctaccaaaactgttgtaataggagctgagttagattgtaaataggaaagcgcgctcattacctttcttcagaataataaagatatttttgcgtggaaatcatccgatatgcctggtattcctagagaggtgattgagcactccttatatgtcaaggaagatgccaaacctatcaaacaacgactccgccattttgcacaagataggaaagatgcgatcaaagaggaattaaccaagctgttagcagcaggcttcatcaaagaggtcctccatcccgactggctggctaatccagtcctagttcggaagaagatcgggcagtggcgcatgtgtgtcgattacaccaacctcaacaagtcttgccctaaagatcctttcgggttacctcgcattgaccaggtggttgactcaacggccggctgtgagttactcagtttcttggactgctactcggggtatcatcagatctgactgaaagaatccgactgcttgaaaacctcgtttattacgccctttggggcctactgctacatcaccatgccctttggattgaagaacgcaggagcaacctatcaacgcatgattcaaatatatttttcaactcagatcggccgcaatgttgaagcttacgttgatgatgtagttgtcaagaccaagcagaaggatgacttgattgcagatttagaagaaacttttgcaagcatccatgttttcaggatgaaactaaaccctgaaaagtgcatcttcggagtaacgtcagggaagttgctcggatttatggtatctcaaagaggcatacaggccaacccggagaaaatcaacgccatcctcaacatgaaaccgccgagctcccagaaagatgtccaaaatctgactggttgcatggcggcgctcagccggttcgtctcacgactcggcgagcgggggatgccctttttcaagctgctgaagaaaaccgacaatttctagtggggacccgaagcacaaaaagccttagaagacttcaagaaacttctcactactccacaagttttggcctcgccacatccacaagagccgctactgttatatgtgtcggcgacctcccaggttgtgagcacggtcctagttgtcgagcgtgaagaggaaggccatattcaacaagttcaacgaccaatttatttcgttagcgaggttttggcctactccaagacaagatatcctcaggttcaaaagttattgtatggtgtcttaattaccgtcaggaaattatctcactactttcaaagtcactcggtcatggtggtcacatcgtttccactcggggatatacttcataaccacgaagcaaacggacggattgcgaagtgggccttagaattgatgtctttggacatatctttcaagccacgaacttcgatcaagtcacaagctttagctgattttctcgccgagtggaccgagtgccaagaagacatgccagaggaaaagatggaatattggactatgcattttgatgggtcgaagaggcttacaggcactggagctggggttgttctaatttccccgaccggagaaagattgagctacgtattgtggatacatttttctgcgtcccataacatggcggaatatgaggcgctgctccatcgattaaggattgcaatctctctaggcattcgccgactaatcatccgtggagattctcagttggttattaatcaagtcatgaaagagtggtcttgtctaaatgataatatgaccgcttatcgacaagaggtacgtaagttggaagataaattcgatggacttgagctcacccatgtcctcggacataataatgaagcagcaaacagactgtccaattttggttcaaaacgggaagcagccccttcagatgtgttcgtcgaacatctttacgaaccgaccgtgcccagaaaagaaacaattgaagccatggatactcaaggcgtaagcatgattgaagccgactggagagaacctctcataagatttttgactaaacaagaactccctcaagacaaaaatgaagccgagcagatttccaggcgcagcagactctacgtcatgcacgagaccgagttgtacaagaaatgtccttcaggaattttgcagcgctgtgtatctttggaagagggaagacaattgctgaaagatattcattcaggcatctgtggtaatcatgctgctgcatgaaccattgttggcaaagcctatcggcagggtttcttctggcccacagctgtttccgacgccgacaaaattgtgcgaacatgtgagggttgtcaattctttgcccgacaagctcatttaccagctcaggagttgcaaaccatcctgctgtcttagctgttcgcagtttgggggcttgatatggtcggtccatttaaaaagcagtcggtggttacactcatctctttgaaatattgaacaccttcgtcaattttgtgcttaggcatttcgtttgtatctttcctctttgactgctaacttcaagtttttccttgaagttttcagtcggggggctactataataataatggaacatgatttttatcaattcaatttgcttacttgatttatcattgccatgcttgattttttggcttacacaatgaggactgaaagttttttaagaacttttgcgagttttagactcaataaggtttgacaaaagcttttaagaaatcagaggctaagtttgaaatatctagcacagcataaattcatcagtattgtacaaattgatcttccatcatcatcagaatcactactactaatcagtgtcagtcttttcatcgtcagaattatcagacccagtcggccgaaggtcgacatcttggaatctctcaactacgtcagcagcaatcgtgtcagcggctttttgtgcatcattgatgaggttgagggctgtttcttcgcttgtcccgtctgcaaacccgtcaacggcgtcaatatcgattttggggtataaagatttggtcatagctaatgccatgcttgctcccatacttccagcctccctgatattcttgaagtaagtatccggagcgactctcagcttgtcgaagatctcggaagcatcaagtgtactcggaccggcgttattgaagaacatggcttggatgagtggggtagcggcattagcgactttatccctagccccttcaagcctattgatcttgttgactaagacatcaaactgcgcctgggacttgatcttgcggtctgcatcaacagattcacattaatgagtcagcatatagaagataatggcttttgaggtattgattattggtaccttcaacctcctttaatgccgagtccctctgtcttgccagttctgccttgtcattttccagagtttgaatctgcttctccagttgagatatcttggcagcttgcactacattgactctggttaatcaagattacaaagataacagcacaagttagttgggcagagtttgtgcgtatcttttgatgagccactcagttcaaaattggattccttgagctcagcaatccgatccctcagatcatgttcattcttcctggcaagttcttttgtctcgtgcagttgattcccggtggcttcgagggttccgagatggggggctaacctctctaaggttgccgttttagctttgttcctaagatgaatcctctgcaagacagtttaattagcgcttgaactaaatggcaaacgagatggttgagatcaggcgccaaagagcttacatttacaatgcgggtggcctggctgagtgccttcttcagcaagcatacttcttcatcttctttttgtttgtttattacgattccttgaggttgcctatcatcgtcccaccacttgactaggatgggagggcgcgagtcttcagctacttgtatacggggaatttcttcttcgtcaccaatcattggtcctaatgaatccactgacaaaggttagacaattgattagaatcatttggataaacacggttccaggcaaggtgtttacctgtaatgatttccggacggggacgagtcgactcttgcgtcttaacgggagatcctggtgtcgggtcactgctggtgtcttgtttacgagggttgtctgcctgagctccaacttctggaatttcttggcttgacccagtgcccgactggttttcagtcgagggctcctgattaactccggctccagcttcggccgactcgtttctggttgagggttaatcaccagatcctacattatcggttgttggctggttatcactcggatgatcctcagcagttggctcggtttcttttaagttcgttcccgtgctggtcggatcagagtcctttccagaaggatctatgttagatggtttcctacaagttttgccatcagtgttattttcacgatgggagaatattaatacaaggaagattgttatatgatttatacctggaagactttctgatttttggttcaggacgactggaggttttcttcttcaaattagttggcttcggaggtcttccagttgctcctttatctctgagctttccggtatcatcgccttcgtcgtcacttggaactagcttcctcttgcgagaatctgactggccgactggatcagaagcatttggttgggtttcagaccgaattcttggtcctccacttccctgaccagtttggcggcgaggtgattggtgctgggcgattggaggatctgacttcaacaaagcaaattcctgggcgtaatatccttcattgttaatggattcaacaaaaagacaagaccatattttgtgaaaggttgaagtgtttgattacataccggtggaggaggattgaaggcattgaatggcacgactggcagcaagtgcgaatagctgacgacgatagcatttgagaagatcttgtacatcctttccttcatgaccttaaagtcaagagagtctgaatcttaacgatttggatcatgtttgccgtcaaactcaaaagctgtgcgggatctttctttgattggagctaaccggctttttatgaagtgccgagtgatttgttctccctgcaaaccctgctcctttagctttatcatgcgctccatcagttccactgcttgcgcagcttcatctcccattggcagtgagttccaagtatcccgataaactgaaggaagacaggagtactcggggagagcaggctcagggttttgaacataaaaccattgcgtgccagcctttatttgaggtcttgaagggcatgaagaagtatttttggcttagtgttcccctgagttggaaaccagcgcccccaacaacacatggtttgcccttgtttggctgaggcttaaggaaaaagatacggcggaacaaggcgaaatgtggcctaatacctaaaaaggcttcgcaggcatgaataaaattggcgatgtgaactatggagttcgggttcagatgatgcaggctgattccatagaaattcagaattccccgaaaaaatcttgaggttggaagggagaaaccgccatagaagaaatgagcaaataccacgatttcatgcgtatcaggggtcgggaatgcttcgccgaatgctggtcgccatccgatgatctcctttgccggaagaacgccgtgcgccaccatctccttcagattatcttccgtcacatcggagggcgcccactgactctcgaagctttctctttcttccgccatgaatgtgaactggatggtttaatttggtccgagatatggctggaaggggatggggaatcggagcggtggatgcggggagaaatttcgtgaagtttttgaggatggattggagcggattgatgaaccctagttttgctggcgcagctttgtactgtagcaggaaatggggaaaatggcgagagtctcggcggggaagacgaagagacgttttatttcacttcggcgttattagggtatcgggagtgctaacaggcctgggcctgtacagtgcttcagcccaatattattaccagcgtggcccattgtgatctttagggacttaggcgctttttgctttgccaatttgtgctcacaatgatgtgacccgatgctgctaaaatcctttttaatgcgattagataattctttggaattactacgatgcaaataaaaggtacccaacagaaaagtgttatattatttttgtaagcttttttaggctacaaaagctgtttgggttaatttgagatgactggtttattagtagtcattctcttagcatgttatatgcttattttgattatggtaaggattatagcctaggctattaaacttcttaattaccatgatctttatcatgtttggtggatcattttaagagtttcttgctcggattcctatcaaatatgtctatttttggaccttttgagtgtttatcactcgacccttttcgtattttttatccttgatatgttcaagatgagaagcagtcggctgggtattttactgagtaccatgcatgcttcgctataaaaccactcggctcttaactacatgtttagttcttcaactaatcacatagtcgggggctatatctaattaggtgcatctactcgatgcaccatgttttatttttgcccttcacagtctttgattttagcactcggcaagctggagcaggttgaattgaagtgctcggattactgttttttgtttcgagaaggctattatgtcaactgcgaaggtctcgggggctactgtggagattatggataccccatatctacatgacagttataatttagtcggatatacggtaccaaatatagatagaatatctttatgaggactcgagttagtttctaacttgtatgtcaaggaaatacccgagatcttagtcggttacgattgtattttacctgtaatcgcatattccgttagggatatggactgtattttgtaatacggatctcttcccctatataaggaggggtccgggttcctctcgggacgattttttttccctagatcatacaatcaataatctactcggcggaatcatccctggacaggagtagggtattacttcttgaataagaagccctgaacctgtataaaatttcttgtctctaaacccatctacttttctagcttgatagctaccccttttagtattgccgaaatcttatttcgacatcaaccctctagtttaaccctaagtccacctaagtccacctggtcagcagacatgtgtcaacaccggccagcacagacacaaaggtggaggtgcatggaagagctcatggaccaaacccgaggactcagtggtggcactgctactggagctgtgtctacaggacgggctgctcttcccgctgctcgaatcgtcaccgccgacatcatgtgtaaggccatagcgccatcgtcgccgcagatgtcggcatgtccgctgtcctctcgcttccctcctactttgggcgatgccaggaatgtgttcctcgacagcaaggaaagtattttgactcgttaaccatactgtattcaccaccagatctctttggccatccttctctctccgatgggctaagatcttgtcacccgtgtcctgtttgtccacatcatattctgcaatgccagtgacctccctggtgtgtgccaccctgttggacgcatcacgccaccggatcaccggcgctcgacctcttgaatgcgcgggtatatgtcgtatgcttagtttgagatatttataagagcaaaatattaaccggagaacatctgccatgatttcggcattaattacttttataatttttttaacctgttagttatatattctatcatatttaagtaatatctataaataattatttataatcttcttcatcatttgaaaagaaggtagagttattttatttagaaaacatgtcaacgaaagtaaaaaataagtgtaaaataaaagtaagattttttttctttttaattgcataatattatcatggtttattagaagatgatttgggacatcaagctccactaaattttatatagcctaatatgattgacatatacttgtgatataatacttattttcacttttttataatattgtgttctttttgctatttggttaccacgcacaggataggtgtctatgttcaaatggctcttttttaacttaaaatttataattgtggagattatggatatcccatatctacacggcgatgatatttggactgaatataggataccgaatatagatagaatatcttatgtgtatcctgggtttgtttcctaacttgtatatcaaggaaacaccttgaaacttagtcggtcacgactgtatttaatctgtatctgtgtattccgttagggatataggttatcttttgtaacccggactccttcccatatataaggggggtctgggcgcctctaggggcagaggttgatcttctccaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggttgcgtcaagcttttctccgatcagtgcaatgggttccgtctccggcatcgacgacctcgtcttccctcccgggcagacgtttcggttcggcagcctcgacttcatcaccaacaacttcggcaagatttctctcctcgactcggaatcagaccagtcgggagagaaccggatttcggtcctgtttggattcccgaacgcggctgaaagctacctcaagaccatcttaaccgagtcggcttcaaaccactcggccgagatcgcatcttcttcaacgacaccagatcaagatgatggggcttacccaccagtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcctaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggatcgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgattgcggcttcggtcccagttaactccgaaagcgtccacacgccgactggcagccgagtcccccacttccgatctcatgactactgtcatccaagcctcagcatcaccggcgccggatccaaccgcaggagcaggggacacgacgagcggtctgttcactcacctcccgaccttcatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcatcgacgatctgcgtcgagtggattggccagccggcttcaagccgactggaatagagaagtacgacggtaccactaatccagaatcgtggcttaccgtctacggtctcgcaatccgcgcagcaggaggagacaacaaagccatggcgaattatttaccagtggctttagcagattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaatgcaacaagatctccgacatcaccgacgacgttatcatcgccgcattcaccaaagggattcgccacgaagaattggtcggcaagttcgggcgtaagccccccaggacagtcaagcttatgtttgaaaaagccaacgagtacgccaaagctgaagacgccgtcaccgcatcaaagcagtcgggtcccagttggaagcaaaacaagggtacgccggctacgggaggcggtggaagtaacaatcataaggaccgcaagcgtaagcctgcggaacttgttgcagccgccagtcactcttctcgacagcgttcgcgcgtcaacacgttcgacaagatcatgaactcccaatgcccgcatcatcctaactccaaccacgtggccaaagattgtttcgtctacaagcaattcgcggatcaatacaccaagactgcacggaagaactctgacgaagaacaaagcacgtcaaggaagaaagacgacggcgacaccccggcaggctttcaagatcaccgcaaggagctcaaccatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcgctccgagttaaaaccaagcaatgcgccttttcacggagtgattccaggattatccgcatctccactcggccagatcaccctcccggtcacttttggcacgcgggaaaactttcgcacagagaatatcagctttgaagtcgccgatttcgagacagcataccatgccatactcggacgcccggcgctagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgatttgcacaagacaggaaagatgcgatcaaggaggaattaaccaagctgttagcagcaggcttcatcaaagaagtccttcatcccgactggctggcaaacccggttctagttcggaagaaaacagggcaatggcgcatgtgtgtcgactatactgacctcaacaaatcttgccctaaagatccttttgggttgcctcgcattgaccaggtagtcgactcgaccgccggctgtgagcttctcagttttttggattgttactcggggtatcatcagatccgactgaaagaatccgactgcttgaagacttcattcatcacgccctttggggcatactgctatatcaccatgccgttcgggctaaaaaacgcaggagcaacctatcaacgcatgatccagagatgcttctcaacgcagatcggccgcaacgttgaagcctatgtggatgatgtagtcgtcaagaccaagcaaaaggatgatttgatctcggatctggaagaaaccttcgcgagcatccgtgctttcaggatgaaattaaaccctgaaaaatacatcttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatgcccttctttaagctgctgaagaaaacagatgatttccagtggggacccgaagcacagaaggccttcgaagatttcaagaaactcctcaccgagccaccagtcttagcctcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgccaagtgggctttggagttgatgtctttggacatatcattcaagccccgaatttcaatcaagtcccaagcgttagctgattttgtcgccgaatggaccgagtgccaggaggatacccccgcggaaaacatggagcactggaccatgcattttgacggatccaaacgactttcgggcattggagcaggagtggttttgatttccccaactggagaaagattgagctatgtgctttggatacatttttcggcgtcccacaacgtcgccgagtatgaggcccttcttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttctttgacacaacaatgaagccgccgacagacttgccaattttggatccaagcgcgagacggcgccctcagatgttttcgtcgaacacctttatacaccgaccgtacctcatagagatactactcaaaatgcggacactcataacgtagctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaatcctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaagattgtacgcacgtgcgaaggttgccagtttttcgccagacaaattcatctaccagctcaagagttgcagactatcccgctgtcttggccgtttgcggtttgggggctcgacatggttggcccatttaaaaaggcagtcggcggttacacgcatctctttgtggccattgacaaattctccaagtggattgaagctaaaccggttgtcacaatcacagccgataacgctcgagacttcttcatcaacattgtgcatagatttggagtgcccaatcggatcattactgataatggcacacaattcaccggtggagtttttaaagacttttgtgaagactttggaattaagatttgctatgcctcagtggcgcatcctatgagcaatggacaggtggagcgagccaatggtatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagatcgctacgacgaggaccgagtggatgacttgaaccgattggaagaagttcgtgaagcagctttgattcggtcggctcgatacttacaagggttgcggcgttatcataatcgcaatgttcgatcccgtgcctttttagtcggcgacctggttttgaggaaaattcaaaccacacgagatcggcataagttatctcctttatgggaggggccatttatcatctctgaagtcacccggccaggttcctatcgactcaagcgcgaagacggtactctcgtcgacaactcttggaacattgaacatcttcgtcgttctatgcttaagctttatcattgtatttccctatcttgactgtcaacatcaagttttcttcttgccgtgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttactcagtcagaatcagtcctttcatcatcagagttattattgctcggctgaaggtcgttgttgcggaattgctctacaacatcacttgcaatcttgtcagccgcactttgagcattgctgataagatcaagagcagcttcttcacttgtcccgtctgcaaagccatcaatggtatcaatttcaatcctcgggtacaaggatttggtcatcgccaatgccatactagctcccatacttccagctttcttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgagatttgattttacggtctgcaaaacacatttataataagaatctgctgcattaaagagaggacagttcaaattgtcagctggcaataccttcaacctccttcaaggctgagtccctttccgcagccagttctaccttgtctcttttcaaggcttcaatttgtttctccatctgagccatcctggtggcttgcgctgtttgaaatccaaatgtttgaggatacagttatgacagcataaatccatggagcagatctggaagattaccttttgatgaaccactcagctcgaagtttgaatcctggagctgagcaattcgctcccttaattccttctccgttttcttggcatgctccttggcctcgtgtagctgttccctaacggcttcaagagttcccaaatgtggaaccagcttttctaaggttgcagtcttggcttcattacgaagatggattctctgcacggtggttcatggattagtcttgctaacgagaaaacaaagtcatcaaaggcagtcacctagaagacttacattcacaatgcgagtggcttctccaagtactttcttcagctggcacacttcctcatcttctttttggcgatttataacaatgccggaaacttgagagttctcgtcccaccatttgagtaagataggaggacgagagtcattagctgcctttatgcggagaatttcttcttcgtcgccgcttagtggacctgatgtattcccaagatattagacgaacaagctggagttattcagaacggcatcacttgagaagatgagattacctgaggatgtgcctggcggaacgcgaggtgatccttgctctttatctggagacccaatcactgagtcattaccaacttctggtccttgagaagttgtctgcgcttcagcttcaggaatctcttgatttagatctacatccgactggtttccagtcgggggctctctggttgttgcagtttcagttgttgccgactggtttccagtcggcggctggtcactcggattggccttgtcatccgaagcatgggcgccagtcggctgactttcggcagtcggctggctttcagcagtcggctcagcatccttggatatatttggttctgtcacagccggatcaggatcttttccggttggatctatatcggacggtttcctgcaaagtgccctttcgatatttagcataattcctatgagagaagcatgccgaaataaaatggtaccgagaggtttatacctggaagatgttctaatctttggcatttgacggccagccagttttttcctgggcatggtatgctttgggagtttgttgggcgtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctggcgaggagatcggcgctgagcaattgggggatcagatttcatcaatacgtattcctgaacgagatgcttccacagttagctaactcaacatgaagatgaaattatgttttgaccttgggttgaagatttcagatacatacctgcggaggcggattgaatgcgttgtatggtacaactggcagttgatgtgaatagctgacgacaatagcgttcgagaatatcctgtacatcctctccttcaggatcttaaaatccagagaatctgggtcttcacagtttggatcatgcttgccgtcaaactcaaatgctgtgcgagatctttctttgattggagctaatcggcacttaatgaaatgccgagtgatttgctctccttgcaagccttgttctttgagttttaacatgcgttccatcaactccaaggcttggactgcttcatctccgattggaagagagttccaggtatcttggtacaccggaggaagacaagagtacccgggaagagcaggttcaggattctgaacatagaaccagtttgcatgccaccctttgtttgaagtcttgaagggcatagagaaatacttttggctcagagttcccctcagctggaatcctgcccccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccgtagaagaaatgcgagaagaccacaatctcgtgtgtatcgggggtcggaaaaatctcaccgcacgctggccgccacccgatgatctccttagcagggagaacgccgtgcgccaccatctccttcaggttctcttccgttacgtcggacggcgcccattggccttcaaagctttctttctcctccgtcatcgattttacccgaatgcgctgatttgattcgagggatggccggggagaagtgagggattgaggcggtggatcacgggaaggattttgatgcacttttcgaaggtggatttgagtggagtagtgaaccctagttcgccggcgcagttctgcactgtagcaaggagtggggaaaatggcgagagttccggcggggaagacgaagcgtcgcttggatctcgggatttcttgttaagggtatcggaggtgcgaatgggcctaggcctgaacagtacttcagcccaatacttttaacagcgtggcccattgtattccttagggacttaggcatattttgctttggcaatattatgcgcacaatagtgttgcccaatgctgataaaatcctttttatgcggtcatataattctttggaattattgcaatgcaaattaaaaggtgcccgacagaaaggcgttatgctgtttttgtaagcttttttaggctacaaaagctgtctgtgttaacttggagtggcttgtttttaccatagtcatttccctggtatgttatatgcctgttttcattatggtaaatagtcatagcctaggctattagacttatttattgccataatttttataatacttggtgggtaatctttagagtttttattcggatgcctgtcaagtgggttcattcgtgaaccttttagagtgttaaccactcggatttcttttgttatggctaaaaagcagtcggctagaatgcctctttaggcgccgcatatgcttttgtcatatgatgcatgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctacgatggttgactgcaaaggtctcgggggctactgtggagattatggatatcccatatctacacggcgatgatatttggactgaatataggataccgaatatagatagaatatcttatgtgtatcctgggtttgtttcctaacttgtatatcaaggaaacaccttgaaacttagtcggtcacgactgtatttaatctgtatctgtgtattccgttagggatataggttatcttttgtaacccggactccttcccatatataaggggggtctgggcgcctctaggggcagaggttgatcttctccaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacaataatcattttgctttctacttattgatcatttttagtaattagttaaaaaaataagacatcaaaggaattaaattagacatgagaggaggagagagtagaaggggagagtgtagcgtgcttataattatcattttttagggttgtagtgttttagttgctattactttatcaaataaaaaagaataaaatatttattgattgattaaaatctatcttttttttactaaaactatgaacgctaccaatctaataatgttaaaattgggggaataattttgtagaatattgcttagagttaggttcattttacttttatcactatagatctagtttaattattgtgaagttgtataggatgataaaatatatatcattattttttaataattttattagttatttgaatagcatgaaaaagttggaaaaatataccccgaaagtgatatatttctttttaaatttgaattagagtggatatgagtctttatatataaaataatctaaagatataagtggatcaaatattagttattatagtatgatttagatattatatttgcttattttttagcataacttttactttatgaataatatatttggggaacattactcatagttttcattttacttttatggttttagatctaatttgcttgaatggcacgcaaaaatcagaaactataacccataatgatatttcttttcaaagttaaattatagtaaaatttggtcttcaactctaaatttagtcatatataatttaaagatataaccggataaaaattagttgatttggttgttatagttgcttaattatttaagagatttttttttgctcttttatatttaagtaataaagcacaaaaatataaaaaagaataggtggaaaagaactgatcaatgaattgaggaggggagaggggcgcacggacatgagtacgtacgcacgttctctaataaattaacgtgtacaggcccaggtgggtccggtttgggagatgaattttttttattgaagataaatctaatgattgtaaataatgggtccaccaaatttaatgaaaatcaacggctagattttttttccttttttctcatatttttttaggaatttatctaatttgttagagtgccacatggcggtttatgagcgttttcaggatgccacatggcggtttaggagcgtttataggaagtttaatggtgggcatgtattgtacacaatgttaaactttttggttcagccaatttgatcgggcatcaccgaaatttttgtgtgaaattttgaacaaatattaccaaaattcatgaaaaataaaaaaatttggccggaataatattgtatcgaaagggtctgaaatgaccgaaatttctaaccctgattgtacattgcgtttgaaatatatatataaacagaatatcaatcggctggcacctcccatgtttaaaagtacttttttttatttgaataagacacatcaggggtattttgctttgataattttttcaaagatatttattaggtttaaaaatatatcatatttaatacatctgtataaataattatctatgatctctttattatatagaaggaagttcgatttagtttgtttggaaaacatgtctaacaaatcaagtgtaaattagaagtaaggtgtttggcctttttttaatagaatgtttacttgctttttttacaaattctaaagaactatattgttaataaatatattttatttgtaccatcaagtagtttttcttctagtaggtttaagttgatgcaagttgttacatacttacatataaattaataaagacatgtcatatacctcgcttccttctgatttatgcgatctatactatctttttcaaaagaatatacctagttaacatgaatccaaaattttaaatttaatagtaacaaatataacttttcaaagaactatatactgcgaaccttagtgtggcttatatatgtaataatatgtagagaaactcataatgctatgatataggatagacgtaaggccattaatgtctaagcattttaaaattgttatgaaaatggaacatgcaatggttggtctaattttagtgaaatgtaagaaccctttttttacgaacttattacattttctattacatgctttattttatattttaaaccagttcaaaatataggctttttggatctttaaattattcttttaattataaatacaacaatatttagattagaaatcagatgcatagcttgaaatttatgcatgttttaatatttttattacttttggctatataaacagtaaggggtagagtagagagctcaagcctagaagggatgggacgagtaatgccatgttgtacgtatgattggggggggggcgaagtggaggggtgtttttttctatgttatgtaaaagatttaagtaaaaccatgatctatttttttctcaatttttttgttattttttctaatttttaagacgtaacacattgtggcttaagatgttctaaaaagtacatctgttggttgaaaatagtggatctacctatttaagtggaaactgatgatcggatgatttttcttccaatttgtaaagttttatttttatttaaggtgtaacacgtgacgccttaagtgcgctcagaggatgtacaatgatttacgataatataatacttattttcattttgtattatggtctgtcttttttctatttggttaccatgcaaaggaacgatgtctatgtttaaatcacgtattttcatttttgtagagtgaaatatgggtataatggatcttaaattatctatttaattataaataaagcaaaaattcaaataagttaacattatgatttaacctaagaattataattatttggctttctaattattgatttttttcacatagttaaaaattaggagacaaagaagttaaatgagtgaggagaggaagagagagttgaagggaagagattacgcgtgcatataattgtaataattatttttaccgggttgtagtgttttagttgcaattattttttaactaaaaattgaaaaacgatttattgattgattaaaatctatcctttttacttgtcttttccagtatattcatagtagatattaaaaatacgaacactacaatctaataatgttattttgacttattctaatgttataatgggggagtagctttttaaagcattcctcagagttaggttcattttatttttatccatatagatctaatttaattattccaaagtcatatatggtgataaaatctataccattatctttctataattttataattgttcaaatgacacataaaaatcagaaaatatagctccaaagtgacatatttcttctcaaagtcaatattacaatggatatgagtctttacatgtaaaatagtctaaagagataagttcatgaaatattagttgtgtgagttagatgttatagttgcttattttttgcataagttttgctttcgaactaacatattttggaaacattgctcatagtatattcattttacttttatgattgtagacctaatttaattattatgaagttatgtatgatgataaaatctatattattatcgttatttcatatgtttttataattgcttgaatggcatgcaaaagtcaagaaatctaaaccaaaatggcattttttttcaaagctaaattgtagtgaaatatggacttcaactgtaaatttagttatgtcttcaactgtaaatttagttataaataatataaagattttcgtggatcagaaattagttgtatgattttgaagcttaattgtttaacacaaaattattgcttatctaactaataaggcatgaaaatagaagaaggaataggtgaaaagtggacaaatgaattgaaggaagaggaggcgtacaaacgtacgttcgtttttgtaaaaaaaaaaagtaacttatacatacaggcttaggtgggcccgggtttaggagatgaattttttcttgaaaattaatctaatggttgaaaataatgcatccaccaattttaatgaaaatatgttttgttattttagaatttttgagaatttcactaatttattagaacatcacatggcaacttaggagcatttgtaggatgtcatatggcgaattaggagcatttttgaaaagtttaatggacttttagacatgtaatctaatgttctgaaacattagtcgggtccaccaatttaaataaaaattaacggtgatatttatgtaaatttatagagtaataagatttatcattaaataatagtaaatcctgtttgaaatatcatcaattttttccaatggtaattttatggtaattttgtgcgtatttttttcttctgacacgaccagtaggtaagctttcattggtttcttcagttgtaagtacgtaagtttttcctatatacataaatacgtaatattacgtaatattcaggatgattttttaagattttgacctttctcttaaaagtttttatttaggactttttttttaagttgattgtatatatttgtgtgtaaagacctttagaacaaataaattctaaactcaaaccattcaaaaccatgaaatcaagtagatatatggattaaaaattatagccattaacttgaacttatctgactgttgattccttttatgagaaattgattacttaataatagaaatagagaataggtgaggagggtatatatatggggtggacggacagacgtacgtacgtacgtacggtaggaggtggtggagtaggggtggggtgggatttaaatttaatctaatggtctaaaatattaggtccaccaatttaagtgaaaatagacggttagatttaatagagccacgtggtggcctagaagcatttgtaggagcaccaagtggtggcttgagagtatttctaggaagtttaatggacttttagtatatctcatagattatataatgtatattattcatttatttagatattttatgaatatttcgatgacgtgcgtataatacaatacaactcaaaataacttatatttgtacaactatgggttggaattattaacgtggtttttatctcacgtgcgtataatacaagacaagaaaagtgggacgtggggccctacatgcaagtacatactccgaatcatatggcctggaatatgaattttgttttttcttcatgtgttagtgaaaaagaaaaaagaaaagggggagtggggcccacatacaaaatatgtaacatacatgcacgtacacgtacggggcatgtgtggatttttaaagataataataaatctaattgatatttttttatgctatatctaacggttaaaaatagtgggtccaccagattaaatgaaaaaccaacggctagatgctttgcttaattcttctaatttattagagtgccacgtggcggcgtaggagcgtttgtaggggggcacgtggcggtttaggagcgtttgtaggaagtttaatggacttttagtatataataatagatagatagactagaaaaaatgcccgtgcgttgcaacgggtgaagtctattttaattttattattgctatacggtttagttaagatgaaattcactctgtagttcgcttgcatatatataattttagaaaatcatgagctacggttaggagtccgatcgtctcaagctagcatgcgagtttttttaaatagatttcttatatgattgcttctgtattaccaaaagtgaacgatcttaaaaaccgatccgaatatgaatatgtatttcccaaagcaaacgaacttaaaaaaaatatcggcaaaaacatattcaatttttataatagtagagatatgataaaaaaattaatgaagtaaaaaataaaacaagtttcatgtagatgaaaccatgtctacacctttttcattacaacttgtctattatgtattgcatatgaaaaaaaataaaagtaaaacaatgcattctatgagttatttcaatcatcagttaaatgcatttttgcagtgcttcagattttctttagaagtttaccagaaaatgtttcgatatgcctttatatctgtggagaatattatggatgaaaagttgagtgtgggattgctcagtgaatcttttatgttaatgcatgaaatacaggattcaaccgagcatcgtcaccatctttagaccattatattgtccctctccaaagaggatatgcatcgatatcgttggacccttaggctaaatattgatgttgttagttttgtgctaatgaagtaaatcaattaataactccaaacctattttactgaaagtaatgcaatgatacgcctataggatattcattttttttcttttaatctattcataataacatttaatggtaaatttagaaacacgggccgggcctgtttctttcagtttgagattattataatctagattattgagtcagattactgtaagctagattgttataatctgtagtaaaataatctgtagtaaaataagcggttagttgtttctttcctagattattagagcctagattattgggtttgtaagtctaaagagggagtggggtggcatggtgggtaatttttcacccaataatctgtaaaaagctcagctaaataagcttatcagattataataagctacatcaataagttgtctttttctttcagcttactcccaataatctggattataataatcctaagctaaaagaaacagatagacatgatgtatggcacttagcaaataaatatattattattgatcaagtacagttataccttctactttaagaagcaggcccaatcattaaatgaacaatatataatcatatagtgttgaccctattgtttgtattagcgatcttatacaatatttaagaaaatatttactactactgcatagtcgatttttacgtgcggtcaaaatcgattttcagaagcggctgggcttcccacctgtaccctatgaaatgaatattttggcatgcaggtagtgcaaccgctttcgaaaatacaacttttggaagtgggcccttaagccgtccatttgcaaaacaaaaaaggcaaaataataaaaaatatgaatatcaaaatccaaattccagaaaccctagaatctgtcacgaccgtcatgcttgaatccactgcaaacatcaccgttgttggttcctcccttccagtcgcatatactagaaaaacgattttttatgcgtggcgaaaaaataccaaaaccaccagcaatatcgtaatgagggggtggggggcactgaccgccagcgaaaatggattttcgctggcgtccacgttataccggccgccagcgaagatatgttcatttttgctggcggtcacttagatgcgccgccagcaaagatggataattttcgctggcggttaggttatatagcccgatagcgaagatccaattctttttactggcggctcacttaagcaaccacaggtgaaaattgatttccgctggcgctcttaaaaaaattcgcacataaacaaatcactgcgcgcccatacaggcatacccttatccacccaccaccgcataataaaaatatctccacttctccctctccagatccagatccacttcctctcctccaaatccctgcaccctcctctcctcctcccctccagatccacatcctctcctcctcccaggcggcgacggcggggttctcgggtggtggcggcggctccggcagctgtgtgtggtggcgaaggcaacgggaggtgggcgcacagctgcgacgggaggcggtcgtcgggggggtgcggcgacggcaacaggaggagccatcgaggggctcgacggcaacgggacgcgcagcgactgcgacgggaggtgggggcatggcgacgacgatgggaggagccgtcggggggctcgacggcgacagggggcgcggcgagctcctcctcctcctcgtcctccccctcccacgtggcttggtgctgcaacggtcgcggcgacgactcattgctgcggggcgcgacgagctcctccccctccccctcccacgggtgtggcgacggctcggtgctgcggggcgtgacggcttggtgcttgctgctcggtcggtgagacgacgacctggtcagcgacggcttggtgcttgctgcggggcttgctcgatttttttgtcagttttttttttcatgttctaaatgtttgtaagcccgtgttcactcgtatgattattgaaaggtgaatacccaatatgatccttaaacttttgcttaaggatcaatctagtccctgacatttcgtattgtgcaaacaagtaccttgagtttactgtgtgattcaatatagtcttttgaccctctaaacatgccatgtgtacatgccacatcatctatgcatgcaaattaaatatttaaatgtcctttacacccttatctgttcatacgaaataatgaaaaactattgagaaaacacacaaaaaaaagcttttgaccattggcaaaaaaagcttttgaccattggcaaaaatatgtagcattgatagataaaaataattgacatttttctttgttttatgattgcttcttcttgtttttcttttctttatttgatagaaaattaaaggttaaaatggacatttaaatgttatcttatatgcacaaatgacgtggcatatccacgtggcgttttaagttggtctaaggactatattaagccgcatgataatctttaggtcttgtttggatattataaaacatgaaggactaattcgacccctgagcaaaagttgaaggactgaattggctattcacccattattgaatctaatgaactctggatgtggatttgaatatatactcaaaaatttggatgtggatttgaatatgtacatgctgcgaaaatctgatttatttattttttttggcgaaaagagattttggggattacttttttttatagaaaatcatttttactggtggatcgcgtaagaagccgctagcaaaaactattttagctggcggagcacataaggtagccgtcagcgaagactatttttgctagcggcccacatacgacagccgcaagcaaaaatgattgtcactagcggttgtctttagccgtccgcaagcgaaaagttattttctttagcggtttagagccgccaacgaagatgctatgttttcattggcctttttttttgtggcggcgctaaataccgtcagcgaaaacccaaaatgactgccacaaaagatggttttcgtagtagtatcatcgtcgctcgaaaccgccaccgctgccgccttcgtcatcattatcgcttgaagccgtaggatctgcccgtctcctcggtggatctgcacacgtggagggcagagaggcggtgagatccacgcaggagggggagtagccgttggatccgctcctcttgtggccaccaccgtcgcccgagctcgcccccgctcttgtcgacactgttgcggccccgctcgctgttgccaggagtgggagggaaagaggctagacgggacaagggggagaagtgagagagagaggaggggagagaaatgagtggggacatagaggaggcggagaaaaaaaataggggaggaaggtgattttgacaaacacactttgcattcgaaactttacatctgactgcaaaactcattttcacctgcgggcctcttaaaatgccaatatgcgaaaatgactttccgtaagctggccttgatccaccctatttatttttgcatgcgaacgccattacagtctgcttggagcttccaagaggtctcgtccgtgaaaatctaatagtgattctcacatgccatattaaataaaatatcaacaaactgcatgcactaactatttattgcaggcagattataaagagaaccttgcgtaaaaatcaacctattttcagaacaagaaaaacattttaatgaacatttgggcccctaatatgatgtcaactgagaaaactttcaagtaaaacgtgtgatctcaattgagaaaactttcaagtaaaatgttgtatatctagtcgagagttccggttttgatacaaaatttgtcatcattcgttcttgatatattaaagttatgacttttttttaaaaaaaatagtattatttatgttttcaatgttagttcgttatataacgccggtaaaaatcatttttatatgtctttagagagaggaggggagagaaatgagaagtgagtttccacgtgcagttcgttagaaaaacctccttagttgcctttatgcttatgcagagaaaaaggacaacatgccactccgaatcgggttttgacaaaatgccaccccctacaatacaaaggataaaatgccactttaataggttactttcaggatattttgtcactttggaagattttaagaccaaaatacccttggatgtggataaattggaagagggaggagcggggaaggttgagatcgacggtactcatgcttcccggcggtgggcgtggggcgttggctgcgacgggcggacggggagaggaagacgttgacactgatgggaggaggaagacgacggcgctgatggggagacggcggtggcgatggtggagaagggtggtgactgggggaggaggagggtggcgccgatgagagggaggaggaggcggcgacgatgcggagggctctccagcactacccacccacgcgcttgtagcttgccgccttcggcgccgcccgtgcgcgcgctccatgctcgtcgcttctggcgccacccgcgcatgcgctcaccgctcaccttcttcggcgtcacccgctgctcgcggcaccaccgtccccctcccccatagtcgttcgtccccacgccctcaccaccggccgctgacgagcacagacgccgccgtctcgatgttccccggtgctcccctcacctctctctttctctctccaatgtattttggtcttaaaatttttcagtggcaaaatatcccgaaaataactcagtgagtggtatttcatcctttacattaggtggcatttcatcgaaacccaccgaatggagtggcatattatcctttttctctgcttatgcatggttggttttcttaaataaccacgtgttgaaataggattttttggcagtataagaccttgagaaaggacagacaattttgaaaaagcagtgtctgtgtggcctagaaatttgggacgccctgtgaatatgaacgcctggatcctgaataaggctgcgttcgttgggtggagaaagagagagagtttgtttggttttccgcgcgcacgcttcccaaactactaaacggtgcgttttttgtaaaaaatttctatagaaaagttgctttaaaaaatcatattaatccatttttaaaatttaaaatagttaatactcaattaatcatgagctaatggcttacctcgttttgcgtatcttcccaatctcctcgatccccttctcctcaaacactccctaaatcgttttagcagtggtgagccggtgagtgcccgttacacaaagtatatgggcgaataatagcaaatgtaattgaataattgatggagggataaagaaacttcttgttgcatggttgtaccccacctgcaaaaatgtacagattgtgtctatatatctctatatctacttctacttctacttatatatatactacttaaaaaataaaacaaaatttccgtcgtccgtccggtgagaaaaaaaagaacagagaaaaaacttcaatcggcaaaaaaggaaaaaaaagtccgactcctccggtggaaaagaaaaaggagagaaaaaaaagaagagaaaaaaatctatcccaaaacaaaaagaaaaataaaagggcgtccgactccctggtggagaaaaaaaagacgagaaaaaaaaagaaaaaaaaaacttctacctaaaaaaaagtccctaaaaaaggttcgactccctaaaaaagatttttcgtccgtaatctacttcaaaaaatgtccgactccttacaaaaggttcgactacttttattcaaaaaaatataaaaattaaagatgtttttgtcagtactttggtacgtctaggtcggtttttaaatgttcgcttttgaaaatacacaagaaatctctttaaaaaaactcgcatgctaatttgagacgatcggactcctaattgcagctcatgattttctaacaaaatatggccgtgtttagttccaaattttttcttcaaacttctaacttttccattacatcaaaacttttctacacacacaaacttccaacttttccgtcacatcgttccaatttcaaccaaacttccaattttggcgtgaactaaacacaccctatatatccaagcaaatttaacatagtgaatttcatcttaactaaaccatataacaataataagattaaaatagtcttcacccgatgcaacgcacgggcactttttctagtagatatatagaaatacaactattccttttttactagaaagatctaacatactccctccgtcccacgatataagcacttttggcatagtgacaagtcaaatatttataactttaactattaatagcaaaaaaataaaaaagatcaatcatgtaaaattgatattgctagatttatcactaaacaaactatcataatttacaactctttttatttaaaacatattacttttataaatattattggtcaaagtagcatcacgaagaccatgtcaaagtccaaatatgcttatattttgggacggagggagaattttacatacgattatctgatctgcatcagccggatcatcttgatggaacgatatatctactttattgtgaggaggaagtcaatttttatttatgtcactttaatttttcatgagtaaatttcacagaacaacatatacataggccaaataatcacagaactatagatttaaaagtaatgtataacaaaactacagatttaacaataaatttatcccaaaactacatgttaaaggccaagtagcagaaaattataaatttaataataatattatcacaaaactacaaatttgagtttaaatcattggcaataatattatgtttgagttataaatgtccaaattttgagatcaaattgatataaaatctatagttttgtgataactttattactaaatatgtagttttgcgatattccatcttaaatatgtaattctataagaaatttaatgttaaatatgtagttttgtgataatttgactaatgcaactatagttttgtaaaatttactcatttttcattgattttcctcacccgtagtgactttaatgttaaatttaaggggcaattttgttcttgcccctacttctatgtccagtattgattttgctcctgttttttttagggtttttattttttgccctcacttttttgaaacgaataagcagtttgcccctgttccgttaatttttgctaacggtgttaaatgtggggtaaaaaggacaattatacccttagatattttccggtactttcatacaaactttcaaatttgacccaaattttggcaaacttttacaaaattttgacaaataaaattactgctataaaatggcatcaataggtctgtattttgattatgtcaaaagtacggaaaaatatttaagggtttacttatctttttatccctcacatttaacaccgttagcaagaattaacggaacaaaagtaaacgattgattcgtttaaaaaaagtaaggtaaaaacgaaaacctaaaaaatatgggcaaaattaatattagacatgaaagtaggggtaagaacgaaattatccctaaatttaatgtttctttttactggaagtttgccaattgtgccattttagaaaaaagtttcgacctgcccttatttccatacggaatattatctacaagataagattgtgatggaaatagcagacggtatcttttatgataatgcaatcaattcaggtttcaagtttcaacaaagcacggtgaccatcattatttcgatgagagggacaatggttggtatgcatctggaccctaaggccaaatatcgcttttgcaataaaactatgttagctgtgttctaaaataactaccctcttaggatcttcaactatactctcttcatcctgttttgatcattctctaggttattaagttattcccaaataatcatctaaccagtatacactggtggagaaaccatctttggtcggtcggccaaaatccataatagtcccggttgcaaaaaaaaacaccacagctattttatgatctacaccaaccgggactaaaaatcatatttactcccggttcattccgtgtcagtagtctgtcagggggccgaggatctttagtcccgatcggtgacatcaaccgggactaaagatcatctttatagtcccggttggtgttgctc

SEQ ID NO: 73636 - DNA, 7587 bp, Oryza sativa
  unsure (1)..(7587): unsure at all n locations
ttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaagatggcatctcatagtcgcgcgaacacgcgactccgagaggctaatctctatgtgaaatctaaaagtaagttataaaacaattatcaactagccaacagaagggcagtctttttatgactgatacaatagacttacaaagaatgacatcagaattctcacttgggaaaaaaatgataaaagtacgctgtttaaaatgtggtagctattagatgatccatctattacattatagggatttgctattcataactcaactgaaatttttttgcaagaaaaatcagattcctaacctttggatccggcagagattcgtgctccggcgagattcttgactctggcggccgtgcaacaacggcaagagcgccggattaggtttcaggtggggttggggttagggaagggggattttggggagagggtggatccccgggtttagcgggaggccagcgaggcggctgaccggaggtgcgtggtggcgccgccggatccgcgggctggaagcaggcggtgggcggagtaggcagcgggggcaacgagaagtcgagtggttagcaggcgacgcccgtatctgnngnnnnctatnntgcgaagacagggaagggtcggcggcgcgaaggcatcttgccggaactgtaggagacgacgaccggcttcgagcgataagaaaaaaattcccaataatgagggggaagggacaccgggaagangaagggttacgcccagtgggcgggcggcccgggcgtctttcgaaggcaagcttgtctgccgggcggcgttgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacgggtttcaggacatgccatctaattcgcactactttcagaatacatcattgggacgcgaatcttcttcattttacgccactccgtccggcgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggtgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggctcaggtaaggcagcgcgggcatgtgagtcaggaagtcgatcccgtacggcggcgccgctcgcatccgtccgccggcgccgcccgcgtccccgtccgcccgccccgccatcgcccactacccctcttcaccgaatctcgcgcgtctcgccgaggagcaccatcgcgcctccacggggaagatggctgtgtcggcctcctcgacctactcgacgacgacctccaccacgagctcctcaactagggcgattttgtccaggcggcgtgtcgggtgttcgctcgcagtggccgcgttgagcaggccgtcgccgcggcggcggatggacggggactgacgcagctgtcgtcagaggtgccgcggacggacggggacgtgggtgccggcgctggcggatggacaggaacgcggcggcaccgccggatggacggggacgcgggcggcggcaaacggacggacgacgacgaggaccgacgtcgacggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaatagcaggctattagccagctgtaaacatattttagtgagataaaagatgagagagatgcgcaacggactacaaatctgtagccagctgcagcgcggactccaaaacgcaatatgtgtatgacaggtggggaaccatatattaatagtatagtaagcaactattatatgaattggctattagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggtgggaacaccaaccggacaaaagatcaaaccgatctttactcccggttgaaaacaccaaccggaactaaaattcgaagcgtggtatataatccatatcccttatcctctcctcaacagatcgaatctctcccttctttcccttccttct

SEQ ID NO: 73637 - DNA, 5454 bp, Oryza sativa
tatatgagaaaaaaaagttaaataagaagtactctctcattccctaaatatttgacaccgttgacttttttaaacatgtttgaccgttcattttattcaaaaacttttgtgaaatgtgtaaaactatatgtataaaaaaagtatatttaacaataaatcaaatgatatgaaaaaaattaataattattttttcctaatcggccacctctaatatatctgtccttttggtccctcctctttatttaaacaaataattttccttattatccaactacagagaatcctacttatgcaaaaagcttgccaagccccaataattacccagaatttctgctccacttggccaaaagcatactaaaagaaagcactccctccgttctaaaataagtgactaactttatcatgtatagtctaaattacaaggaaagctgagaggtaaatgataccccttattaaatgagggatgtatatgtgtgagagggtagttggaggtaagatatatgagaaaaaaagttaaataagaagtactctctcattccctaaatatttgacaccgttgacttttttaaacatatttgatcgttcattttattcaaaaacttttgtgaatgtgtaaaactatatgtatacataaaaatatatttaacaatgaatcaaatgatatgaaaaaaattaataattacttaaattttttaaataagacgaatggtcaaacacgtactaaaaagtaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgcttccgccttcgacgtcacatatcacgatgcgcttgcgagactgaacaaattaagctggagtactatattatcatgttgtttgcttgacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttcgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccaaaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataagctgaatgatcatgttcagtgttggtccatatccatcttagttgtagtgtagggggaattatagtttctccttc

SEQ ID NO: 73638 - DNA, 5587 bp, Oryza sativa
attttttttcttttttttttagatgtgaatctgtgatgtatttttgtgtgagatgtgaatctgtgatgaattttttagaatcctgtgatgtaatttttttaagagtttgtgatatatttggagatgatttgtttgaggatttggagatgttctgtaatatgtgatgatttggatatgggatgggattgtgtgaaatcaatattcaatattaaaagcagaaaaaaaagaaaaaatatctttcgtcccggttggtgttatcaaccgggactaaagatgctcccatctttagtcccggttggtaacaccaaccgggactaaagattgatttttagtcccggttatttgaaccgggactaaagatagcgatctttagtcccggattcgtagtcccggttggaaaaccgggactacaggggggttatgaaccgggactagaaagcatttctccaccagtgtaaatatacttaaatgcaacaagatcttaatataaagggcatatttaacatgtcaatcaagcatataggataaaagtagttaaatcaggtaagatcggctgaaaccccgattctacactaatcgacaaccaaaagcaggctagagattgagattctaatcacgacttataagatcaaactcaactgatgcagctacaagtatgaaaagaagaacaatatctagacaatcaagccgctggttatttcatagagtggtggatatcctatataatttaagtcaacgttggtatttaacctgatcggctgccttctagtagcagacgttagccgattggaggttaaataatgatattgccagagattatacagaatatatgataactcgacaaattacataaacaagattagagtatcataaagatggaagcactaatcccgagaacgcaagtcgccataacaagttttacctcttagttgaagatcgaaaccgatgcagctcaacccgaaagcaagaactcgtcgaaacaaaacgaaagtaaaagggtggcgatgcgccgaaattgtattgaatgtgtgttattgtattacatggggctcggggtctatttatacccgagattacaaaatatgtccgtgtcggacacgactcttctctctaacaaactccaagataccataagtctttgcggcagacttttgcctaaacatatctctaaagaaattacatgaaatatcctaattaatagatacaattgccttctcaggactcaatccatgcacggcaatatcctcatgaagcatattaactcaacccgacaacatgtaccacgtcacattgtcggtatcggctgaatcggccaacctagtccgactcgaactctgccgatcctagtcatagccgattcggactttagccgatcctcgctctgtttccggaacaatttccatcttgaattctgcttcgatcctatcttcatctctgatacttggattaccaaatttggtcgttaacaaccatcatgtgcgaacaccagggttaggaaagccctgtcgactaacaagcttgctacccagccctagagaaaaactcaaagggtaaggtcctacttgagtcattgttgccaagcacgcacctgttggaaatttagtcataattaggtatattttaatccaataattcggcatatttgccaagctcgcaagcgaaccgtttcccatctacaaggaggaacctctcccgacctgataagaagaaaacagggaaatgtcagcacacacatgaatattagcaccagtataaacccaccaatcaagtgagtgaaaaacagagaaaactgtaggtaaaaatttaccataccccaatgtttctccgccctcgctaataaccatgtttgcagacttcttgtccttacgctcaggacaattcttgacccaatgcccaggcttaccgcacacaaagcagtcgctctttgcctttcccttgcctttcttcttaaaattagttgtagccttgggtttgacgtcaggtttgactttcttcttgttgttgtaggatgcatgagggttcgtcttttgcaccaaattggcggtagaacctccctcgatcactttgccccgattgtcctttgccctccccttctcctcaacacccaaaaagccaatgaggtcagtaacactgaacccttgtcttttatgttttagagaagtagcaaagtccgaacaagaaggtggcaatttggcaataatgccttccgccacaaacttgtccggcaactcgcagttgttattctcaagttcctttgccagcatctgaatctcatgagcctattctactacagtatggtcatcgaccatcttgtagtcatagaactgctccatgatatatagctcgctgccggcatcggaaagtccgaacttggcctcaagagcatcccacatgttcttccccaaaggcatgtgcatatagacgtccactatgttatcggtgagcacactgatcaatgctccacagaacaagcaatccgcagcctcgaacttagcctcctcctcaggcgagagaggcggtttgggcatcttgccccgtgaaacaaataagcattgcattgccgtcaaccacaatagtacacgtgctttccatcttttataatttgaaccatcgaaagcgtctggttttagtgatgcagcaaatccaactactgaaaaagacctatcaagtttttggattgttgaaaatttcatcataattcggcatattttaattcaaaatattaaaacaataaacatgacatttgcaatatgagtagatctagtgacagtgctagatgtaaaaaacttgagcatgcttaatataaaataagcatcaacatttacagagtaacgcaatgctaccattgtgaagaatattagcaaagaaacatctaatagaatcgggagaatgaaagtataccccgagaacgtcccaccgctagattttgagacagtattgcctccattgatgtcgttcacctcctagtatccaatatccgtcgacatgttggtgaaggcaccgatgcagcagcagtagccgcgaagaacaggagcagtcgtgcttgaagcgctacccaaaaacttgatcgcccgcctacccgtgcaggttctcaagcggacgaagttccggaggcacctgctcgtcccgtacacctatgcaagcaggtgaagagaaccggggaaggattctgcaacacatgaacagaggaggaggaactcgaagtgcaagaaacatcaggaagaacggagcttctattcgtctgttgtccgtctgtggagtttatatgcgagcacgggagtaacgtgcagatcatcaaccgcggtgtttaatttggtaaccgacgcgctcgttaatatggaatcaattcacggcgtttaattccgtaaacgacggaatcaattcatgacatttaattctgtaactgacgcattcgttaatacagaatcaattctccgtgtttattaccgtctgctacaaaacgagagagagcagcagcagcagcagccgcttgcctgcctcgcctcgccccgccacgccgcgcgcgtggttgttcgcccaccatctcaaccggtcaacagagactcttcattagctccgtatttaagttgatacctcttcacttagattttcaagatgatattattacccataacacttaatgtgggacaataaaatttattaggatttaattgggtctagcccattaatctcctgcatggcagctccatttttactcaaagtaaaatttttactctacatatgtaaaatctaagagtaaaaagtgtactaggggtaaggtgaacgtaacctagaggtcaatttttcgatcgtatggtagttccatgtttacactacattattatgtggtttacactgtattttcaataataaaacaagaaacttatgacatcagtaatactacggggtggagcctttggtcagtagatgcagcgaatcgttgctagaacagtgcacaattatgaatttggtcaattagaattctcagcatgtgaaatgcatgcatatcaagtgatacactaatcagtgcagcgagatataaggtacaccgataattgggactaactgtttgattcacatctagactgatcatctacagtgttgtagacaagccagatcaaacttaattagctagtaatatatatgttctgggatatattcacccacttccatctctcaaatgccacacatatgacatatctgtaagaactaacaaagtgacatatacacctctacaaaattcaaattctaactagattcttttcagcgaagtacgggtcgagtgtagacttcaattttttcgggtagatagaccataaataacatcatttgttttttttcctccctccgttcctttatacttgtcaccaaatactattcacatttaaactctaaacatttatattttttgcagaaattttctaaatatctaaaaagatttcatattatcaaagaatacttcctccctcgcacattacttgtcattctgggttgtatagcattgattaagatttgggaaaaaaaagattatagtgccttttactaaataatttacggttaggaaaattaggatggaaagatggttgagggcatgatagagagaaatttacatgaaatgtgattgatgagataaatagtactccggtaattgagtgttctaaaagttacaacttacaagtaatttccgataacttttaaaatttacgaaaacaactattttagaactgagagagcattacatactaaggctgagttcgtttgagtgagttcccaactcactcccctcgttttccgtgtgcacgatttttcaaattgctaaacggtgtgttttttaaaaaaaaaaattctatacgaaagatgcttaaaaatcatattgatctaattaatcacgctctaatggattgatctgttttctgtgcgggagagatttgctcccagctataagtaacgaacacagcctaaacatattaaattttcttcataagtatgggtcaaaggtgacaattacttcctccacctaatataaagaattttggattgatgtgacacttcctattactaagaatctggacaagagcctgtccagattcacaatactaaaaagtgttacatctctctaaaatctcttatattttgggatggataaagtatccaagaactggggtagtttttttagcacgttctatatatttgagaagtgagagtgaaacattcagcgtccttttccaacggagcggctgcacatcacgacaggaggattgatggacagagaggacgggaagcaaggtctttcccacgaaaaagatctctgaaagaggagctcaggctgctcagccaataaaccaatgttgcggtcatcacgtgtccaagtgttgctgtcgtacacataccttctatgcgtgtatttcttttcgtccttagaactgttattcttccatacatactagcaatagggctaaaacttctagtcgccatatatttgtatcctggtatatccgtgagtaatatctttactcagggcgtcaggtctaccattgtatgaaaggatatttactattaagcactaccgtgtttgcattatatatat

SEQ ID NO: 73639 - DNA, 29055 bp, Oryza sativa
taattaggattaactgatccctgtcaaacaagcacatatgaaacaaggaaatgcttaattattccaaaaaaagataaaatccttagatgattctgccaaataaacaaaccccaaatctagcaagcaaagcaatctgacaccaagatcagcccaagagcaaatcagaccgggttaattttccccttccccctcctccccatagaagatcaatttggtggtcgaatcttagagctcttgtcgatctctctcataagcgagtaaggtatgacggcagccaacatggtgggcatttggtatggtgatctgaaacgagaagactctcaagcaaccgaacattttaatgttgaatcacaagggttaggaagggtgtacgcaccgtccgttctaaatctccatcaaacatacgagatctgccattaggtgtctagccgcatccacatagggctcaaatattcgttaattggtgctacctatgatttgagatggatatggtatggctatatgatgtcattatttgtattacttttaatttagacatataaaccccaaccctatgaactttacaataccatttaaattacatcataagatagtttggacggtggttttgcatattttgatgcttaaacagacagttttaagtaaagaatatacatatgtactacctccgtttcaaaatgtttgacgccgttgactttttaagcacatgtttgaccgttcgtcttattcaaaaaatttaaatagttattaatttttttcctatcatttgattcattgttaaatatatttttatgtaggcatataattttacatatttcacaaaagtttttgaataagacgaacagtcaaacatgtgctaaaaagtcaacggtatcaaacattttgaaacggagggagtatatatcatcaatctttagttcttaatttatgctccataaaaatgtcatactagctggtatttgtttttaactgagagcaaacatagggtaaaaatatgaatttaagtgaagatttttaatatatatgtctaataatttaacatatataaaatttagataaaaaaccattttgcaaaaccattttacatggtcatataaatggtattataaaatttaggagctagatgtccagttttaaaatttaggatactgtgatgtgagagtagctcatggttaggttccttctggtggaaccagcccaccaaggttcaggttctagacttggcatagatatgtcggcccaacaatcttccgaaggtgctcatagaaggtatggtgtgtgtacgttcataggggtaagtgtgcatgtgttgtgagcatctgcgtttgtactaatttcgaaattcgagaaaaaattgaattgtcgcccatgattcttattggccatgatgattctgatatccgaaaatgctctcagcagcctccaagtgccaattcctgaaattctgaaagattttacacatgttctaaacttctgaagttctggaggggaataagagattattgtttacttctgaaagtcatgtaactgatggtgaaaaatacaacacagagtatagtataatagtatattgttttaataaaacagagtatataggtttgatgttcatcgtgtgttcattcagtttcaaaattatgtcgagatgtgtttagtggaaatagcttccttttctcaacattgtcagcatccttctggtgttttacacttgtcaggacccaaagtttagaaatggaaaacattaggagtcatcaggattcagagaagttcagaaattttttttgtaacagagtgaagtctgcaggcattgtattggttgagtaatttcacttgtaggacatcttacggccgaggggacaaggaagaccatagagatcgtgcggctggagttcttttcagtaatcactgttattaatcatttgtcttttactttttaggcgcaagattataattatgaatagaatttacttcttgttaaatgtgattatgctgttaacactttaaataggggcaatttcgttcttacctctacttttatggctaatattggttttgcccttattctttagggttttcgtttttgccccagtttatttgttttgaaacgaaactaagttttacccctactttaaatgggcatgttaacggtgttaaatctttgaaaaaaagacatccatactatcagtgtgttgttgcacatgttccccctttttttcattagttctatatttaccctatagctgcatcttgcaattttcgtaaatcaaaaacttttacaaatataacaattttgaataatatcaaaaaatattgtttcaaaatttgacacacaaatgtgataaatctagataaatgtcgaacaaaaaatgacaaaatttggcgaaaaaaaagaagggttatatagcaagctacaagtcgtcgctgcctcctggccgggccagtgggccgttgctgccgtcaaccctggccgggccaccgccatcgattcctctccaagttgagttgccaccgccgcctcctccccacgttgagctgccgccgtcgccccctggccgggccgccaccgtcaccttctccccatgccgagtcgccaccgccgcctcctcccagcgtcgagctgccaccgtcgtcacccgctggctgggctgccgccgtcgcctcctctccgtgctgagctactgccgcctgactgggatgtcgtcgtcgcctcttcactctcgcagagtcgctgctgccgcctccaagctccctgcccgccaccaccttcaagcctcctctcagccgccacctaaccccctccccatcgtcgcctccaagcctcctcacccacgccgccacgccctctccccatgcagggcaggaggggtctgcgccgaggcgccacctgctgatgcctgctcaccgccacccgccgacgcccgctcatcaccgcctgctgcgctacccgatgccgctggatggggttttcgtgagaggctggaatagtttcccctattagatattttcttttctttctctatttatttaataccataagtccagtcccactcacttccgtctaaaccaggggcaaacggctctttcggtttaaaaacgtgggggcaaaaacgaaaaccctaaaatgtaggggcaaaatcaatattggacttcaaaactaaggtagaaaccttatggtgtttcgagaatagtttcaaaaattgaattatcgttcatgattcttattggcaatgatgattctgatttctgaaaggtgaaaaatgctctccgcagcctccaattgccaattcttgaacttctgaaggattttacaaatgtcatgttcttctgattcttcagaagaggaataaagctgaggaacacaggggtaactaaggaaggaaaacagagtattgtttacttctgaaaaccatgaagatgaaggtgaaaaaacagagtaacacgattttaatgaaacagagtacctctccgagaacatatagatttgatgttgtcatgttgagcgtgtgtttaatcaatttcgaaatgtttcaagattttgtgttttgataataatattttctcttgttctcaaccttgtcagcagccttatggtgttatagcattgtcaggccccaaagttcagaaatggaaaccattcagagtcaccagaattcagaaaagtacacaacattcttgtaacagagtgaagtctgcaagcattgtaccagttcagcaatttaacttcaaagacatctgacgtccgagaggacaaggaagagatgccatagagatagagatcgtgctgctggagttctgcctggaatagttcttttcagtaatcactgctattaatcatttgcctcttacatttttggcgcaagattaaaaaattatgaacagagtttacttctgattaaatgtgatgatactgtaaacacttgaaattatgttaatgtaatgaagcaactatgtatgacaaacacgaaatttcaaatagacaggttacaattttttcatgaaaacttttgtcgatgttgacaaatagcgagggacctgaaaaaccggaagtatcagaactgaaaaactggccgattgctttgccgtcggcgaggccgcggcacgtggaggtcgccaacgccgaggagtcgatgggccttacagtgacggcataaatccgattgatcttcgcccatctaacaaaatctcagcctgcctccgatgcatggaagcccattaaaaaaaataggaatccaccaacacacatccactccccacttgcgctccttgcggcgccgtcgtcggcggcgccgccccgccatcgatggacctagcagcggcgggggatggtgcgtttcgtcgccgtcgtggggtcgagcagggagtggaagcggacctccattgttagcgcaatcgtctccgaggtctcgggcgacgagcagttcgatctatttgtgaccgagaaataggagctcgaaaagccatggcggcgctgtcgagcaatgcccccaaccctggctctctccggccgcaaggtagcctttccttcgacctgagcttatttcccttggggccttgctcgattgtgctgcacctccttagatattcccatgcataatcccttttctctctttccgctaaattgtactgactgatctgcttgtgctagttggtactgctactgacgatgttggaataccatagctgtaataatgccttaagtttgtcattgaattaagctattagtgtgtggcatcttctgcatctgatgttcaatttcctcaggtagcagctatcatgtcatctgaagttcagtttgcaaaagatgaggagaataaacttgatgcaagtcacttggcacaagtgctgctaagcaagggatacgaggaacactgcagtcagcccagtacaatgtatagccatttttttttactggaattagatgttggaagcatggtcatctcatctggctaggatctacaggactccaatactgcacatatatgatccaggaaccagcactgaatcgaagcaggcctccaattgtacactcctctccaaggtctctggctggttgtcgggcaactcccccaatcccgaaaccctctccctgttactccccttccatttcagcttaaaatgggagaacctggcgttactagattgtgcacacgtaatgttaaattcggtaatatctcatatataacataatcctttttctctctgctgaatacttgaatttggtaatgtttaaattacttcaatattgattattctgctgatgccaactggtactgaactactgatcattttggaagccatgactgttttttttttttgcaaagataaaaaatggcaggagctcttcctattcaattaagaagaatagaaagaagcatacatagaactatatatgatcactttccttagatacattctatcaggacccaatttaggtatccatggaatagtcttctatcttctttgcactgtccctctcacaatgcatactaccaatcttttttggacagattgtggaagacaatttgccatgtatgaatgaagaattgacactgtttggctaagtgagtcatagtctcattctccatgatacacaaagcgagcaagatgagttacatggccatcccatgagggatgaggccatgacggtaatgcctcagttttattagtgaattgaattagtgtgggtaccggttcttctgcctgagatgttcaggttgttcagatactaataattatctttttagtttactttgttacccttaatttgcgtttatgcttgtttaattgtagatagtacttcagtttgcagaagatgatcagatcaaacttgttgtaagttactcgacacaagtgccgctgacaagaaagtagagagtaaagaaacaggccagacgggagagtgtactccagtacggtgtaaagccaccgttgggcgctggagatgacacatcttgctggactggagatgatccatttgcagaagtggagatgacacatcttgctggagatggcctgtacacaagaagcctactgagtttttagaaaattgtggcgtggtgtaatattttgctgctcgcttcagattgcatttaatcagatgcaaaggaatcatattgttaatcggctgtgcaggaatctgtctcttgttatattggagcctgcaaaaggtggttgtaaagtcttggggatagcattttttgttttgtacaaccttcagtaaaatatgtaagatgtaattgtcagtatacatcctgatacggtggtacctgacataaattaggggaacagcagctattttgtatcagctggcatgtcggtttctgtaatttgatgcaagaaaagtgccagggtgccagtgggcagtggcagtcatgttatacagtgcaagtaacaggacatgatgtgaaatgggttgttctatgttctctaagcttgtatcatgcatgtgccatcccatccactgaggtcaaagttcttttgtgttgagtgataactgatgatgagctgttgcatgttatcactttcagtcaataattcagtaacaatggtgcattgtcataagcattgctcatggtgaatctgaaattgctcagtctggagcctgttgccaaatcttgaagtagtgtgacaaatcaatgagcttcattaaaagtgcaccactaaagaagtgtgacaaatcaatgaactgaataaggaatatattcattgaagttgaacagcaaccttgccatccatggcgcccagccgcccagcacttggcttcctctccaaccgtgcatctttgctccaatcccccaattgctctcacctgacaacaccaccgcatcgacgacggccacaagctcgcaatcacacgcacaaatcacaacacaacaaggaagagatcagacataaaaaaaagttgattattttattattgcaaaatcaatgattaaatacaacaatgtaactaatgaataatgattaatttctattctacaatgaataattagctttacagctgcaactacagtactacactaaacgtacaactacaaatctaattatctatctacaaatcacagagatgggaaaagtcttcgactttgattagagacttggactcccatgccgttgcttgttgctgttcaagcgctggatttcttcttcttgttgcagaggcgctcgtgcaccaccccgcgcagatcatcgtcgatcttctcccagacggcggccggcagcgtggcgcaatctgtccacagcccgggatgcacgtacgcctggcgacacagggtgtgggccatcgagttgccctcccgatatatgtgtcgcacctcgacgtccgcgaagcagcggagcaggtccaggatttcctcgtgcatcgccgccgggatcctcgtctgcgtctcctcgccgcggatgagctgaaccagcaccaggtcgtcgccctcgacgacaagccgctcgacgaagcacgccagcgcgagcctcagcccccggatcatcgcacgggcctccaccacgccaaccgtccagtgctccgtgatctccgcgaaggcgagcaccacgccaccgtcgcagccgcggatcacgccgccgatgctcgctcgccgggatccgtcgtcatacacgctgccatcaaagttgagtttgcaccacccccccggcggcgcccaccatctgacgatcacccggctcggcttaaatggcggcgaggacggggacagcggagtggagcagcggggaaccggtggtggcgaaggaaagatcgacggcaagaaagccaaaccaccgccgccgccgcgaccgtcatcagggacccggagcctcccgccgtccacgcacatcctctgcccctcgacactgctcctctgccgctttccgttccccttcttggccaagaagaaggcctcgtcgccgcggccgtgatccgcgagaagattccacggcggcggcgcgctcaggggatccgcctcgaggatgtcgccgccgagcgggaggggctggccctggaggcgccggagcaggcagcggccgacgagctcgtcgtcgctgggatcgagcttgaggcccgggaggagcccatccgcgccagccgcagccgccgccatcgccaccggatcgcctgaggatttctagggttttggtggagagaaagcgtgggcgcgtgggtgagaggagatgatcagatgaggagaggaagcgtgcgtgtggatcgtctgagcgaggcgggatttgaacttatagaaggcggtgacgtcagcgcgagtcagcgttgtctgcacgcgctcttcctcccgcaggagcaacggttgagggtcgtttaacgttattgacttcgaatttggcacttgtttcgatttagttccaaattccaaaaatttgagctatcgctctattgctcatgctatgtatttttactgctcatggtgaattgatgattctaaaactatgtgcagcctccaggtgcaaatccctgaatttttcattttttgaaggattttggcattttccccatgtcttggacttctgaaggatttacctgagggacattgggttaactaaatggaggaaagcagggtattgtttacttctaaaaacaggggaactgaaggggaagaacaaataacagagtatatttgatgattttttttttgggaatatctcttcaagaatatacagatttgatgttgagagtgtgttcgttcaatttcaaaaatatttccagatgttgtgtttgagaataggttttcttgttctcaacattgtcagcagttttctttgttttacccttgtcaggaggacccattgttcagaaatggaaatattcatccgtcagaaattcagaattcagagaagttcagaaatattttgtatgggttgagggaacattgtagttgtaaacctgaaagtgttctgtttagagcctgtcgtcaattcttgaagagttatatccatgctgagtaaacctgaaggagcaaaacatgctagagttctttattttcaattcaagtagcacaatgttgtgctatcactgtcaggacaatgggccactgaactaactgtttgcttcagaatagtgtaagtattaacaactgtactctgttctcttgggattagttttaggatatttgtgactttccaatcatatagagttagcacttcattgaacgaaaggaaaattttcattgaatatgtacgactcaagaagtttgacaaagcaatgaattaaatagggaatatatttcgttgaacaggaatataagatttcagtgtaacagtgtttatgagcagtcggtacagataatataagcttacaatagtgtcagttacattgaatccaaccaatcaacagcaatctcagataataaatcatgttttacatacgcttaattacatgtaattcaactaatcaaccggccattccaggacaaaactatactatgtctcgcttctgcattgccagtctaacactacagactgctacagagcacaatgttcagtgctgatatcttgctatcttcaggacactagcctgccgacagatagatcaaacagctgagagcctcatcaatgctatctggagattcaaaactagacaacgccggtgcttcatcatagcttcaggcatcaaccagtaaagaggaataagcatcatcagaacttttttgtgatgacaaaagaagagtttcattctcaagaggctccatcaaacacatcgcaaagccacagcaagagaggtttccattccagtgtcagatcgatacaaatttcatacacaagaggattccatttcagaatccagatcgacacatatttcatacaccagaaaggcagaaaaatacttcttcattaacttccggattgatacagatttcgtacaccacaaaggttggaaaagacttctttattattttccagattgatatagatttcatacaacagaaagatagaaaaaaggacatcattaacatttctttatctacttccaataagatggaaattcaagacagggattgataatttgacagagctaacagttgctaaacatcctatgagtaaaactggtgtttttttcactctactcatggccgctgatcgaactcttccaacgccggctgcatcttctccacccttgcctcgtctgatcgaactcttccaacgccaactgcatcttctccacccttgccacctgcaaacaactcgtagacaacaagcagcaaaagaaaatacattatgtaaataattgaaccagtggatgcagaaatcgtggacctagttggcgacaactgatggcggcggcaaggaggcccagacgcggcggcggtcgtcctccgcttctccctccacagcttctgccgccgtcctcttcctaccaccaccgccgccgccgcatctcccgcttggacgcggccctcgctccaggacacggcagaaccagtcgaactcgtcagcactgacgaacaggcggtaatcgatggcaatgaggaagcgccgttcgaggccggccatctccctcgcgcggatcgccgcatccgagctggtctcgaacaccacagtccacctcgtcgggagcctgtcgatgggcccaccaaacttggcgcccacgaagatcgcgacggcgacgaggcggtgcgcggtggaaggatcgacgaggatccccgcctcccgcgcggcgccgctgcgtatgaaccggaacaggtagatcccggcgagcacgtagcacgcgtcctggatctcgatcacgtggcggacgctctcccgctggatgaaggtgtggatgcgctccaggaacacaccgatccggacgatgggcgtcgtgccgccgcggaaggcgcggatgaggtcggagtcggcgtcggcgtcggcggcggcggcgtggcggagggcttcggcctccacgagcgcggcgaggagggaaagggatcgagggatcccgcgctcgtcgtcgcggaggacggcgtgatcgccgttgtcgggtgccacggcgtctgcagcggccatggcggcggaagggtctcgcggaaagggacggatcaagattgctagggtttggcgcgcgggaggggattagggggtttcaggctggaggatttgatagaagaaaggaggatcgtgcgcatacagtacttttatacgtatcattatagatgcccaaatgggccgcccagcccgccacgacccaggcacgaccgggcctggccgaggtcagtcgggcgtgctgtgtcggaaaaagtacaccgaaggtccctcaacttgtgatcaagttacgaaatcgtcctcgaaccgcaaaaccggatatatgatatccctcaacttacaaaaccgttcactttagattcttaggtggttttcatctcgattttatctgacgtggcagctgagttagcgtgggacccatgttggccccaatgtcagggtgtccatgtcaccccctctctctttccctcttctctcccttccccctctctctctctcacctctctgcgcaggcgtcggcgggcggcgacgggcaaagcagcagtggtaagggcagcaacgacgtcatccacggccggccgcggcggcgccgccttcgcctgcgccgtgacggggcgtaagaggtcgatgaagacgacccgagaaggcgggtgagcacgcgacggccgacgaaggggagcggagcggccgcgagcgtgcagcgggcgggcgggcggtggagcagaatgtctgcagcggcaggcgagcgcgcggccagtggagcggagcggcggttgaagcaaagccggcccctttttggtggagcagggtcgtgagcgcgcggcggcaggtgaagtggagcagaacggcggcgggcaagccagccgccggaccttttcctctccgagcacatgaccatgccaacggtgcagaacgcggtggcgaagaagcccatgactagctacatctccatcactagcgcatacgtgacggtgcggccgccgccgacggcgtgcttgtaggcgagctcgacaagcgataggatgagtccgtgcgtacagagtggcgacgccgagggtgaggaagaagcccatccagtaattcccggtggtcaccctagcgcgtcgtcgtcgtcgggtctgaacttttcctttcctgccctactcaacaacactgaactctgaatctctctctctctttctgcttgatctgctgctgctaccaccacttcctatagatggccaaaaggcccgcatggcccggcccggcccaggcacggcccaccagccatcgggccagcacggcccgatcggcacttcatgccggcccatgggctgcgcctcccgcccaagcacggcccaccagccatcgggccgtgtcgggccggcccgaaggcgcgagtggcccatcgtgccattttctaaataagtctattttttgtccctcctctttgggctgtgacatatatatagcgaaaataagtttattttctgtccctcctctttgggctgtgacatatatatagtgaaaataagtctattttccatccctcctctttgggctgacatatatatagctaaaataagtctattttacatccctattctttcgaccgtggcatacaatatgtctatttttactcctcattgtttatgtctcgggcctggcctgtggcccatcgtgccgtgccggtggagaggcccaggcacggcccggtggtcgggccgggccggtacgggcccgacccctgacgggccgtgccgtgcttgggccgggccaaaacgccgtgccgtcgggcctcgggccttttggccatctataccacttcccaacgtctccagcgtgctcaccgtcgatagcagcagccctagcttccccgcgcagtagatctccacccgcgtgttgcccccctccttcctttccacctctaactgcacctcacaaactccattaatcccatcatcctcctcattatctagtaacagcaacaacaattaatggatgcagctatgtactttgggtgtgttcctggccagcatctcattggggttgagctccctgaagacgctgagcaccccgggcatctcctgctgctccggccggcctcgacgcgccccgccacgcctcgccttgccggtctagagaagactgagagagagtaggaagaaagagaagaggggaaaagagaggtgatgacgtgtcaccttgacatgtgggacccatgcaggcccacgcttactcagctgccacgtcggacaaaaccggggtaaaaaccgcctaaggacccaaagtgatccggttttgtaaattgagggatgatatatatccggttttgcggttcaaggacgatttcgtaactcgatgacaagttgagggaccttcggtgtactttttcctgctgtgtctgcccacaggctgcagccatggtccatgcacggcccaataagtatcgggccgtgccgggccggcccgaaggcacaacagcccattgtgcttctctataaataagtctaattcatctcccttatctctttggaataagtccactttaactctcttaaaagtgacccaaatctaatgcatgaccctgaaccacaaaatcagatatcttgacccctaaactgttaaaactggtacaatttaactccctcggcggttttggtgagcagtttcgctgacgtggagcaccacgtggtgatgttgacctggtcttcgtcctacgtggcattgacgtggcatttacgtgtcattaaaatttaaaaaatatatgggcccacttgtcattcacacaaaaaaaaattatgggacccactaaccggtggggccccacatgtcagtatatcacttcctcatcctcccgacctccccctctctctcccttatctctcactcccttttttgttcatgagccccagctcgccgtgccccatgccgtcgtcgtcgagcagtcagctctccagcatcgagaacgccggcgcgggcccggcgccgccggtggccatcttgctcacttgatccgtagcagagcccatcttatccatcctagaaaacaaagccaacgcttcctggtagcgtccaactcgatgatagcaagcaaccatgcttgatgagcatattgtgtctgggcaagtaatcccatcaagcaccttgcgagcattgggcacatcaccacatttggcatacatgtccaccaacgccgcttcgcagaaggcactggaactgaacccgctctttgaccacattgcaatgcacctgccttgccgtaagcaagaacacccagcctggcggcgccaccaccgctctggctcgccgacgcggacgccgcgccctagccggagcactgtggctgatgctgcgtcgtcgccatcgtggaggtcgaccccgacgcctcggggcccttgacgccgtcgccgccgcccggccgcatcaagccctgcagcagacgcgtgatgttgtccgcgctcgacgcgtacgccgccgccgagcctgatgtcgtcgccccggcgccgcgcacgcgggctccgttttggccgtcggagaggggtcgaggtcgagcgagagcgcgtcgcgcagcgcctgccgcgccgtgtggatgtccgtctgcagccgccgctcccactgccccttaggtgcggcggtgaccttcatgcttttcccgcagccatcgccgcccgctgccgccactatggacgccgccgccgttgtcgccgccgctgccgccggcgaccccagcttgccgaatggggagggagagagaaggggaggatgaagaagggagaaagaagtgggtcctacaatttttttttaatgacaaatgggctcaacatattttttttaattctaatgacaccacgcgccgcgtcacgtcaacaccatgtaggacgaagaccaagtcaacatcgccatgtaacgtgccacgtcagcaaaactgctcaccaaaaccgccgagggagtcaaattgtaccgattttaagagtttagaggttaagatatctagttttacgatttagggttatggattagattcacgtcacttttaagggagtcaaagtggacttattccgtgtcttatatggctgcaacaagtctattttgtatccctcatttctttggacaatgtcttataaggctgcattaagtctattttttggtccctcaactatttttctttgatcatgccgtgccgttgcttagattacacggatcctattctccgtgtaatatgaacttcgggaaaaaattatcttgcctactttgtgaatgttatgtgcttgcccttgtgcttttcaataccctacatggtttagtatgtatcatgttgattggataggcctaaaattccatcagatttgaagttgtcattcaaatttgcttgaacaccggaagttctttgtcaataaccctagaagttcctggttacctgagctgccagtaagttacagaccctattgaaattaacttctacgattgtttttagtatttttcaaaaacgcctattcacctctcactaggtgacatctacgagctttcacgctgcaccgaatgctcgaccccgatcagatccgggcggggatgccagatctagccgcacgggcatcggatctgatcgaggcggtgccaaatccaccgacaccatgccggagctcgctggcggcttcgtaagctccacatcgtccctcccgcgccagagacaaagggtcgtcggtttttagccctgccactgccatcccgacttgccactcagttttctaggcgacgagctctagcggtggcgaggtggggagaagggtgagggtggcggtggggatagctagggtttcgccccgacccacccgcgtgttttctagttttcaaatgtaaatatcctagtattacaggagtaatggagaactgctagctctgttttgcagctgctagtgctcgcatgttggtatcttcaacgcttatcttttgctatcttcaggacacgagcctaccggctttggtgaagtcgattcagctaagcacctcatcaattccctctgtaaatcagacaacaccggcgattcgcagatgctgcaccagatgactcgtgaagatcttgttcatattcctctggatgagagacgaacaggtcgggcaagtcgaagattttgttcatattcctttgcccaattggcagtcagccagtgcccccctgccacgcgagcggagacgcacgcagcgagtactcgatcggccgccgcgcgaaccgaggaccccacgaagatctgctgccttttccaccggctttggacggtagaacgcgtacgttcggcggggccggccgtccagtgtgcgctgtctcgcctcgcgcgttccagctgcttcattaaacttagtactagatatataccggttaatgaactaaattctgctgttattttagtttaaaactatgtaattgtttaatattttactaattgtagttattgggcccttttttagccatcgggctgttcttttgggccaaaaggtcaatggcaaacccgctcggtgggtccaggctgcccacgagctgtccgacgtcgtctccttccgtaccacttcacaccacgctgagtcgctgaccgtcttttgttatcctacctggccaccacaggtgatcgaccggtgcccgcgttaactccgaaccaccctttcggctcgccgtaccccgatcgtcaacgaaccgcgaaaataccgcgtcaatccttcgagctacctaaagatagtagcctgtgtctgcccattcaaaggttgccggtgccgcgcgcattccctccttttgttcagttgcacagataaaaacggacacggtcacgcgtacacacacgccacggccccattcccctcctttccagttcgatcgagccaacgatttcacgatttcccaaccgtgcggcgtgcgcgcacccggggcacgatcgtgcgcggctgcgcgcgcgcgggccggccaattggcaggcagccgctagctccccgcgcggtagcggagacgtgtacgcagcgagcgcgcgcgcgggcggtgcggctcagccggccggagtgtggcggccggccccgcgccttttccaccggctaatttggaccaacgcgtggaacgcgatacgtttgtacaccggtgacttccagtgtgcgcggctcttctctcgtctcgcacgtccagtcgtccacctgcttcccttgacctttttgcttgcgtgcccaccgactcctacacgtgggacccccggccggtagtcaaacactagtagaagacgcgagtgtgttttgctgttaaagcctccaattaacttcttttttgtggggggagacagcacggttatcttgttttcctccgaaagttaggcacgctctttctgagcaaataatcccgaaatggaaggaggctgctacaaaaatccccacacatgtcccaattggcccagactcaacgaactcatgcatgcagaaatataatactccctccagtatactacaacatcctcaagcaagcaaccaaagtctacagtccacaagtccatagtccataagtccacagagatagccatcgatcacatgatgatgatatcgttaacaagtcaatacgtgagaacattccgacccccttccacctcagcctcctcctttgaccctctccactactccacacaccacactcgccaccaccaccaccgctatatatatatgagccaacgcgcgccatctccacccaaccaaaccatctgctcgaactcctcctcctcctcctcctcacgcaagcttcctctcgatcgtcttcgttttcttggtcgtcgtcgtcgtcgtcgtcgtcgcaggcgaaactatggcatcccggagcagcagcagccggagccgtgccgtcgccatgtggctcgtggcgctcatggtggtcttcctggtcgccggaccgcagccggcgtccgcggcgcggccgctccggccggccggctggaacgcgcctagcatcgacggggagggccactacgcgtccggcgtcgtcgacaagtacgcgccgcttctgctctccatgctgccgaggggccccgtgacgccgtccggccccagcggcggcaccaacggcgacggcaactgaggaatggaagccatggaaaagcgcccgattggagatcgaggtgcagagggagatctgctggttcaattcataaatcatagatgccacggataccagcctttttcttaatttctttctttattttttttttcgtgatgtacaaaatatatagaaaattggtagaatacacatactcatagtcatagggcagggtgtatatatacgatatatatactgttatacatattcttttgtttgtcaattgtcatagtatattttgctgtgacaccgttatataaaagagggtttacgtttaatgagaagatcacagtaaatatacgtacgtgccagtgttcaccgtgccatgaattttttgtctctgtctgtacctgtgaatctgttattaaaatatccaattgtgtacattatttatgtctcgaactggcaagcagtatcaactatcaagagcacaagtcgatcgtgtgggcttgagccatatgccggtgagaatcatgtagtttgcagaggttgagagagggtacgtatggaggattggaggcgatcagagaggaagaattcggaagatttaatttcagactaaaatggagttgaatttggggaggagagatgaaaaggaaggaggctgttcgcctttgatctcatctgttcgttgaattgttcgcctagtgttgatggctcctttagaccttggctccttctgtgtgggagcttcttcttttatttttaaaaaaactcatcatttatttaatataggaggttacatacaacgtacataagtgaacgtcacatatcaaagatagagatcttaatttgcctacactagaacaggtagattcacatacaacataattgttgaaagacccctcaaaaataaacaagttacactgatgttctgaaaataagcaaagaaagaactccaaaagaaaatcgaaaagcaatctagtccttgcttcacttcttccaatccgatgaccaagacgatgaagctgacggtgatgacaacgaggaggttgactgcagaagataccatcgtgccacaaacccaacaggggcctctcacaagtggtggttgaagtgaacacgataaaaaagagatcagtctaacctagaaaaatgcaccgccagagacaaggaagtacaccaaatcgacaatagcaaactcaccgaagatgatttgaacggctagcgacacctcgtcactgtgggggaagatgacctccaaccaaaggacatatatgctatgtgttgacccaaaaccagtgaagaacctggtagtgtccttttggatggcgcaagccagagcaagctctcgatttggagctcaagccatctatggaagcaggcagccaagacgaaaaagatggatgttggcatcttcattgagctattcaagaaatgggaagaagaaaacctagtacaagatactcgatttacaacatgataaatctaagtacaggataaacccaacggctcaccggaacccccccccctccctttccctcgcctgtgaccgctcaccgacagagagaggataagttcaagccctgtcttgtataggagctacagctctcttttttctttaaagaggagctacagctaatactattctctatatattaaaatacttattattataatgtttaatgttgttttgaaataatcatcactgtcacattccaaaacacttttgattaaaatctttcctcactaccccttgtcattttgtcaaaatatccacacctcactataatccatacccttagccgaagaaagtactattatacttatgtagttaggctgcgttcttttataagtaaaatgcatatttttatcttgattttcattaacacatattttaaattgttaaacagtgtgtttcgtgctaaaatcttttattagaagttactttaaaatatcaaataaatttatttttaaagttgtaataattaaaactcaatcaatcatgcacttatgactttttttttgttttgcatgctactataacttaatctcattcaacagttcttaatagagatacctcggtaatttactatagcttttaagctttatattttgtttgaatgtagttagaacaataaataatttgaaaaggagggagtacgtcggatgggccagtcgagtcatcaattctacatggttcaatctttttcgctggaacactgcaggcagcccagcagacaaaggatgcaagtatggcctggtttagttcccattttttttttaaacttccaactttttcatcacatcaaaattttcctacacacgcaaacttccaactttttcgtcacatcgttccaatttcaatcaaactactaattttagcgtgaactaaacacaccctatgtgacgttaggaagctctgccggcggcaccagggagtgctctcgctcaagatgttagcagcgcacctacctcccctgtcccctcctctgttttgaaaatggaagagtacaattagcaaaatttgaaatgtttttggaaaacttgacttcattcgcaacctccaatcaagtagtcttagaccctatttagatgggactaaaacttttaagtcccggtcacatcggatgtttggacactaattataaatattaaacgtagactattaataaaacccatccataatcttggactaattcacgagacgaatctattgagcctaattaattcatgattagcctatgtgatgctacagtaaacattctctaattatagattaattaggcttaaaaaatttgtctggcaaattagctttcatttatataattagttttgtaagtagtctatatttaacactctaaattaatgtctaaatacagagattaaagttaaatctctggatccaaacaccaccttacttgtttggtcaatttgcaacaggagtgattaattaacttgcacttatcttattatagagtactccctttatgttaataatatttgtattttggacaaaattgatgttaaattttaatttttttactataaataatttctaaaatatttgtcataaaagtatgggaaccatatacataaattagtgttaaaatattttgatacaattatatatttgttgatatttctatatatgttataaaaagtagttatcaaagttgtctttttaaaaccatatccttatctaaaatgataattattactaacctagaggcaatactaattgcagtgctgtccacctatattaatctaaccattttattaaactaaaccgacaggacaactatcaattattattattccaactaacgccaaaataaaaagttagcacttccttgttgtaccataaggagcacccaaattatcacatctataccacatctgttatttcgccttagtatttaccattattaatcatttttattgattacattttagaggcgaatgacaaagttatccctagcattccctttaaatcttctgaagatgaagataaagattaagtatttcacgtaaaacaaggtggtaataacgtgtgattaattgagttttaattattacaaacttgaaaaatggattaatatgatattttagagcaactttcatatagaaagttttcgcacggaatgtatcgtttaatagtttgaaaagcatgccacgagaatctaaaatttcatcctgcctctacataagaaacgaacggggcctcactttccatcctcctctgtcacactcttttgctctgatgttgatcctggctgtcgtctctccctgtgcgtctggctactggcatcaccacacttccctagtactgtataattaaaattgcatatatttgtttatttaaggatggaggagacggatgaagagttttaggtcaatggtgtcactgtcaactctcatcaacaatcatgtcttcaagtgaaccattaatgcatatcgacagtaaaaaaaaataaatgagaaattaagttttcttttaaaaaatcgtttcatcgtatcaataccatttgtctaattggtaaattaaattgtaaagcactacattaaaattagtgctacataaacatgtgtatatagcaacatcactatttttttaagggtgaaccttacactgtggaaggagattaggggcttgtttgatgaaacttttagcagctgcaacttctttggaatcaaaagatctcaagaagttgtaactccaataaatgaactagaagccttctccacgtattctgatggttagcagcacccagcctgctatgcaccataacaaagaacatccctcgagggcacaaaatatatagaaatagtgccaaaccaaagcaaagtacttcatattagagaaattgatcaagtgcccaactcaacggataggtgggactaaaatactcgcttatccattctactgaaatctttctgggcacgctggatttggaatgaacacaaaaatgcatccttcttctgggacagtcagctcggagtacactgggattccctagtagcatttctccctgacctgcagaatcttacgacaattaaggtgggagatgttaggcacacttctttttggcatgatctttggtaccgggagaacaccatggctgaaaattatggcccctctactcgcactctgtggacaaacatgctttcagtgtagcaggcgatgtctaggaagttgagaaatcaatttgtgtcaaggctctcgatgatggctgaagatcagttgctccaactagggcttttactccaagatcagatcttgacatcacaattagatatcagggacatgaatggagcaacaggtctgctgcagaccaaacaaatttactacgccgtgtgcgatgacatagacctgtgcagctgtgcaacaactggaagttcatttgggagaataaagcaccttcgaaagtgcagctcttcgcatggctcctagccaaggaaagactccctaccaagctaaacctcaacaagaagaaaatagtacaattgccactatgtgacctttgcaatggggcagatgagacagtttaacacattatgtatccagtgcccctttacaattgctctctgtagactgatcagtgttcagatcaacattttgactgtcaagaacatggcggatttgctgctcccactgcaaattccgatcaaacactactgggtcttcttccttctatgcttttggggcctttggaaccatcgacatgatgtggtactccgtggaaaaataacatatctacgcaggttgatcgtgaggtgcatcgacgacgctactctttggactgagcggctaatcgtggaggatatgaatgctttttcagcttggaaagaaatcatctcttcctccctttgatctcttgatttgtaatgaaacctgaactttacctcccttgcaatgaaaatacaggtgaggcagttctccccccggtgaactttcttaaaaaagataaaaaaaaataaagatacaaattggatatggaattgggggctccgacgtgtaaggaaatacaaacctagctacttccatgactgtgtttcactttatcacatgttgaaacaagacgacgtcagtctagacttgaatcaaatagcttgagttttagacttccaatagctaatttgttagctgttgtcgggctatccatgtccaaatgggctagcttgtctagctaaagtgtaaagcaatttatagactagtgtcacaaggaaagacttgttggtgtcactcgtgggactatctacttgggccaaggcagaagttattggtgtcttatatatgacacatgcccttgtatattggatctcacctttgactcacaacctgtaactgcccacgggctcaagatgctctattgcctctaatttttagaccaggtgtatggatgaaaatggtacggaaatttttttgaccataccgatgccgttttcattaaaaaaaatcgatatcatttttgattgtttctgactgtaaaatttagttttctaatgtttgtatgtgtcatattgaagttgctactaaatatatagttaaattcataaatgtagaaccgtttctataagactaataaaaattgtatcgtttccttgttcccccattcaatccttgcatgttgggcatcacaaaattgacaacactgccagctttatgcagctgcacaacaacagcttcatggtgcaatttctctttttttcagatcatagtactccctgagttgagaacttgtcttgccaattattgttttgaacatcaaaagaggcaacactattaaagtctgatgcaaagtagagtggagatatagctagccctatccaggtaggcatagcataatctttgctggagtcctggagctagcgcaatagagcttgcactagccagttcatgcaccttcctgtacttaacgaaatacccggatggatgcaccttactgtttgttacgcgaggcagatgatgggacatccagacagacagctgagagaacatctttaacaaaccatcgcccctccatttatatctgtgctagtgactaaaattaattaaaggcaaaaatttacggacataaatcaaatttatgttcattttctaaaatattattaacatatccatacattgtaacggactagacccatataattgagtcgattaggaatggactggagggtgaattgagaataaagcactggatcatgcaattattgcgcacactatatatgtgggaagcagcatacaaacaggttgcatgagcagtgagaagagatggaagtacgacgactcaacttttataatagtaaagatactaaaaagttaaaaatatccaggtgttggatataggtataccaagcgcattttttttctttcgcgggagaacaatatgcacactctgcctatgacattagttaatgatattaattcccatagtttcatggagtgatatcagcaatgttccctatcaataaagggaaatttcactatgcgtggtagttcgaaaggagcggaatattccccaactttgctgtaaagttgtagctaggttttaaaaggaaaagacccatgagatcataagggtgctctaaaaaaggcagggtaatgagtaggacagagtagtagagataggtttaacataacgaaagtgcaaacctggcactattctttagcaccgtacaagttcgcgagcccagaacacaaccaatgcataagtttctaaagtctaaacaatcatatcgctttctttccctttgtacatacaacaatcaaggcaatgcatatacaatttggcccaaattaacttgatttatctgggcaactttgacaagtaaaaaacctttgtgctgttttccatgtgtgtaccatttgtatttcttaaatgctaaagaaatttgccctgatcattgcaaccgcaactacattagtacaattgctatgatgatgatgctgaggccggtacaggcttaattgggtcctttcttggtgtcacaatctgcagagtgtttcagagcaactcaccatttcatcattgttcatcagctcagaaattcttctgctatactcacccacttgccaatttgccattgccaacaccttacaaagagaggcactcctccattgcaatgctccatggtagctagctagctgcacaccacaaggcttagaaagagtgtgtgagtgagagactgagagatgagcagccatgagaggttcaggctgtcccatctcatgccaaactcatggttctacaagctgagggacatgaagaggcccaggccaacatcaagccggatgatcaccgcagcagatcatgcagcaagaagctccaggagatcgtcgtcgtcgtcaagcagcatccaccactactacctccatggacatggaaccaccactcccaagcctctcccgttgtcaccgccgcgacgatcctactacccctacctggaacgagccaagcagatgccactgatggagaaggaatctcagctcatctcccactcccctctccaccaaagaatccccgccacagccattcccggagaccaccacgacggcgagtttcaagacttgcagctacgtcctatacgcacgaggccaccgtcggcggcggcggcgtcggccgagccgaggaggacggcgagcgggagcggcacgtgcccgagctcgccgaggatgaggagcaggaggctgcacgttctcggcggctgcgagtgtagggctggtagtggtcgccggaggagcggcggcggtgggttcgcggtggtgaaggcgtcggcggagccggcgagggacttccgggagagcatggtggagatggtggtcgggaacgggatgcggtcgccggaggatttgctggagctgctcgagtgctacctgtcgctcaacgcgcgggagcaccacggcgtgatcatggaggcgttcaggggcgtctgggttgagatcgtcgctgatgctgattgttgcgttgggttgtgagctatattgattctgtttttgtatagttggattgatcgaatcgattgagctgtaaatggatatattgtgccgttaatttttggtgttaatgaatcaagctggcatatgtacaatgttttgtcctgtaattaaatcgaggtattcaagggctatgcagggaaactctagacttcacgcttagttttgacagttagccatgccaaattaaacgaccgaattttttttccaaacaaattcttcaaatagctgcataatcataagcttgggaaattcacaaagaatacatgtcgctgatgattatttgtttgtgaacagtgactcgtgagaacaacgtagctacgtagctatgcgggacggatccgttagtaaggtaagacgtttgtggtgactttgttaatcttaaaatagggtgtgtttataaaaatgagtctgcgtgtatgcgtgtatatatatgagtatacatgttttcaaaatatctatggaagccatcgtttgacttattttaagcatataagcgcaacagcatatttacaaacaaaaaataatttttaaataaaacttttatatacgtgttcttagcgatctaaaagaaaaggctgaaaaataaacttcgatgaaaaaaaccttaaaatcaacttcaagtttaaggttaaaaatttaaattttggctgataagcataaacataaacataagtaaaaaagatgagtctgtatgtctttgacactagattgattggacaaccaagtacaattggtaccggcttggtatgggtttatcaaccaacacggtactggacacgttctttgccattggctttatgtaaggaggggtgaaatattagagataatcccttatatgccattgaaaattggtctgatcccttatatgtcactaaaaattggctcttcccttatatgccattggtctaaatttgcgcatcctctcatgctactaccgtcagttgaccgtgtgttgaacgttagctttcaagtaaaaaagacatatttgccctctctgagttgttaggcatgccctataatcaaaagggtaaatatgccttttttccttaagaattaacggtcaatacacagtcaactgacgggagtgacatgagagggtgtgcaaatttggattaatggcatataagggaagagccaattttcaatggcatataaaaggatcagaccaattttcagtggcatataagggattctctcgaaatattaagttggatatggatattgtcagataacaaatcacttatcctgtaacatattctatattattttcttcaaaatggattcatgaacgaatatccatttgtattttcaattgatagatattaaatatagacaaacaattaaagtgttaaaagagattcatcaaggaaaaaatatacgatattatcaagttaatcaatcttttattatggttgttggtgaatttataatatatttttaagtatgtttcataatatgggacataccggctataaaactcttattgtattttaacccatatttcttaacggattcggattaaaactcggataataacgaatatcctactttctcttctatattattttccttagagttggatcaggtgggtggtcaagaaatatccgttccgttttcgatcctgtaatggtaaatttgtgcctgttcttttctccaacaaagttagataaacttttggatgctcgtggcatgcttttcaaactgctaaacgatatatttcgtgcgaaaactttctatatgaaagttattctaaaatataagattaatccatttttcaagtttgtaataattcaaactcaattaatcacacgttattatcacctcgttttgcgtaaaacacttaatctttatcttcatcttcaggagattcaaacacctatattttccattttagcctcctttaactgcgacgttggtctcgcaagagtcccactgccgaacccagctacgtgtcgcccaacgcctctacctagtctctagatttttcacttttgatgctttaaaaaacttattctacaaataaaccccttaaaaacttattttaggaatgaacccttttcacggcgcattaacaacattggcgtcgtcctccttcaaataagtgacttagcatttagtgagggcaaggggaaccgtggcaacgtcattagcgttgtcacgttggaccatgacgctgttaatattagcgtcatcaaaatgatcaatttcttcgaataagtttttaggtatctattcgtggaataattagttttctaattggataaaaggtgaaaaatccacgccagttcctcctccctttctccaagcgccaccgaccaccgcccctcgccaggaatgtcaccgccaccgacaaggacgaggcaccgcgggaggatctccggcccgaatctcgccgtgcgccccaactttaggccagcggcagatctggtcccgctggatccggcctccgtagtccacagcctcgccgcggacggcatctcctcgccggagtcgctctcgttgctccctcaccagccgccaccctgcagcgcttccccccaacatcgacagcaacaaagctccctga

SEQ ID NO: 73640 - DNA, 23214 bp, Oryza sativa
aagtgagtgaggagtcataacattatctatcttgccaaccatcaagtatctgtgatgggcaataaagttactttgacgatggtatacaaggacatctgtggaggcacatcacgtaacttccaaatgacatgactcactctgatcccaatagaatatccacaaaaacaaacactctagagcaaccgataaggaattcaaagaaaacccatccatcgcatctataaatagacaagcacaatgtaaacccacttcatcattctcacaactcaaacattacagcaaaagcataagaactagaaacccaccacaatgaagatcattttcttctttgctctccttgctattgctgcatgcagcgcctctacgcagtttgatgctgttactcatgtttacaggcaatatcagctgcagccgcatctcatgctgcagcaacagatgcttagcccatgcggtgagttcgtaaggcagcagtgcagcacagtggaaatccccttcttccaatcacccgtgtttcagctgagaaactgccaagtcatgcagcagcagtgctgccaacagctcaggatgatcgcgcaacagtctcactgccaggccgttagcagtgttcaggtgattgtgcagcagctacagctacaacagtttactggcatcaacttcgatcagactcaagctctagcccaagctatgttggccctaaacttgccgttaatatgcagtatctacccaagctacaacactgctccctgtagcattcccaccatcggtggtatctggtactgaattgtagcagtatagtagtacaggagagaaaaataaagtcatgcatcatcgtgtgtgacaagttgaaacatcagggtgatacaaatcttaataaaaatgtcatgcaagtttaaacataatgcctctgtaaggataaatcctagtacattgttgaaattaattatcatcaccgtctactatggttgcatttacaactttacgatgcatgcctacattcggttctaagctactatggctactcgacgtgaacggagtgtgttaagcaggtcaatcttttcatttcgatgagaacaaagtcaaaacgcatgtggcaaatagtatataccctacaacgtaatcctacaccatataaaacatgcccaacctatagcgattataaatccactattcaaaatataagtatcgatgggaccattttccatatcattgttaattcaatcttaccttgtcaccgaaacaagacgctccgcgtaacatgaagttaaaatttccatatttgaaggcttggtcgcggaaatatcaatttataatttaaaaacattaagctaatcatgtagagagaactcaactagtaatttatatattatttgtgataatcatattctaagcaggggttaagataatccaagggtagagtgacacacaagcattaattactcatcctcataatatatcatctaagctaagtggaaagaaaagagaaagagaatctattcctatacttctaatatacatagtatacatacattctagttaactgatatactagctaataccctctatccgatgccctcctggtacttcgagaagccacccctgactgccgagttccttacgacagcctgtcatgaccaaataatgatatcccataatctagacaccacgtctaaactaccagatactactctaatatcatcgtcacgacatagagtaaatgcataagcaaacattatacccgcaccaaagcatcttctagataagctagccgtatattcagtataacatgaacataatgtaaagtaggtactcatatactcgaaaagtatttcagtaccataaatgtatatagaagagtattctaataaaagtacaaagcttacaaaagaggaaaggaaagctgctagagccatacccgaactcttccaaaggcttccggactcctgattcctattctaattctattccaccaactagatactactaaactaaacttgagaggaatgagagaactattgcttgaggtgtgtgagtgaagtgggaaggtgaggggtttatatagcctcccaatgacggttgtgacggttggaatggtcggaaataccgtccaaccgtaattgggagctaatccacaccgtccagaagaaaccctgcatccagcggcgatgagggaggttcggtcgaaccccctagttcggccgaacctggggccagcccaaccagcccatggctcggctgctggcctcctctattgttcttctccgcagacttgtgaattttggcccaattcatcgtgtcaattctgaattcttggcctattcacacacaagtctggttctcgacatcgtccgattgatttatcgtctgagttaatatcgattctcctccactttagtgtcattccctgcaagaggttagtatacctaatactagtggaagtttattattctagcagatatatgcattgcaagcatcactagttctctcctattttagtaatattgacggtcgaaactgatcgataatgaccgtcaacaaaaccccccaagcttgaacctttgctcgtcccgagtgaaggacgaaaggaaacaaagacttggttattgatcaggaggtgctactatgctgcatatctcaaagatacaggtggaaggtatatgtactctctcttagattaaataatctttggcacggtggcttacccttacccctgattcccacaagacactgtttctccttgccttgggcggttgaaggacagaacattaattagagcaccaatcacccgatctttattcaactcttgttccggaagttttcaaatgattttgaaaaagaaagccaagttcctcaattgattcacatagtctctctaagtgtatcaatttgaattcctcaccaaacattgcattgttgattcctactctaaggtttatatgtggagcttggtagggatcaaacatggcacacttacattcacatttattaccaagtcaaaattttagactagagcagataactaaacatactaaagatcaagatcgtgcataatgtgtgtatggtatatagtcgaaaaataaaggaaaatgcttctcctttggtaggaaaatgcttcttttatttataaggagagggcatggctatattttttttcaacatcatgctcatgcttgatggagcataactttattattattattattattgttattgttattattattattattattattattattattattattattattattttataaccatgcctttacctcctcttttttttcttttttgtcaaaaggatttttttctttttaggacaagaaagtacatgaaaacatggagaatttattttgatggtaatgtgaaaatagaatggaatattgcttaactcccagtgtaggagtttagcatgtgcatatatgtgggtgtatgatcttgatcatagagcatgagaagtatctacacaagtcacaagagtttgacaaagttcaatggaatggtaagcaaccaaaatgtatatggtttaatcatgatagcacatttttggctctggtagaaatttacatcaaatgaggaacttcaatgttatcattttgaaaaacaaaacatccggaattcaagtcaaactagtatcaggatcatagctactcatatttactatctcatatctcacaacaacttagacttagattagcaactgcagcccatttacctcaggttcccggataattgttggctacttatatttaacctttgagagagtatttaccaagaactcatatataagagatataaaacagagcaactattcatcatttcaacaaagagaactagcttgtcttacctaccatgactcaaacctatcctatctttttggtattttctattttgcaattttttatgttgttttcaagttttgtaggatgcaattggaaagcaaacatacaattggaaagggaaatatgcaatgtgatacaagttacctcagtgggtgtcacgtcctgataaattcatcccaaaataaaaatcattctctaaaaggaataatagaattaattaaaattcaaaaagaaattggcaaacactaaaatacatacaagaaaaatttgaatgttgcccggagaatttttgttaaattctccttggtctaaaaggagacctcaaattttacttgaattttcagagcaccagaaatatttattaagcaacaacaacaattaagaaagtttactaaaaagaaaaactaaaaataaatcttccttcctcctttgggccaagtctggcccaaagtcctccctctctctctccctcggcccacggccaaagtcctctcttcctccctctctttctctccctctccttctctccctccttctcttgggcctccccttcccctcccggcccactccctcctcttctcctcctgggccgcctcggcttcgcccggcccaagccgagccgcgcctcccacccgttgccgcgcgttgaccgcgcgcctcccacgtgggtcccgcctgtcaggcgcgtccccgacctccagccgtcggcctcttctctctcccgtgcaaaccctagtgccaatcctccccaaaatccacgcgattcaaaccggggtttccgaaattgattagggggttttaatccccattgattcctctttgatttcccccgttttcccctttgaatggcgcccccaatcgccgggaacggacgcgccaacaccggccgccttccgttgctgccggccgccattcccgcctccgttccgacctctctcgttgccggctccctccccgcgcctataaaatggaaccccctccttgcgttctctcatttttgcctcctcctgagtcttcccgaggtccctagccaccttcccgccgtcctcctctctctcccgtgccgtcggccgcctccagctgcctctccctcctcgccggaacgccgtccagtcgtgccgtcacccccagcggcctcgcagctgcctcctcttccccggcgtcgctccgtttcacgggaaaatcatcggagccgcgtcctggccgacgaccagtggtgtcgccaccactccaccgactccagctgcccctgccgcaccgctcaggtgcgggccggccgcgccatctactccctcggcgtcgccgcgtcgacctccaccccggcctgccctctgattcatctggagaccgccgtcactgccgcgccggcttctccatcctcctcgtcgactcctccgattggccgttcctcctcgccggctcgtcgtctcgctgcgccgccaccgtcgtcgacatcgcagcggcgtgttccacgccgtccttgcctccgtgcagctgctgccggctgccctcgtcgcctcctcgccggttccgggcgtcgtcctttcgtcgctcctggtcgtcatggcgttcgtccctccgtgaagccgatcgcgttcgccgcccgtggttcgtcaagcgagctgctgcagccccgtcatcgtcttcatcctcgcctccgcgtcatcaagcctcgtgccggtcgcgtctcgccttcgtctaaggatcgccgccgaaatcgtcccctcgccgttcgtctccgctgcccattcgtcgtcatcgttcccatgcctcgtcgcgtggtggtaaggatccgtcctctcgctgcccccgtcctcgtcctttcggtgtcacccgtgcccattgtgcggttgtcgaccccggtacccgtgtaccggtgtcggtagtcattcgcttgtgcgtgtggtgaccgtgttagtgtgcccgctcggtagccacgtggtttccacgtgtgcagcccgcgtggtgtctagtggagtccgtttgtcggccactcgcctcggttgacacacggggtccgcttctgtcgacccgtggaccgtctctatgtacccggtctgccgtggtctcttaggttgacatgtggggtccgcatgtcaacagcgcagccttcctgtcttttccaggctagcgcttacacatgttttatagttgcaaaacctaattataataatccgcaaatctccatataacagcatttaacttcggatgaccatgtcttggtcatacgaactccgaatcgatccgttcaagtctcctaatgtttgttataacctaaagaagattgtgctttctttttatgtattgttattgcttctttataggcttgtagttttgcttgtgtgcttcgcgtagcttctgtcgttccggaggttctcgaagcgtgggtcgcggtcatcgccgaaggttcggaaggccgttgtctctgagcaaggcaagtcacatcatcctttagcatattgaatcccagtttataaaattattttgatttaaattaatgcattattgctttatttaaattcccgcgttatcactgttttatttagccagcctatttacctttgttatgaccttattatgattgctattgttattattaccttgttcaccctaggaaaatagaaccccaactagtgggtactctatttatggttccactagtatgaacttaggtagatgcttcgctggttaattatgcagcattaggtggttttataactttagactttaggaattctcatatcacttggacactatggaatggttggattatggtggaattggacatacacctctcttcctctttcaaaacccctaaaacctgttttccggtggggtttgggtgcatgccagttgtgggaagtagcaccccggccaatataaggattaagctcgggcctctgttgtaaagcactaccgtaattccacatgtctagtgggtaaggcttagtttgtggctcagtctggttattgtcgcgtcccaaaacgactctaaaatacatcctctaaattctgcctacaataattaaaatccatgtgaaagcctccaacaattaaaatgtgcaaagttaaaagtcaaataaggcttgcaggatttttgtatatttcctaaaagcctaaaatgcgtaaataaattttagtggaattttcagagcacaaataataattattaagaaataaacaaagttaaaatgactttataaaaagaaaaaccctaaaagtcccctttccctccctccccctcttgggccggctcggcccacttccctccccctctctcctcttcccccgcggcccactcggcccctccccgcgcacgcgccgctgacgggcgggcccgcccgccaccctcgctgacgggtggggcccacccgtcatccccttcctcccgccgctcccgccgcctcgcccgcgccctagcgccgcgaatcccgccgcctcccgccgtccccgcgtgcaataaagagggggaaatcactccccgtgatcccctctccctttccccccatttttccctctctcttccacgttcaaacgggcggatttgcccctgcaaatctcgccggcgccattgatggtggccgacctcccgcgccggtttccttcctttcccggccgccctctctcgtcctggctctatttaaaccctccccgcacctcctccgtccgtttccgcctctcgccgcccttcctcctcgccggaatcgagctcacgccgtcgccctctctctccgctgtcgccgccgagctccagtccgccgccgtcgtcgccccggaccccctcccacctcggcgccgcctcctgcggcttcgccgcatccttgccgacctcgtccacccctccgtttcgctcgccgaccgccggaactccgtcgaccccgtcgacccgagccgcgccgccgccttcctccgctccagccgcctttttcgtcgtcgccgtcgacctagggtgagccgtggaccgccgcctcttttcccccttcccttcccctctctcggccaccactccgacgtgcctatggccgccgccagcgaccataggggccagggcgccgcctcccaccggctgcgcctgcttggccgccctcgggcgcgccgagtggctgccgcgtggggcccggccgtcagccgcccgcgcctttaggtgcagctgacgcgtgggacccacggcgccggccggtgcgagccctggtgcgcccggtccaccgtggaccatgaggcttccacgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatatgaactcggaattggaccgttcaagtctctaatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcctagtttataaaattattttgatttaaattatcgcattatcgctttatttaaattcccgcgttatcactgttttatctagccatgcctatgtacctttgttatgaccttattattgttattgttattatttccttgttcaccctagaataaacaaaaccccaactagtggacactctactcatggtaccactagtatgattttaggtagatttggattcacacctccccctctattcaaaaccctcaaaatggttttaggctgggctcggggtgcatggttttgatagtagcaccttggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccgatgtcctgctgctaggggctcagtcctgcctacctgtcccgggggtcccggccgtaggtggggttgggtcggtactcttgtctatggctaggatgggttggaaactatgtcacgtatttcgtccgtataccgtggtggtatgtggcacgtggctacacgtgaggaagatgtgtcttgtgggtaaagatgtacacctctgatcagagtataatctattcgaatagccgtgccctcggttatgggcaagccgagcaatgtacccaagttagtgttttaaattcttaaaacctgcttaacaactaaaatgtggaatggttggcttgggacgagctgggacccagggtcgggttgccagttcggtctgaatcatcgtaggccttgggttaaggcaggttcgtgtgggttcacggccttgtttaataatattgtatagctctggaatcgtgtttacaaaatagctttgagcaactaagtgtcttttaatgctgtttactgcgaaccctaaccctttatatcttaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgttgtttctcgtttgtctttgtgtgtgctgggccttcgctgcccatgtaataattaactatttacgcttccgcttgataaactctgaaatgtatcaacttttggtgtatcttgcctcctgggacaaggaataatacacacacgtaaggaacgcccgttgggttaattccggtcgtgacaataatgtaaagtaggtactcatatactcagaaagtatttcaataccataaatgtatatagaagagtattctaataaaagtacaaagcttacaaaagaggaaaggaaagctgctagagccatacccgaactcttccgaaggcttccggactcctgattcctattctaattctattccaccagctagatactactaaactaaacttgagagaaatgagagagctattgcttgaggtgtgtgagtgaagtgagaaggtgagaggtttatatagcatcccaatgacggttgtgatggttggaatggtcggaaataccgtccaaccctcattgggagctaatccacaccgtccagaaaaaccctgcatccagcggcgttgagggaggttcggctgaaccccttggttcggccgaacctggggccggcccaaccagcccatggtttggcttgtggcctcctctgttgttcttcttcgcagacttgtgaattttggcccaatttatcgtgtcaattctgagttcttggcctattcacacacaagtctggttctcgacatcatccgattgatttatcgtctgagttaatatcgattctcctccactttagtgtcattccctgcaagaggttagtatacctaatactagtggaagtttattattctaacagatatatgcattgcaagcatcactagttctctcctagtttagtaatattgacggtcgaaactgatcgataacgaccgtcaacacaggatatcatttgtacaactgccataaactaaccattcccctgcagaccatagaagaatctcgtgcaggtggagcaaacagggagacgcgtaacatggcaaagaatgaacaagaaagttcatcatccttaacacccgtgcagatgtatgagaaaggttgggcaccaactagggatgcacccagagggacccaagctccacgccacagcatcggagtctaaaactgggcgagtgccagtgaggaccgatggcatgcgtctcatgacatacattgggggataaccaacctcccagatcaagtggtgtgcctccatctccttgtgaatggtgctcgagttcctcttgttgggacttaggtgaaatcactaggagaatggatacccttgatgtgcagacgggggagatccagtacaacctcacggaacacatatctcaaacgctagaattgcaacaatctgctaatgctcagttcgccaacttcaacaaaatgatgcagcaacagcacgatgaccttcaagcgtacttcctcttccaggggttcaatcattatcaaggaccctaagcgaaagccaagcttgaggtggggagacatctctccccccactgaggtaacttgtatcacattgcatatttccctttccaattgcatatttgctttacaattgcatcttataaactgaaaacaacataaaaatttgcaaactagaaaatactaaaaagataggataggtttgagtcatgataggtaagataagctagttctctttgttgaaatgatgaatagttgctctgttttatatctcttatatatgggttcgtggtaagtgctctctcaaaggttaaatataagtagccaacaattatctgggagtctgaggtaaatgagctgcacttgctgttcagagtctaagttgttgtaagatatgagatagtaaataagagttgctatgaccctgatactagtttgacttgaattccggatgttttgtttttcaaaatgataaaattgagagttgctcatttaatataaattcctaccaaagccaaaattgtgccatcatgattaaaccatatacattttggtttcttgccattccattgaactttgtcaaactcttgagacttgtgtagatacttctcatgctctatgatcaagatcatacacccacatatatgcacatgctaaactcctacactgggagccaagcaaatattccattccactccatttccatattaccacctaaataaattatccatgctttcatgagctttcttctcctaaaaagaaaagtcctttcgaaaaaaaaaagagaaggagggaaaggcatggttatgaaaagagaaaaaataaagttacgctctcacaagcatgagcatgatgttgaaaaaaaatgtagccgtgccctctcctaatcaataaaagaaggattttttgggagaagaaagtaagcacaaaggagaagcattttctttatttttcctcatgtgccatttccaccatataccacacacactttgcacaatcttgatcttaagtatgtttagttatctgctttagtctaagtttttgatttagtaataaatgagaatgcaagtatgccatgtttgatccctaccgagctccacatatcaaaccttagagtaggaatcaaaaaggcaacatttggtgaggaattcaaagtgatacacttagagagattgagtgaatcatttgaggaacttgagtttcttttgcaaaaatcatttgaaaacttccggaattagagttggataaatatcgggtgattggtgctttatttgttgttctgtctttcaaccgcctaaggcaaggagaagcagtgtctcgtgggaatcaggggtaagggtaagccaccgtgccaaagattatttaatctgagagagagtacatataccttgcacatgtatctttgagatatacagcatagtagcaactcctgatcaacaaccaagtttttgtttcctttcgtccttcactcgagacgagcaaaggttcaagcttggggggttttgttgacggtcgttatttaccaatttcgaccgtcaatattaccaaaataaaggagagctagtgatgcttgaaatgcataaacatgttagaataataatattccactagtattaggtatactaaccttttacagagaataacaataaagtggaggagaatcgacatcaacacatatgataaatcaatcggacgatgtcgagaatcaggccaaaattcacaagtctacgaagtgaagcagcggaggaggccaccagccaaaatgtgggctggttgggccggcccaccctggttcggccgaacctgccgtgaagccgctggatgcagggtttggatggacggtgtggattgcttccctatggcggttgggggtattaccgacctttccaaccgccataaccgtcattacctgcctatttaaggagttcactctcttcacttcaacacacacctcaagcaagagctctctcatttctctcaagtttagtttagtagtatctagctggtggaataggaatatagtagtaatcaggagtccggaagcctttggatagttcgggtatggctctagtagctttcctttcctcttttgtaagctttgtactttatttagaatactcttctttatacatttgtggtattaaaatactttccgagtatatgaatgcctactttacattatgttcttgttatactgaatatacggctagcttatctgggagatgctttggtgcgggtataatatttgcttatgaaattactctatgtcatgatgatgatattacactacaagaaatatgaccttctatgaagaattcctcgtgacatcggagctattcgtcattagcacattccattttatgacgattagtatgagatggggtggcttagtgacgaaaaaaatgtgttcgtcgttaatgccaactagaaatcgtcataaattatttcaatgggacgtcgtgacgaatattaacttgtcataaggggcacaaagcaaacgtcataaatatatataatgcatttctagaaaaatatactccatctatcccataatataaggcgtggttactataagatttgtagcaacaaaattataaccatatgaaagtaaatttaaatgtcaatctaatgatataatttttaacaattaaaattcatttcatattatactaagtgttggtcaaatgtttaaaagttaaatcttaaaatgcgtgcacgtcttatattatgagatggagggagtattaaaagttaaagcaatttaatcaagtgaataaatgaggaaaacaaaattttcctgcaaaaattatggccggaaatattttttttaatattctacgtggtctaaattattctctgaaaatttctgtgaattttcagagctcaataactaattttaatagtgagtgagcaaatttgagttatgctatcagtgctatttcaatagtgagtgagcagcaatacaaggaagatggctaaatgatttgtacctggaggacttcttgattttcgacatgggacaacgggatgttttcttcttcgggttagcttgccttgctggttttccagtcatccccttgctgccagctttttcagagtcatcattttcatcatcgctcagaactaatttcctcttgcggaagtctgattggttggccaattgagtggtgctgggttgagagtcagaccagatttttggtcctctgccagcttgaccagtttgccgacggggtgagcggcgttgagcagttggagggtctgacttcatcaaggcgaattcctaggcatgatgattcaagttttccatcaactttgtagatgataaaagcatgcttttgagaaaggttgaaattttaaatacataccggtggagggtggttgaaggcactgtatggcaccactggcagcaagtgcgaatagcttactacgattgcatttgagaagatcttatacattctctccttcataaccttgaattcaagagattcaggatcttcacggttggggtcatgcttgccgtcgaattcaaaggtcgtgcgagatctttctttgattggggctagctggctcttgataaaatgccgggtgatctgttctccttgcagaccttgctcctttagtttcagcatacggtccatcagggcaagtgcctgagcggcttcctctcccattggaagtgagttccaagtgtcctgataaactggaggaagacaggagtactcggggagtgcaggctcggggttttgtacatagaaccaattttcatgccagcctttgtttgaggttttgaagggcatggagaaatacttttggctcagagttccccttagttgaaatccagccccccctactacgcatggcttgttcttgttcggttggggtttgaggaagaagatgcggcgaaatagtgcaaaatgtggtctgacgcccaaaaaagcatcgcaggcatgtatgaagttggcgatatgaactatggaattcgggtttaggtgatgcaaactaatcccataaaactctaatatcccccggaagaatcttgaggttggaagagaaaatccgccatagaagaaatgagaaaataccatgacttcatttgtgtcaggggtcgggaatgcttcgccgaacgccggacgccatccaatgatctccttcgccggaagaacaccatgtgctaccatttccttcaagctttcctccgtgatgtcggagggcgcccattggctctcgaagctttctctctcctccgccatggatgcgaattgggtgatgcgatttgctttggaaatggctgagaatggatgggggatcgatgcggtggatgcgcggatggtttatgtggaattttggaaggtggatttgagcgaattggagaaccctagttccgccggagtggttttgcactgtagtgggaaatggggaaaatggcgagagtctcggcggggaagacgaaacgacgctctgacttcggcgtttatttctctagggtatcgggagtgctaatgggcctaggcctatacagtacttcagcccaattctgttatcggcgtggctaagttgtgatccgtagggacttaggcatttttgcttcggcaatttttcctcacaacagtatggcctaatgctgttaaaatcctttgtgatgcagttagatgattccttggaattactatgatgcaaataaaaaaaggtacccgacaaaaggtgttatacttcttttgtaagcctttttaggctgcaaaggctgtttgggttttgttgagatgattggtttttgaacagtcattctctcggcatgttatatgcttattttttattatggcgtgagtatagcctaggctattttgactcattaattgtcgtgatatcatatttataccacatttgatggatctttgagagtttttactcagattcttgtcatatgtgctgatttatggacctttggagtattttttactcgggcctctttacgtcttcatttttggtatattaaagctaaagcagtcggctcgatgttttattaagcgctgcatatgcttagctatatgatactctggatgatacggttgtaaaaccactcggatggatgttatttgcactttgactatatgtttagcttttagctactcacatagtcgggggctacacctaattaggtgcatctattcgatgcacctgattatttatttttagcccttcacagtctttgattttggtactcgggagatcaatgcagaagaaattgaagcactcggattatcattttgtgctacaagaaaagactatttcatcgactgtaaaggtctcagaggctactgtggagattatggataccccatacctacacggcatgtatagtccgactgggtatgaggtgccatgtatagatagaatatctttaagaggactcgggttaaattctaaacttgtatgtcaaggaagtacctgagatcctagtcggttacgattgtattttatctgtaattacatattccgttagggatatgaactgtattttataatatggaccccttcccctatatatggaggggtccgggtgtctctaggggcacgatttttcacctagatcatacgatcaataatactctcggcggatcaatccccagacaggagtagggtattacttcttgattaagaaggcctgaacctgtacaaaattccttgtctctaaacccatccacttttccagcttgatagccacccccttttagtattgcggaaatcttgtttcgacactgagccacttcgcccgagcttcatcaacctctgtagatcaagaatcccgaaggaaccgacgcgaggtggaccacggaggaagatcctcttcttcttccccaactccggccgccgacgccattcctttatttctccttctctggtgagcttcggtgcaaatatttttcgcctagagctaccttgtgctgatctaaaccgaagcatgcaccctccctatgcagtagaagcccgggggtacaccgtcgacgacgaccgtagcagccgcgccgtcgccgaaccagtacaccatcgccaagacttcgtcgagccgcgtttgcttcttggtgagcctcctagtagtccctagagtccttaccatacgcatgcacgattagatcgagcctcaaaacccacatgcatatgcaagctgtgctttgccgccgcttctaacactctaatagccgctatagagcacgaaagcttgcactaaagccaccaataggttcgcacggtcgttctctacacttttagttttgggagcttgagctgaatcgccgccgttcgccgccggtgatgctgtgaagctcgcggctgtgctgctgctctgctctgctctgcccagagcaagggcatgtctcgtgaaatttaaagactcccagggatgaaatggcaactcaaccaaaaacttacatgtaggaccagtactaattcgtaaataaattaaaactcgagagtctttttgcataaaatcctaaacaccgtactaggggctgcgggatctatttcccgagaacccaggggcttatgcgcaaaaccgtagtcgctgactggtggacccgagagagtaaatgatttgagaaaattggagaaaatacaaaccttgtttcttatcaactgaaaaatgacagaactttagaaatttgtagaaaattcatcctaactctaaaatttgcaaactaaattttgttggaataatattttcatgctttgcatcaaaaaaatggttagcttaacagaatcataaagatttatgtctcaaaaatccgaaatgcatgtaggtctatatttaacatgtagacactttaaaaatttgtaactttaaacgaaaattattaaaattaaaattctttcactaaaaatcaaattaacacagatcacaccaactccataaaaagcattcattttagagcatgttggatttttatgtatgttttaatttcgattttgcatatgtatgtttagacgattcgcagccgagtcacgaggaaacctacctttaagctgagcaaggagtggaagagcaaggcaagccacctcccctctttgatcacattgaacctatgatttggaggtttttgaaaagattgcaaaatatgcatgtctattgtacactaatctattaaaatcttgtaaaatttgttagatcaactccttaacttgcattatcacctaaactccacaaaagaccttaaccattattccaaatcttaggaaaaattcattgtgtcacattaagaatgatgtttgaggtcacaagtctataaaaatgcttagccatgcttagtgatgagtttacttaccgtttgggctcaattacatatatagaatgatttattttatgatctgaattaaaatgttaaaatgtgttatttgtcaaataaaatgatggaaaatatggatttttaggtttgggcctcatgtggtacacatatggtgtttagttgtgttctgatagggggagagtgtgtccagaccgacctaaggacttcacccagcgtcagttcatttcgtatacagtacaaccacatgtgctagtatgggatagcccaagcttagtaaattatttacggtttagccttacattctggtaggccggtgtgtatgagttagtcaataattctgaggaattagtcgttgattcagaggaacttcctatttaccccgacgtggtagtttaggtgactaagtctgtccaatacaacggtatagtgccacgtggtgggttcccgttgtgtccgccaccacggcgttaagtttaaggcgtgggcctgccacctaacggttctaagtcatatatcgagtatggcttaggatggaataacacatatcatactggtgtaaggctaaatcatgaatcttggaagggctttgttgtgagtaataaatcgggtacttatgtatcgcatgccatgctctttcatgattattatttcgcatcatgtgggtaaagtgtacgtactctgcagagttaaaactaatcaattagctgtgctcatggtcaagagaggcgtatgaatatgtcatgagtatagacctgtattttattcttctaaagctgaatttgaacttcaaaatgtgatctgatttatggatttttgtccttgctgccatggaaggcaataaggagctatgttctatgtggttaacatctattttgatgcccatttgctaagtgtatgcttgctgaaatttaattgaaaataaatctgaatttgaaatgttctttgcaaactaaatttgctttatgctaaaattatcccatgtaagctttactttgaatatgccatgcatgtagagtactaggcttgcttggtgcttgccattacaatttatttgtactgactcttgcttgtattgttgtattgttgcatgtttagatttggttgcagctgagatcactcctgaggaggatgatttcaatggggatgtctctttcttccaggatggttcttactagggtctaccctagtcggttgtatgaaaagtcttttgggtagaaaatgcttccacaaacctaacttttcggccaatcggccatatgtatctaagttataagttgtatgaacctaactaaaacttagaacttagaactctctatgttgagatatcatgtgcttggataaaagtgtttagtgtgttccttttgttagggacatattaaacatgagtatgagttaaagatatttgagatgtcgtagatctttagccatttttgtcaagtctcctgaatgtgtaacacatctggtcgccgtcttcgagtggtttgacaggcacatctcaggctgaagttgactggctggctaaaggcccagcaatgtctcacatatctttctcttggagcgtcgaatgtcttaatatgtttgatggaagaattgtgtttagctattcatccttcaaatatacaaaggggttcggagtgcttccgacagctgagggagaggaagggagggggattgggccgagcccaaaggagggaggacttgggccaaaaatggcccaaggcaaaggagaaggattttaatttgtttttctttttatttaattaattaatttaactttgtgactttaaaattatttcttgagctcctaaaattcacggaaaaatcctgagagtattttagggcacaaagaatattacaaaatattctcggccaatgatttttaaaggaaattttaatttcctctataatttcacttgattaaattgatttattttttatttaatttctagaaaatgcattatttaatggtttttaattccgaacgaaaatcagggcgttacagtttgtagctcagtctgggaatgaacaaaaggacacggatagggatggatgaagtcaggttcgatggatatctctagggcaaatgaaggctacacgggcggttgtctggtagtcgagatgtcatggcataggacaggcattgggaggtcactcccgagggatgttctgatgctaggggctcaaccatagcctacctgtcccgggttttccggccgtaggcgggcgttgggtcagtattcttgttcatggataggatgggttaggaactatgtcacatttttatgatgggttccaaggccatggaatgcggcgcaaagatgtgtcttctgggtaaagatatacacctctgatcaaagtataatccattctaatagccgcgcgctcggttatgggcaaacctagcaatgtacccaagttagtggtttcacacttaaaaattggttaatcaactaaaacctggaatagttggcctgggttcgcttgggacgggctgggacctggtttaggttgccagttcggtccaactcatcgtaaaccttgggttgaggcaggtttatgtgggttcacggccttaattaataatactgtttagctctagaatcgtgtttgcaaaatagctttaggcaactaagtcacttttaaatgctgtttaccgcaaaacctagccctatattattactcctttgtaaccccttgcattaatcatgcatgtcccgatgtgtcttgctgagtagtgtggttgaactcattcttgctcaatctttcctcccttcagtaagagaagctttggagaagtcctaggtggagtcttggcttataccccagttgagcgcctttgaagatggagccgtaggcccgctagtccactgctatttatttttggttgtcaggcctgaagtgcctttgtaataatgtaaatattatcattataataaagatgtgtcttttgtatcatgattgttgaagttaccttggcttttcctgggacagggatcaatgcactagtgttcaggagaggcatatttcccgggagcgacatgaggggataactctcgctttgatcgagtgcgacgtttacgatatggcaaccaaccagaacaagtccaggacgccatgtaatcgctacactataaacgatgtcgtatcaaccgtgacgcgctgttgatgatccctgtaatgcaaatgagagaacactgcaagaacaagataagatgcaatctaaatattatgaataggtgattaagaacaaagaaatagttacgattgaagtggtagatctaatcgacccgactaatcaacacaccaactattgggggctctgaatatatagtcaccaactaatcgagcgaggactagggacaagctgaatggcacttagcaaaattcaactaaacaaaagccaaatgtttttgagggtgtacaaaactatttatagaggaaaatgtatctacggttaagtgctaattcgtggaggtggagggagacacttccaacatggccctattctattacaaggcccaaggcccaagttcggtttcagcaatagcattgtcttgttttggcgattcccgttgactcgagataaatttagatatgagattagatgagattgaaaagtgacgaaataagctttccatcaagtccaagttcaccaaaatcagagttggcatgaaggcgctaggtcagtttgaattcagtgctctctctagaggccgaactggattccaaaactcattggacttgaatatcctatagatcctccattcatccgatgtattctttggcaatgttttatatttatcatgcttggttttatgtctatacttgacggtcacatcatctgctctgccctgagaatgaataggtaggcatttcattctttactggtatctttgatgaccgccgtgatacaatcagtccatggtctgatgctagtgaaatggtcaattaagcctagagggtgatgaataggctaattcaaaaactcaagtaaatgcggaagcaggaatttttagaatttccgaaaataacagagtatgcacaatacaaagaaaattctagagctagctgcctacaacaaagaaatactagcacaaacagcaactagacctatagcggcaccaaacaagcaaaaagtagaggagtgagaaaagggatatcaccaaagatgttgcaagatgagatgttcacggagtttgaataattgagaggattctactctcctttgaagctcacaaagagtcaggtcttcgctaaacctttcctcaagaggttgcacaaagcactgctccttccattagtggtatttctttcctttcggaggtgagatccgaccttcacaaacttctcccggccaaccacatattgatcggtgccttgagagtaatacctagccgtttaggagtcctcaaccttcaagagtaacaaatgatgccaagatctcctggagatgaagcaagtgctcacaaatgttcatgaagccaacaacaggcgttacacaaacttggaatccacaactgtcacacatacaccaaatccgaatcaaaccacaggtggagaggggaaacaagaaagcaagggtcaaaagtgaatctccagatgaacaagccaagggccgaaaatatccgatcagaccagcaacccacacaagtagagagagtgggttattatataccacagctctagatctacccgttatgcacaataattacaatttccgtaattccaaaaattaatttcggacatatcaaaaaatttccagaacaacaaaatagtaaagtcaactgatgtttttcggagattccgaaaacttttcggacaagttcga

SEQ ID NO: 73641 - DNA, 25023 bp, Oryza sativa
cgctgaggtaagtcctcaccagctagatcccttttcctcgcatgaaattgatttctccttttctcctcatgttttctgcttcccaattcctttagatttgttgcacctttccaacctagtcgcgattcctagcctttcacacaaaaaccactattttcttggcctaatcgacaatctcgaccacactgatttcatcatcggtgaaaccaaccggatcccctttagactagccaaccctaacctgggtcactggaagaataccttcaagtcttggccatctctcgaaaaacctactcctgataagagctggaccacctggtaccaacgcgtatcggctagtaagaaagttcactgcgatgaaattggaatcggccaagcacttgctctcaccatagccaattctgctaaggatgaacctttgatggctgccgccacctacttttggtccaacaccatcaatgctttcttattcaaccaagggccgatgactccaactttaatcgacatcaccatgattaccggattagatgtaacttcatcggctaaccctatgagtatgaacaccaagaaccaatttgacttcaagaccaaaagcataggtggctggtctggctatgtggcggcatatatgggccaagggtctgttacccctcgagagcatgtagctttcttgctcatggctggaaaagttcctcttcagtggatccagttgtggccctacaaccaactggcaatttgtagccgaagccttagaatcaaagaaagaatttcctttgggcaaaatccttctcggctatctgtaccagatgttgaacaatgcattggctaaaatagccgttggctcaatagttggagcaggtggaccatggtggctgctgcaaacttggttaaacctgatagtcatgaaggttgtcaatcggccctctgtgacagaagctgaattcccattgccagagccgattgtggaagatgacggagaagagcgcacccatcgcagatgcatgtcatatggagaatatgcatccacaccaaccgatgctggagcgaagctatcggctgagctactcaaggactggttctgcagcttctacgaaggttttaagaaagatgcacaaatctggtttccttatgaagactcagcagaccttgaacttccatcagactttagatttgaagacattaatcatgaaaaattccaaaaatccagagaaattcttatagctgcaatcagcccatgcatcctccctgtcggcattcaccaagggagaaacatccaagtctcatacgagttttatcacctaatgagctcggccagacaacttggattgggccaactcccaatcggcttattctttgccgacaagattcagtgcccaggacaaatcacatccactctaatgatggatcggctacttaacctactaggaccccctttgggcagcattaataatattgagttggcaggatttagaagcaaaaagtttgacagatggtggggtgaatggaagctgcatctatttcatcaatcgacttcaatgtatatgacagatctattccctgacgtcataccccaggtaaactttgtcattactaaattgcataaccagttagccgattcattacttgactaatctcttgctcctgttttgcagacaacagagtcctcccctcctcatcaaagtaacagtggcaagaacattgaatatgcttcaggtctaattccgaatggaggtggactatctcccccttttatcggctaccatgcccccaagacttcaactctccttcatggcctaactagggaaccagccgatgcaggcaagaaaaggaaaaccagatcatcaaccatgagtaccttagccttggctccaaagaaaaaaaccaaattcaagaaaactcaaccacaaccaactgatatgccgactgatgatctacctgccttggatccatctattgaacaagctttagatgaagaggaaattggtgaagatgttgaccaagctatagccgaaatgagtgacacagaaagaacaccatcggcttcacccaagcaaacgcctccaactccttctgcccccgttcattttacaagagtaagtacctctctctgacttcttctgaaattacctccctcttcggctaattacccatagactttgtagttgcagaagaagaaaactgctgtgaagaaaaaaccagcagcaacaattgttaaatcggctccaccagtaagatgtccttaattcttttacttaatcaatctcaaccgattctatataacacttgtctatttcgcagcctcctcctccttctcctcctgtacagcaatcatcaagtgatcagactccatcggctgtggggagtcatcacgtcgaagaggaagaacaaccagctgctcctgctatcccagtaagtttccctttgtctccacaattagattggctataatttacccagctcttattctttccgaaattgtctctgcatgctctagccgatctcttctcttttgacatcagagattaccttgatgaggcagaagaagacacttcaagcaaagccctagctcccctatccgatgatgtgagaaaaacacttgaagacatctctcatcggctagaagcctcttctttagacagtttggtagttgactgtgggtcaattaggacacagatgcatgaagttcaatctctgattcccgaagatttggctgatgtcctaactccagccgcttatctcgagcaacatcagttcaagctggaaaaagccaagctaagactagccgaacgccgtgagcgcaaagagattgaggccacaatccaagctaatcggcagcttgtgcatgaagaaaaaaccaaacttgatcagctatctgaaggtccgatcaaatccaatattgatcggctcgaagctcgcaagattgagctcttggcgcaacttgaagaatgcaatgccgagctagatatggaacacaaaaagctagccgatctcccaaaattaattgaagaacaaaaagcaaggctcaaatcggctatcaagaatgttgctgacctaaccaagtccctgaaagtcatctctggaactgatgctcaagatgtccaaactattgaagaagtagaacaaattaggcaaagggctattttggctatccagcgatacttgtctcaataacttttgtgtaataggactcagaaattttttgtaatcagctaagatgctctagtactttactgtcttgataatcctttgtgccgattaattatgactttgaaattcgctcaaaaaatttgcattgcattttgatatatatgtgcccccctaattttacaatgacaaaagcattgataaaattataaaacaattaagggcgatataacaatatcggccattgtacctcggcaaaccacaaccgattacaccatgaaaaacaactatgggcgatataaccatatcggccattgtacatcgacaaaccacaaccgattacaccatgaaaaacaactaagggcgatataaccatatcggccatctcaaggcgatgcaaacacatcggctgtcatgcatcggcaatactagccgatcatgcgttaacccaaacacttgggtaatatttcttcaaatacttgccattgagcgctcgcccatagacttcaccatcaagcccttgcaacagatatgctcccttagacacaaccttataaatttggaatggtccttcccaattcggcgaccacttgccgaatttactatcacgagtaccaatcggcaaaatcaatttccatacatgttctccttccgaaaaatctttaggtaccactttcttattataatccgagcaatacgttccttatccttggtaacctttgcaagggctcgcaatcgtgactgaaccagatcctccctctcatcggccataaggttgtaatactcatcagctattaaatcgttttgtaattctgttcttcgagagccgattctaacctcccatggcaaaacagcctcatgcccataaacaagtttgtaaggagggacttggatcgatccatgacaagccatcctataagaccacaacgcttcggccaaccgagtatgccattgccgaggataatcagaaattttccgattaatcaatttgatcaaacttttattagacgcctctgcttgcccattatcttgtgcataataaggtgaagaattcaataatttgatacccatgctatcggcaaactgaacaaattcgtcagacacgaagattgacccctgatcagttgtaatcgtttgaggaataccaaatcggtagattatatattcttgaacgaattgaattgcatccccataatcaactttcttcaaaggaatcacctccacccacttggtgaaataatcagtcgccaccaatataaacttatgtcctttactcgatggtgggtttatcataccgatcatatcaattctccaacctctgaatggccatggcttaataataggattcatagccgatgccggagctcgttgaattgccccaaacttctgacaatcttgacactccctataatatgtgaaacaatcctccagcattgtcggccaaaaataccctgcacaccgaagtaaccacttcatcttatgagccgattgatgagtaccacaaattcctttatgaacttcgccgattgcaactttagcctgatcggcactcaaacatttaagtaacactccatcaatcgtccgataataaagctcatcatccaacagagtatactttaatatacttatatatcaattttctagaagccgattaagatggattatgcaaatactgatgcacatcatacctccaatcatcggctgtcattgctgcaatttcaaccttaacatctttgatcatcggcttataccccgatgccccttgggccaaatcattagcttcaatattttgttctcgagagacatgctttaaagtaaccagccgaaactccttcattagttcttggcacttctcattataaaccatcaatgtatcattcttgcattcatactctcctaccaattgactgattactagcaaagaatcccccatgatttcaatggtatcgacttcaacttccttgagtaattgcaaccctttgagcactgcctcatactcagcttgattattagtcgcatacggtttaatagtataagcaaactcgaaacatgcccccctaggggaaattataactaggctgataccacaaccatgagtacacaccgatccatcaaagaataaagtccatggcattatttcaaccgagccgattgaatcatcacgatgttccacaataaaatcagctatagcctgtcccttaatcgccttcggcgactcatactgaagatcaaacttggttaaggaaaatatccactttccaacccttcctttcaatattggagccgatagcatgtacttgacaacgtcggccttgcatataacagtacactcgttggactgtagataatgcctcaaccttgtacacgaaaaatatagacacaagcataacttctccacaggggaatatctagtttcagcatccaagagccgatgactgagatagaatacaactcattccttcccttccaactcctgaatcaagactgagctgattgacttctcaccggccgataaatataacctaaacggtattcctttctgtggaggaataaaaacatgaggagagctaagatattccttaatattatccaaagccttttgctgctctgcccccaagtaaactgctgaacggctttcaatctcaacaatagtgtaaaaggttctaaccttccagacaaattagaaataaaccttctaacaaaatttatcttgccgatcatctcttgtaattctgtcttattctccggagactgaatcttcttgatcgcattaacactcctttgagttacctcgatccccctctcatgaacaagaaatcccaaaaactggccagccgatacaccaaaagcacattttgttggattcatcttcagtccatattttctggttctctcgaaaaccttcctcaaatcagctatatggtcctctatttctttagacttaacaaccacatcatcaatgtagacttcaaccaaccagccgattagatcatgatatatgtaattcatggctctttgatatgtagctccagcacttttcaagccgaaagtcatgaaaacccattcaaataagccgattgcaccaggacacctaaaagctatcttatgaatgtcttcttcggccataaaaatttgattgtatcctgcgtttccgtccataaaactcaaaatcttatgtcccgaagcagcatcaactagttgatcggctactggcattgggtattcatctttcggggtggccttattcaaatttcggaaatcaatgcataccctgaccttgccgtttttcttgataacaggaactatactagaaacccactcaacatatcggcaaggacgaataaaaccagcatcatataatcttttaatctcagccttgaccggttcaagcatgtcggctttgcatctcctcggaggttgttgatgtggcctaacccctagtttgataggtagccgatgttcaacaatcgatcagctgagtccaggcatctcgtaatatttccaagtgaagcaatctctaaactcttttaagagctctatcagcttggttctaaactctggacataagttcttactaataaatgtcggccttggccgatcgcctagacctatgtctacttcttccaaatcatcggccgacatgaaaccttgaccttgcttgtcatcgagatcatctaccgtgtccttagtgtagacatttgaaccctccacgacgccctcaaaataatagcttgggttctccatcttcaattggctgtatatcagaatcggacacttttagaaaatctccatcccagacttttccagataaacaatcaaggccatccatctcccaaagagctaaatcggcactggcaacattaactgacctgtcggctggcacgatctctatgttgtcgccttgccactgaatcaaacattgatgcatagttgaaggaatgcaagaattggcatgaatccaatcccttccaagcaacaagctgtaagaacctttcccatcgatgataaaaaacgtggtaggaatagtcttactgccgactgtcaactccacatttagaacacctttggtttctgatggattgccaccaaaatctttgagcaccatgtttgtcttgatgagatcctcggcatttctacccaacttcctgaacgtagcatagggcatcaaatttaccgcggccccaccatcaaccatcttttagacatcggcttcccattcacgtagccgtttatatacaatggtttaagatgccgattctctgtcccctcgggtttctcgaacactgcctattctggtgacaaccaacttagccgattcctcctccacctcgtcgacatcggcgtgatcgatcccgaattctgctggcagggtaaagaccatgttaaccggtgccgtcacaacactcttcccttttgccaacctctttgcctcatcggctgcaacatcatcagctacaggaacctgattcttaacacgccactcctgccttggctttgctttcttcagccgatgatttatttcttgttcaacctcctgaaggcgctccctgttactcaatctttgaacccttctcttctgattcttcttgaaaataccagaaggacaccattgattcttcctgattacattgtcctcttggccatgatcttgatttactggacccaatctttgatgaacagaaactcttgtctgccttagccgattacccctattatatgatcggcttgagttctcgacgatgtcactacacccagggcagttttcaatagatggcaacctcataccttcattccagtagaatctaaagaactcacatccccaataaggattaaaaccatcatcgtatttctcatgatgcttctcttgctgcttgtcatacttcttctgatatttgttgataatcttagccgaattcacctgaaaaccccttgcacgggccctatcggctgtctggctagctgtatgcaccatattaacaggaaaaaggttaccatcgaccttcatcggctttttggaatcatcaaacctaatcttgcctccctcaatggccacctgaatctgctgtctaaaaaccttgcaatcgttagtagaatggaacccagaattatgccatttgcaatacctctttttgcctaattcctcagccgatgggattgtatgaccagtaggaagttgaatttgcttctctcggagtagcaaatcaaagatcttgtcagctttagtaatatcaaagtcatacttctcctcttttccagaactttttacccattggcacggtatgacctttttactcctcacccactcggctgcagctatttcagaatcgtccttatcatcatccgacccatacatgtacggataagcatgattaaccttcttagagtttttcctaacttccgcggacctatgttcatgcaaggttactttctgtatcagatgtgacaagctatcaaagtcttcagacgagaatttctccctaatcggagcaatcataccctgaaaggccagatcggctaactgggcatcagttaaactcaagctaaagcatttgttcctcatctccctgaatctctgaatatactcgtgcacaggttcatcatgccgctgcttaattgctatcaagtcagataatttcatctcatgaaccccactatagaaatagctgtggaattgcttctccaaatcggcccagctattgatcgacccatacggcaaagaggaaaaccaagtaaaagccgatccagacaaagataaccggaataacctaaccttcagagcgtctacaaccgatgcttcaccacactgagctaagaatcggctaatgtgctcataagttgacacaccatcttgtcccgaaaatttggagaagtccggaactttgaaccgattgggaagaggaactctctcaaaccactcagggtaaggctgtcgatacaagcttccagtctcttttggtttaaacccaaactattccctcattacgtcagcaatcacattggcccacagtcgttgctgagctaccccttgtgactattgctgcatgggctcgaactgaccgtattgaggcgcaaactgaggttgagccaatccccctggctgatattgggcttgcggggaaggaggctgatattgataattcaagttacccccttggtaattatgaaggttcggctggatattacgtaccaaatgctcaggaacaacttgaggtattactgtgccatctgactgtacatggtgaaccaagtgttctgggacaacttgatttaaaaattgttgtacaggctgaccaccaggcgttgcaaacccggccgatgcgcctaatgaaccttggtgctggatcggctgaacgatttgttgtcttaacggcgtctgctgaatcggctggagaggctgctgcattggtggtgtttgctgaactggttgcatgacctgttgctggattagttgcacaacctgctgaattgggggtgtctgctgaatcggctgctgctgtattggatcaacaataggttgaggcggcagaaacgtggcagcaacctgatcttgggtcagccgattcgcaacctgcccgccatgctgtggctgctctctcattaacaaccgagggttcactggctggtctggtgccattgctgacagaacaggcaggggagttgacgccagtgctgtcggctgagatgttggtgcaacggagggaaccgcctaagttgatggttgaacatcggtaatcaaagaccgataatttgggaagacatctccttgcaaataaaccgggctgcagcctgatgctcagctattgaaccatcggctatggacttcaccatgtttgataaggtattgactaacaccccagattgattgatcaaagcatgatgcacagcgtagtcaacccgatcttggaaattactgaaaaaatcttgtgccgcatcactattctgattaatatttcctccttgcaacccctgggcaccatcaccttgaactccatgcaccccgtcaccttgcactccatggactccttgagaattgtcaccttgatttcctagagagctatcggtagcacttttgttactcagctgagccgagccgtctggagcttatttcccatctccatccttagaagaactggtccccggatcatcagcaaccacttttattttgtacttctgaacaaatgtccccttgcgggtttgcatgaatgagttcaagaactgatcccgtgcttgctgcaacattgcttcaaactctttcttctgcttaggtgtgaatttttctggattgatcggcacgacgtttccttcattgacgtcagtcaaccctaatttcagcatcttttccttaacagagcctgggctagctagggatggtggtagtggttgtttctcggccatgaggaagaattgttggctgacttcttaaaggtcccaccgggcatgccaaaagcgtgttgacagaaaacacgaggcctaggagatctgcttaactccagtgcaggtccaaagctcgccttcgaatgtatgagcgtgccagttgatttgatcctgtaatcaacaagaaatagaagcaaagaaaccgcagttaaatatataaatgatagccgatcggctaggtgccgatgacacatcatttatctggcagccgatgtcatatatgaatcgatcggcggttgtaaataggcaataaagaactaaatctattcgatcggctgtaaatattaacaatatatagttcctataccgatatatacttaaatcaagtgactgggatagatcggtcgccatgccgagacagtatgaatcacttagatcaaaatatatattgataacagccttatatatcttaatagcatagctgatcagatagatctagcatgtatcggctaatactccgatactactctatatcaggatactaaaacaagtaaaatatatcaaacaagagcctaatatacttaaatgcagtaagatcttgacataaagggcagatttaatgtatcattgaagcatatagagcaaatacgattaaatcaggtaagatcggctgaaactccgacgctactctaatcggcgaccagagggcaggctagaaattgatattctaagcatgactttatagatcaaactcaactgatgtagcattaagtatgaaaataagaacaatatctagacaatcaagccgctggaagtttcatagagtagtagatatcttatataatctaggtcaacgtcgctatttaaacaaatcggctgccttctgttaacagatgttagccgattgtaggttagatgacgatattgtcgaagattatgtaagatatatgataacttgacgaattacatagacaagattagagtatcataaagatggaagcactaatcccgagaacataattcatcataacaagttttacctcttggtgaaaatcgaaaccgatgcagctcaacccgaaagcaagaactcgtcgaaataaaactaaagcaaaaagggtagcgatgtgtcacgcccagaaattcacaagtaatttccgaactaatttgtgcattaaaaccctcgtccaggaatcagccgaggtacacaaactgacaatttaatatacagattcatcaaaataactaaaatgataaatacttacataagaggcacttagtcctcaccatgaagaaaactgcagcggaaaataaaatctagcgaagcttcagctccactcccacaggcagctcaactgggatctaaaccaaaggtcttctccttctggatccttttcttcaactgaggtttgatgattattgcaaggtgagtacatggaatactccgcaagccacacagcaagtatgcaagtgcacatggataccaaaggatggcataatatagggttcatttgcaaaagcagcatttagcaaagagttaagagtagtaaaacagtacactaattaatcatcaatattaatcaacactgaacagcacacccatgctgctcaggcccaaccaaacctgaacaaccaaccccggtcgtacagatcaaacctccaaaccaggagtcaaattaattatcacattattatcattaataagtagtctggaactaatcacgaaaaacattgttagacccgcctataaccgcgggcacagctattcgaatagttttactctggccagagatgtaccaatgtacccacaagacacgattccacacatgttaccatgccccgaagtaccaccacggcactgcaaagggggaaatcgtgacagtaccctttgcacaacacaactcaccacagtgcaccattcctggatcataatctccaactcaaaaccagagacaatggactccccagcgacccccacggacttctcgccgcttcatagtctgacaccccgtaatgaatcatgctatacaaaagataaagccgttgcccacgctggcttgtggttggcatggttaatgtttcacaacagtagctcgcgaaccggtccttaattatcatgagcacgaccctcaaaaccatgtgctcacaacccaccattaatcatattttaattatcaattaattatcataacacgattgaccatcgtgagctaccattaaatataaccataagtaatagtgaagcataatttatctcattaatgagctaatgtttctaagcacggctaagcaactataaataacatctaactgaatcaatccaatatataaggtccatgctagtcaaattataacccataggaaaataaagtcatcttcggccagaattaaatgggaaaggctcaccacccaatgacattcgaaaataatgcataagttgaaataaaatattagctttaaacgggttcaacatgtacaaagggttgtttgggatctgtgtgacttgccttgagcttccgcaaacgcttctgaaccttcctcaacgtaaacgctctcctccagaacgtcggaaactaaagtaaatgaacaaaatcaacaaaacagtacaaaacaagcataaacagtacatgtggatacttttaacatgtaaatctcgattttagatgaatttagcaactttaaccactcgaatccgagttacgatgattttgttatgaatttccgaagtttaatcgattttcagctaacagagaaaactaaaaaaagatttatgacgtcatcgctgacatcatcgccggccatggcacggctccacgcgaccaccggcaaaagggagctcggttggactatccgaggacacctacgcgaagaggacgacgacgcgaactcaccggtgcaagaaataatgacggacgacgacgtatagcggccggcaacgagctccgacaacggcgcggctcggctcgacggcggcggtggcgctccggcagcttgcgacggcggctaaggggcggccgaggtactcctcctccgtgcacacccgacggcggcgacgggaagcggcgacgacggctacagttgcggcgcggcgcggctggaaggcgtcggcgacgtcggcggctagggctacgcggcggcggcgctacggacgatggctcggcttgggacttgaggcaaacggaagaggacggctaggggatgctatttatagccggaagagggagagatcggctcgggaacggatggaatcggcgacggattagtttgggttcgccggaaaataggaactcaaaaccgcgtcgaatccacacgatataccacgagactcaagggggtttcttggggataagatagaggagatcgagaggaatccattcccacaactaatttggaaagaggagcaacggagaggacgaatttggtggggaggcggcgctgtacacgggcacggcagggaggagatcgaccggctggaggttaggggcgacactgtagtagagggagacaagacagacttcttgccgggcttcatttcctcggcccaatgaaggagggaagcaaatagaacttcggcagagagaggaagagaggatgcaggctcgggttgggccggcggaagagagaggaagaaagcgaatgggccggattcggcccgagacaaagaagaggattttaattgactttttaatttaaataattgctgaaataatgttccatttattaaaaatacttccaatgctcaaataaatccaagaaaaattctgaaaatacttgggcacacaaagtatttgatgaaattttatctagctcatgtttaagttcaaatttttcatagattttattcacacactttctttaattattaaataatttctaaaaaattcctttttcacaatgatttataatttagcgatttttagggtgtgacacgatgcgccgagattgtattaaacgtgtgtgttaaaagttacatagggctcgggtctatttatacccgagaattacaagatatatccataacggacacgactactatctctaacaaactctaagataccataagtctttgcggcagatttttgcccaaacatatatctaaggtaattacataaaacatcctaattactagatacaattgccttctcaggactctatccatgtgcggcaatcaccttgaagcgcctcaattcaacccgatatcatacatcaagttgcatcgtcggaatcggctgcatcggcttacctagcccgactcagacccagccgatcctactcgtagccgatctggactccagccgattcctactctgtttccaaactcgatctccgcctccgactttgcttcgatctaatcttctttcccgatgccaatattaccaaatttggttgctaacacatctgtgttgacgaaaaaaaaatcgaacacacatcggatgatataaaggcaatcggctgatgatgatgcaataaaataacaatataatccagtataaaccaatcggctagcaatgatatgataaataagcatcgatccgaaggttaaagcacacatcggctggaggtccggtgtcatgaaatccacaagattagattaaacagtgaaacctttgttgtcatcggcgaaatgcaacttatatgtatgtgcaatccttatgagccgatgcaacgtccagataactcaccggctgaaacctcgatgaaacccttgttgtcaatcaagaagcaggctagagattatggttctaagcacgacttagtagatcaaacttaactgatgcagcactaagtatgaaaagaaacataatatctagacaatcaagccgttgactgagttttagggtggtagatgtctgagctaatctaatctagcaacgcgatttagccgatatcggcagaaaccctaaaacgagaagcagccgatatagctaaattgatatgctaggactagattaatagagacatatgataaataggtaggcaaatatatcatccaaactagagcaatccaagaggtcgaatgtactgatgcagccttgaacgacgccgatgtagatgagacaattgcctgggccgacggaacattggacttatcccttcgccggagatcgaagacgacgcagccccgcgtcgggtgccaagttccgccggaacgtaaaaaacaaaagtagaagtaaaaaaggtggcgatgtgccgaattgtattgatcgtagagataaattacatagacatcgggtgtacatatttatacccatgggttgatacaagtccttgtcggacaagaaagaaactaacctaaagataaaagaaaaatataaagtccttatcggacactaaacatactttcctaaagataaaaggaaactaacaaactattcctaattaatagataaactgccatgccacatcctttttaaactcggtcacttagggataagcttcctttagtagattgatttccttaaccaaatatagcaggaatccgactattggtgacttgataactcccatcggctgattccgagatgctgtagccgataatgattctaagccgatgacgtctttaccaattacaaaatttcactgttaacaacgacatctaaagattacggtatttgttagtagacatcgtaaaaacgagattttgcttttagtatcccagaaacttggtaattagctactggacattaccagcaacaaaataatatatacagccaggagaggagagacatgttgtgtgaaatgtcatttatacccttttcttcttgtaccattatcttcaagttcctcttctgttcttccactgagcatcaagcagtactccacggccctcttccaggaaattgtcaaacattctcggtgagcatcggccaccacacacacgcgacgagctgtaccttatctctccctagctagctggccatagcaagagccgtaaactaccttgctgttgcagtgttgcttgccatagagagcctctactatacaagagcttcatcatcaagaaccgccgccgacgctactgcttctccagctccgaccgtgccgacgccgacgccgactccaccgccttctcctccactcccgcctcacgtgccctgctgcaagaacgtcggggagatcggacaccgatggtgatgacgagacaatgttgttggcgacgaacatcaccgtccgggtgcgggtacatcaccgtcgtgttctgccggacgggtcggccgcgttgagcactagctgccgcgccgggagggagttgttgtgtcgccgccattgtcccatatcactggaatggaaggatgaaagagaaggggatggttatttggggattttgactggttgactgattttgagtgaaaaaatgactgacagtcacccaccgcccaccggggaaaccgaaataggggtgcgtttagttcacgctaaaatagaaagtctggttgaaattaaaacgatgtgacagaaaacttgaaagtttatgtgtataggaaaattttgatgtgatggaaaagttgaaagtttgaagaaaaaatttagaactaaactcggcctagactagggtattttggttttttcaaaatgattctctctccgaataggcaagaaataataaaataatcgatgcaatgtatagcaacaaattactacaatgtttccaggatgtccaaaagcaaaaccttgtttttatcatatctagcagcaaagaccataatatttaaatgtcatttagcaaattttgtcttttaagtacattcatgccattgttttttgtgcgggacgatatttactatagatatctcaaatagagcgagtagaatggctgaggctaggccggcgagcagtggcaaatacataactaaacttaaagttaaagaacggttagtgggatccaaaagttgaataaaactatatatcaaaataaaaactagtttacccctttatccaaaattagatatgaacaagatagtggagttaaaacttgtctttgtaatatatttgaggatatccgcttcctatttcaacgatcttgctatgagtagggtttacaaaaccgtgcattatcccagttatcacgtacggtaaacttagtttttaaaaccactatgaacccgtgttaaccacatggttttcacggtaacatgttgttatcgcgataaccgtcttatcatcgggtgatggtacacccatccaaaacgccttggtgaaccccggctatgagccaggctgaggcttgctaggagagcttctcacgttagagccacacaatcaccaatgcaggtcagggcttcctcgatgaaacaaacatgtgaagaacagcgaaacaaaagacaagtaggaatcattaagtgatagccttggcccttgaccgagtacgtaactactagctaggtgactgtccatatatgcaagaatgcatgaccacctagcaaatatatgcaagaatgcatgaccacctagcaaattaaacgcggttggctcggaagaattgcatgatgatccattcttgcggagtgctataaattgaatggtatagatagatgaaaacaaaataagagttatatggttagcactttaaaattatggtatgactgttgtgagataatggagtgaaatgagataatggagtgaaacaaatcttactatagacgcagcttgtgtgccgtgcttcatatgctctcttctttaatagtcctcatttgggtattggtccgttctgtcatgtctattgaattatcgttgctccatggttggatgcctatccactacagttacacagttgttggcagtatctctttcctcgtattgtgcacagttgttgctagcacctccttcctcatatttaataggagaacattgtcataaccaaaacataaaattgatagcggttgtttcataagaccgaatgtaatctccgaattgtattatgatttatgaaatgacggcttttattttaataatatttttatttttaattttaatttttttctttgcatcttaatctttcatattttgttgaaatctatgccgcgggggttaatttgttgagttttcatgaaataaaatacttaggctattgctttattggaagaaattaaattaatgcaactgagggtacatataacatttcccctaaccctaaaaatgtggttacatgcatattaacattggtaattttcacaatggtctatagaggtagcataatgaatctaagcatttgtcttattttatttaatggtaatgtctattcatactatatgttaaattaattgtggtagatttttctacttatagtataaatcgatgatttagattgttctactaataataagactagtactagaattctagtaccagtagagatcagggtttatcttaatagtaaataccgcagtagccgtacatcccatagcggttcgttagcaaaaacaactagtaagtttcatatgatgtaaagtttgttattgttgataataatttataaaagaactaaatggttaaattacgatattcaagatcgattttacatattattctatatccatcctaaaataagtaaaacctatagtgttacttgtaaattgtcccattaataataactcattcaaatttcctctaattttacccccaactatcttcacactttcaaccacccccatttgatagggaacagctagttgattttccctcgttgttaatttatccttctactcataaaactatagttattttagaactaaggtaattttttagaatggagtaaagtgtttcgttgttttgtcgtcatcgtccatctcctctctctctgttttccttctctggagatcacatatatgttcccagatatagtgtcagtcccggtccttcattagttatttcccacacagatgatcaagtagcacatgtacgacgcgaaatataaatagatgtattttttttgtaattctacatcacatggaaatatcgatcaactatttgcattggagaaatgtataggttggataaaagaatatacgaagaacgtcaggaaacaaaattattcaacgacatgatccaaaaggtccccaagtacttgttcgaggtcggccatggcctggaggactccggcaagccgttcatctgggtggtgaaggtgtcggaggtggccacgccggaggtgcaagaatggctgtccgcgctggaggcgcgcgtggcggggcgcggcgtcgtggtccgcgggtgggcgccgcagctcgccatcctgtcgcaccgcgccgtcggtggcttcgtcacccattgtggctgtaactcgattctggaggacatcacccatggcgtgccggtcgtaacgtggccgcacatctccgaccagttcctaaacgagcggctcgccgtcgacgtgctcggcgtcggcgtgccggtcggcgccacggtgtccatgatgctgtactatatttccaattattactattatattgtggctctatattgcccattgtttgtttctttaacttcgacggatgtgaatttcataaattttgagtggcttattcttatttccaacaattttgctagttaactaattaattagtgatatatgccacataatttttaatttttaaaatagcttaaatttctgggttgtttcaagttacaagtagcactataggattttacttattttgggacaaaatttagatcgagaactgcacttattttacgactgatatatcataagacataaaatcgatcttgaatatcacaatttaaccatttatttattttataaattattatcaacaacaacaaactttagatcatatgaaactcaatagttgtttttgctaccaaaccgctataggaagcacgactgcctgtggtaactgctgttaagataaacccttatctctaccggtacttgggaagtacgactggccggtacttgggaagtacgactgcatgtggtaactgctattaagataaacccttatctctaccggtattagtagtattctaggtactggtagtattctagtactaggcttattattagtagaacaatctaaatcatcgatttatactataagtaaaaaaatctaccgacattatcattagataaaataatacaaacgcttagattcgttgtgctacccctagagaccattgtgaaaattacaagttaatatgcatgtaaccacatttttaggaataggggaaatgttatatgtataagtagaattcatgttaacatcaattgcatttgttccaatgaagcgagagcctaatattttattttaggaaaactcaacaaattaacccttgcagcatagatcttaacaaaagataaaagatttatgatgcaaagaacaaaaaaaaataaaaatcacaattaaaaatatagtaaaataaaaaccgtaatttcataaatcataatacaactcggagattaccatcggttttatggaacaaacgctatcaattatatggttttggttatggcaatgttctcctattaaatatggaagattaacaaatactatgagcggtgatggtaacaactaggcacaactaaagtgtatgcgcatccaaccatggagaaacaataacagagcaatacccagttgatagatggtgtaaggagtgttaaagaagagagtatatggaacacgacacaccggctacgtccattgtaagatttgtttcgctccactatctcacaacaattctaccttaattttaaagtgctaaccatacaaatcttgtctttgttttaattcatctaaaccattcaatttatagtactctgtaagaatgaatgacatgaaattattcatccgattcttccgagctacccacgtttaatttgttaggtggtcatgcgttctttcacatatggacagtcacctagctagtagttaccctggcaagggccaattctatcacttattggctctacttgtcttcattccactgttcttcatgtgtttgtttcatcgaggaagcatacatgcatacatcacgtgtgagtcggatgagtaacccctgaccagcaatgatgattgtgtggctctaagagcaagtttaatagtaatcatctatagttaatttaatagccaattcatacaatagttacctataaaaatatactacataattaatgtttggtcccacatgtcatacacatgtgcatcttagagtccgtgctacaactggctataaatatgtagcccggtgctcttctctctcgtcttttatctcctcgaaatatgtttatagctggcttatagtctgctattgtatcttctctaacgtgaggctctccaagcaagcctcagcctggctcatagccaggattcaccaaaccgttttggatggggttaccatcacccatggtgagacaattatcacgataacaacatggttaccgtgaaaactgtgcggttaccacgaggtttacagtgattcaaaaactaaaaagattaccgtatgtgataacagtgataatcgcatgattttgtaaaccctattcatagccagattagttaaaaagtacgatgcaaatatcctcaaagatatttgaacagactgaatttaatactaaaatttattgtctctaaattttaagggccctgtattgtcagatactctctacagatgctaatacacggccctggaaggccaagccaagcctgagttgcagcccatgcatagtaagccatttctttaatctcttgtcttttacttctattttacataattacaaattcatttttcaatctactatcttgttcatatctaattttagataaaagggtaaactagttttcattttgatggatagttttattcaacttttggatcccactaacagttcttcactttaagtttagttctgtatttgccactgctcaccggcccagccccctcagccattgtactcgccccatttaacatatctatagcatatcgtcccggccgtaccgaaaacaatgtcatggttgtacttaaaagcctgccaaaatagtggtgtgatgaaaggttattttagaagtaacattattaatagtctattgttagaatattattaaacatgtttagaaatatgtctttttattattaaatgtacaaaaaatgatggatatatagatttatgtactttttttaaccaaaggtagtgggggaggcccccacggtatattaattttccagtagtatgtacaaagaaggaaaaagataaacaatgaaggaaaaaaaacatctaagttacagctgatctatccatgattgaactaggggcctgtaacattctttgagcctaattaaatgtaagctcaaatctaacttcaagttcatcaaccagttttgcactgagggctggatgccttagaagataagtccatttctctccttacagatattccatgaggcaattaagaatagatccataaagcaagaatgcaagacagccactttttgagcctggatcctttgatgaaaatccaagttagggttccatgtccatcccagacaattccaacaagccgcactaaaaggacaaaggaagaacaggagatctctagtttctctggcattagctgagcaagagagacaaaggactgaagtattgggtggcgcgcagtgctttctatcaaggagatcccttgtattaaccctgtccatgaagaagagccattcaaagaccttaattttcatattgactttggactgtcatatccatttgatagtaggtgggggagtgagagccagaaaactgagcttgtaacagagtcgcgaagtgaatttccctgatccccaaacaaatgtccatgaatcatcaacctcctgaagggtaaaggattggagattttcttgcatgtccttatattcatcaaacgcttgctgcgaaaggggaaggaaaaattgatcttggggacctctagctaagtgttgtgcaatataatcattcctatgctttgcgaaggagtataaatggggatatttgttgatagaatcatgtactttttatttttagtacctcatcatagctggacatatgttgataattttcctacttttagcatataataataataataataataataataataataataataataataataataataataataataataataataataataataataataataataataataataataataataataataataataatataagagtagagctttttttttttgataatgagagaagattagagagatacggtaatacatagataagatagatgatgcaatagtgtcaccaaagcttctagagagaaacaaaagacatcagcggaccacctcgatggctaaaaacctttcttcatccaattaatctgctcgggctactatagctcgtgttcatgtttggcagtgttcgttgccacgtttcgatgtagcgatcatgtgtggaaaatatcatgccacgccataaatagtgatgtggttgtactcaaacgtacatcaaaattgtggtgcaaccgaaggttatttcgataaataacttaactaagcgtcaattgttagaatgttactaaatatgctgatgaaaatagaaaaataatgttggttaattgtatagcttttacttataacacagcaacccaaaaccaaaaggatgtacatagccaaacagtagctagacaaaggcaggtatgtttttcgtagttagcaataataatactccaagattagaagagatatcgagatagttataatcacaaaagcttctagaatggcgcaaaaaagaaaaaaagagctggaccgctttgatggctataaatcactctctatgctgtatccaatctcccacatcacccacactatcaaagctttttggctgccactcgcaccgctctcgtgcccaccatggcgcccacgccggactccgtttctgctacgtcaccgccgccgccgctgccaccgccgcattttgtcatcgtcccctttccggcgcaaggccacacaatccccatggtcgacctcgcgcgcctcctcgcggagcgcggcgcccgcgccagcctcgtcgtcacgcccgtgaacgccgcgcacctacgcggcgtcgccgaccacgccgcgcgcgccaagctgccgctcgagatagtggaggtgtcgttctcgccgtcggccgccgacgccggcctgccgccgggcgtcgagaacgtcgaccagatcaccgactacgcccacttccgcccgttcttcgacgtcatgcgccacctcgccgcgccgctcgaggcgtacctgcgcgcgctgccggtgccgccgagctgcgtcatctccgactggtccaacccgtggacggccggcgtggcgagccgcgtcggcgtcccgcggctgttcttccatggcccgtcgtgcttctactccctctgcgacctcaacgccgccgctcacgggctgcagcagcagggcgacgacgacaggtacgtcgtgccgggcatgccggtgcgcgtggaggtcaccaaggacacgcagccaggattcttcaactcgccaggat

SEQ ID NO: 73642 - DNA, 14280 bp, Oryza sativa
aagctgttttgatctgtctgtccgcaggttaagtgtccagaagatagcaagatatcagcactgaacattgtgctttgcagcagtctatagtggcagactagcagtgcacaagcgagatatggtactatacttttgtcctggaatggccggttgattagttgaattgattgtaattaagcgtatgtaaaatatgtgatttattatctgagattgctgttgattggttagattcaatgtaactagcactattgtaagcttatgttatctgtactgaaagctaataaatactgttacactgaaatcttatattccttggaatggccggttgattagttgaattgcatgtaattaagcgtatgtaaaacatatgatttattatctgagattactgttgattggttggattgaatgcaactggcactattgtaagcttatattatctgtaccgaatgctcataaatactgttacactgaaatcttatattcctgttcaacgaatacattccctattcgattcattgcttttgtcaaacttcttgagtcgtacacattcaatgaaaaattttctttcgttcaatgaagtgctaactctctatgattggaaagtcacaaatatcccaaaactaatcgcaagagaacagagtacagttgttaatactgatatggtactagttagttcagtggcccagtgtcctgatagcacaacattgcgctatttgaattgaaaatgagggactctagcatattatgatccttcaggtttacttaacatggatataattcttcaagattcaagatttgataacagggtccaatcagagcactttcagacttccagtgttgccatgagcaatgcttataagcgtgcacccttgttactgaattattcactgaagtgctgacatacaacagaaggcttatcatcaaatcattttagacttaatggatgacacatcatatgagccctgaaaatacagaacaaaaatcacatcctcttacttgcactgaagtttccaaatgccacctataagacgaatgccacttcaccctggcactttttttgcatcaaattacaaaacaaacatgctaacagctgaaaaacagacccgcagtttccccattattatgcaagatagtaggatatgtactgacaagtacatcttagattatatttacatgtctgtcctgaagacgaacagaatgattccttcaaaactgattcattgcaaaaatgaagtcaagtgcacttgctgcttgttgcaacagatatgagcagaagtccggtggtggtggatcctaggcaggtgaactctccagtctgcttctctggccatagtagctaaaagagtggtgctaaactattggcaagagtggaaactgttgcggttaagaaattgcctcgtacctcttgctaccagcgcacttgttccgtgtgacttccaccaagtttcatatcccattatgtattacaaactgaagtagtatttacaattgaacaaacataaaagcaaattaagagtaagcaaatcgacagaaaaacgttattactatatgaaaaagctgatcatctcaagcagaaaaaagtcatatcctcactggccattagttcgattcactgacaaaactgaggtcatcggatagctcatatagaaaatatttaagcattatagcgctttcaggttcatgtccacagtttaaaattttattgtgagaaaacaaaaaaatcctaagacttcttggttcatcagatgtccttaaatcaagaattttattgtgagaaaacaaaaaaaatcctaaaacaaaaaaatttaatgtttctcagattccccgctatttgtcaacatcaataaaaatttaagaaaaaaatgtaatatgcctgtttgagatttcttggttcgattatgaattgtaatctcacgcatataccataaaatatatgattaatgtatacagtgattaccgacaagaactacacacaatctctaggccatctcttccttgtcctcttgttcatcagatgtcctaaagtgaaattgctcaaccggtacagtgctggcagccttcactatgttacgaaaatctttctgaactctgaattctgatgagtgtgaatggtttcaaatttctaaattttgtgtcctacaggtgccttcgggcttcactctattacaaaagtatttctgaacttctctgaattctgatggctgagtatttccatttcagaacaggacgcgagtaaaatcattcagaactgtagggtagcacttcactcttgtttatcttctccgaacagccagcacggcactccaggtctgtcatgaaacggctgttttgctttgatctgagatatataattgaattctttttgggacaattccgagggtaggatagggcctaatggagccaaacggttggattcatcccttgttgcttcattacaataacccttatttaaagtgttaacagcatcatcacatttaacaagaagtaaattctattcataattttaatcttgcgcctaaaaagtagaagacaaatgattaataacagtgattactgaaaagaactccagcagcacggtctctatggcatgtcttccttgtcccctcggcagtaagatgtcctacaagtgaaattactcaaccagtacaatgcctgcagacttcacggtgttacaaaaaaattttctgaacttctctgaatcctgatgagtgatgactcctaatgttttccatttctgaactttggggtcctgacaagtgtaaaacaccagaaggatgctgacaatgttgagaaaaggaagctatttcccctaagaacatctttgacataatttcgaaactgaatgaacacacgatcaacatcaaatctacatactctattttattaaaaccatctattatactatactctgtgttgtatttttcaccatcagttacatgattttcagaagtaaacaatactcattttccatccttcagttaccccagtgtccccaggccttaggtttattcccctccaaaacttcagaagttcagcacatgtgtaaaatctttcagaatttcaggaattggcacttggaggctgcggagagcattttcagatatcagaatcatcatggccaaagaatcatgagcgataattcaatttctgctcgaatttcgaaattaatccgaacaagttccaaaatcaagtcatttgccgttaaacctgaaccattgctcgcgcgtggtggcaacgcagtctcacgctgacgtcaccgccttccatcaattcaaatcccgccgccttaccaaggggatccacgcgcaccgctctttctttcgctcctcgtctcctctcgcccacgcttccttccccccaaaaccctagaaatcctcaggcgccgcgcgcgatccagacagcaatggcggcggcggatgggctcctcccgggcctcaagttcgatcccagcgaccacgacctcgtcggaaggtacctgctccggcgcctccagggccagcccctcccgctcgacggcgtcatcctcgaggcggatcccctgagcgcgccgccgtggaagcttctcgcggatcacggccgcggcgacgaggccttcttcttcgcggaggcgcatgccaagaatgggaaggggaagcggcagaagcgcaccgttgagggcggcggattctggcaggggcagcccacgtgcgttgacggcgagaggctttgcgtccccgacgacggcgtcggcagcggcggcggcggcggcggcttgcagatcgcgtggcgcaagtacgtgctcagcttcttcgcgaacggagagaggggcaagttcggatgggtgatgcacgagtacccggtgacggcgccggatggcctcgcctcgtcccaattgcggctgtatcgcgtccgattcagcggctacggcaagaagcgcaagaggaagccccaatgtccgggagcccacggcgacgacgacggcgagctacaatgcgcgccgcccccgcgccccatggcgaagacggctctgctcgaggagcgtgggccactgccccatcccgttcttggccctgcatcggtggtggatcagtgcaccgatcagggctcatccggcgtgatcgacgattcttcgctggtgtttcgtgatcttcccgacctgattgacctgccagttgcggaggaagcagatgccagccatggtgcagagactgctctgctcaacgagcacctgccgctgccgccgccacagttgttcgttccccctactgcagtgccgctggacctcgccgatgactctaatggcgccgatcagaactcctatggcatgatgggcgacgatcagctgctgcttcctgaccttcccgggacaatcaatgacgacatgccagacctgttcgtctcccaagcagaggaagccagtgcagtgcccgcgatcagctaccactcgtcgggcttcatgggcaacgaggttgcggcattgtctgattttgagttgccggagagctattcctcatctgatgccatggacggcgaggcgctggcattgtcgaattacgagtttccagagagcttcgaggaggatctgagctgcatcgacttcgccactgccaacgcgagcagcctcggcttcccaatggacggataccccatggacgagctgttcgatgatatgcctgaccagggctcttccggcgcgatggacgattcatcggtggtgttccgtgatcttcccggcctgatcaacctgccagccgcagaggaagcagatgccatcggcgatgcagagactgctctgctcagggatctcgccgatgactctaatggcaccgatcgaaactcctatggcgtgatgggcgacgatcaggatcggctgctgcttcctgaaattcctcggagaatcgacatgcccgacttgttcgtctctcaagcagaggaagccggtctcggtggcggtgcagcgctggactcctcatcgggcgccatggacggcgaggcgctggcattgtccgactttgagtttcccgagagcgtcgaggaggtgctgagctgcatggacttcagcacggtcgacatgagcttcttggacgtccccattgacgagctgctagatgatctgcccgcagactgagactaggcgtcatggagttggcaagtgatcaacagatattgcccttgtagttgcaggaagagatttcttcagagattttcttctctagtgcagaggcgagatgttcaggagttttgtccaggaacaacttgtatttattactagttgattagctgattgaatgtaattaagcatatgcggaacatgtgatttattagttgaggtatttgttgattagttgaattcaatgtaagtaacattattgtaagtaatatcactattcaatgaatatataatccttattcaattcattgctttgtcaaactttgggtggtgtatattcaataaagttgtttcttccacatttcatgatgtggaaagacagaacagaacagaacagagtacaacattgtgctgtttgaaatgaaaacaagtatcttcatccttcaggtttaatcagcattggtataatccttcaagaatggacagcaggctccaaaaacatcattttcagatttaacatgagcaatgcttatgaccatgcaccattgttactgaattattgactgaaagtgataacatgtaacagctcatcatcagttcatcactcaacacaaaagattttttaccacagtggatgacacatgatataagctcagagaacatagaacagccatttcagataacatgagtgccactggcaccctgtcacttttcttgcatcaatttacagaacatgctagcagctgcaaaacagcgctgcagctccctaattcatgtcaagtaccaggatgtatacttacaattacatcttacattacatgaaaatgcatcctggcccgaagctacctgtctgtgagcggttgatcttcatcaccagggattggaaagtcaacattaatccagctcctcatcaaccgccaaaccgcgattgtaaaattacaggccacgaacaggtggtggcagtcctcattatctcgctggcagagtggacagacttcatcgtggggccagtttctcttcgccagattgtctgccgttaggcatcttcctttcagggctagtcacatgaaaaaacagactctcaatggtgctctggagtctggagtgcctcagcatctctccataagggcagtcctctttggccatgaagaaaagatcatatgccgaggcagccgagaattgccctatctccagtcagtttcaatctgattgcatctgcattaggctgtagagccacatcatgaacctcgtcccaaagctgaaagaagtcacccaaggcttcattgaacaaggaaccctgcaaatctcgcacccatctatgattaaccatggcctgggcgaccgacaacctggagtgtcctacataggagtacaggataggccacctccaggcgaagcaaccatttcccgtccaatttgtcgtccagtatctgttatcagctccatcaccgatgatatattcagccactgatctgaaaatgccatctacatcatctcccatccgatatgccaccatggtccagggcctctccttctgtgctcaaccgattaacagtatgattcctttgaaactgattaactgcaatctaaagcgagcagcaaaatactacactgccacaattttctaaaaactcagttgggttattgtctacaagccaactccagcaagatgtgtcacctccacttacgcaaacgggtcatatatgtcctagagtttcgacgagcctagccagcagttgttttacattgtactggggtactctccagtccagccttgtttctctactctctactatcttgccagcagcacttgtgccgagtgacttacaccaagtttgatatgaacatcttctgcaaactgaagtactatctacagaatacaattaaagaaacattaaagcagattgatggtaacaatgtaaattaaaaaaaaatattagtctctgaacaaactgagcatcttaggcagaagaagccataccctcaaaattcaattcactgataaaaatgaggttaaccttcatgggatggccatgtaattcatcttgctcacttgtggatcatggaggatgagactacaatccatttagccaaaaagtgtaaattcttcattcatacatggaaaattggttgctcatgatttggccttgatggatagattcaactggcacaatctgtccaaaaaagaaatggcattatacactgggaggggggcaatccaaggagatagaagactaatccatggatacctataattatgtcctgataaaatgtatctaagaaaatgaatcataactagttctagcaattttattactgttagttgtggcatccatttcatccaaattgtaactgagaacctctatgagtgcttctttctattcttcttaattgaataagcagaaattcttgactgtaaattttatctttggagaagattacagccatggtttccaaaatgataagttgttcagtactaacaggcatcagcagagttaattaatattgaagtaatttgaacatcaccaaattcaagtattcaacagagagaagaggatcatgtatgagataatactgaagtcaacatgagtagtgcacaatctaggaaggtaaggtcttcccatggtaaactgagatggaagggaagctaacagccagaaagctccaggatattggggtcggattgctcaacaagccatcggagaccttgtagaggcctgtgccactggagacctgcttccagtcagtgctggctcctggatcatatatgcagagcggttatacatataattccagcagtggctgtacatcgtactgggttactcaccctccaatgtacctcgcgccccttgttagcatcatttgtgccaagtgacttcgaccaagtttaatcttttcatcttttgcaaaatgaagtactacctagaaatctaaaattaaacaaacatgaaagcaaagttatctgaagaaactaaacatcacatgcagaagatgccccaccccattagtgattagtccaattcaatgataaaactgaggcactacatttatggttttccaacatcgtcaggacctgcaccaattagcatcagcagattcgttagactcgttaaagtgaggccaaattcagcagagagaaaaagatcacgcatggaggaactagtgcacaatcgagcaaggcctccatggtaataaataggggaggttaccttgctgtgacgccggggttggggggcattgctcgttcgcccacgggttccgccatggctgttcgagctccaatttctcggtcacaaatagatcgaagcgcttgtcgcccgagaccttggagacgactgcggcaatggagatccgcttccaggccgtgcccccccacgacggcgacaaagcacaccattcccgccgccgatatgtcgatgtgccgcgggtcgtggctcctcgccggaccatgctggagccctcccagcgactcagggagatcggagatggagtggtgcggcggacgacggcgcggcggccactggccggtggggagtagtccaaacagagaacagacaggctgagattctgtttatgtgggctcggcacgatttgattaggagaaagtccattattagtcatttaactataaaaaaacgtccaaatatcctctgaactttaaatgaaagcacattcagtattctaatgtttcttaaggaaacatagtacaaacatagatactcacaacacacgtacaattacccttataaatgtacacacatcataccccttacgagtatctccgaaaaactattaggccgacatattgtctcaaatctagatcctgaatctgggtgggctaggaaccagaagaaacagtatactaaattttaaaaccagacaccctaaactttataataccattcatatgacccctaaaatggttttttatctaatttgtaaaacgttaaattattagacatatatgttaaaaatcttcacttaaatacttttttttaccctatgtttgctctcacttgaaaacgaataccaactagtatgatatttttatggagcataaattaagaactaaagattgatgatatatatatatatatatatatgttatattctttattcaaaaactgtctgtttaagcatcaaaatatgcaaaaccaccgtccaaaaccatcttatgatgtaatttaaacggtattgtaaagttcatagggttggggattataagtctatttaaaagtaatataaataatagagaaaaatacaaattactcctgaacaattgcgacagtatgaattaccccaccgaaccacaaaaccagatatatcacaccctcaactattaatactggacatataacccccctcaacattgtttttgaccggttttgacttcaacttgtacacgtggcgccaacgtggcaatccagttagaaaataaataaataacccctgggcccacctgtcataaccctttatcaacccaaccccccctctctctcgccgtctcgcacacacgctaggacgaccggctgcggaggaggcgcacacgctcgggcggccggcggcagaggcggagctcgcccgggagtccggcggcggaggcggagattgcccaagtggtgggctgctgaggtggaactcgcccgggcggccggtggcggaggcggaggtgagtggtggcggaggcggtggtgagcagtggcggtgttggtgctgcgcacgatagagtactcacgctctgaggaagctggaggccctcctcgccgcgtccaccgcctgcccttcccaccgcgcccaccagccaccctcccccgccgagaccttgtctgtccagaccaccgccgacgtcgccgccttctctgcctggactgctgccgctgccttctccgccccgaccactgtcgctgcactgcaggaaaggggagggagtcggaacagaaggaaaggggaaagggatgagcggcggtcatcggcactcctatgcagctccatctcgtgcatcgccgtcgtggacacggccatcgacaccctcgccacttcgctgccctcctcacccaccacgacgccctcagcctccagtgcgactccctcagcggcgacgccgtgctcccgtcgcgccagtcgcccgctctccgccacgcccgccacccgccgcgcccatctccggccacctagtcgtcgctcccagcgacatctgaaagagacagacgttgagaggaagggaaaggggaaagagagaggtgggtcccaccatgttttatttgttttggctgacaagtgggtcccatatcttttttatttgttttgctgactagagtgccatgtatgcatccacgtaggatcaaaactgccctggatcgacctagggggtaattcatccggtttgtaaagtttagggttaaaaataaatggtattggagtttaggggggtaactcaaacgaccgcgatttttcagggggcaattcatactttttcctaaataataacatcatatagccataccatatccatctcaaatcacaggtagcaccaattaacgaatatttgagccctacgtgggtgcggctagagacacaatggcagatctggtatgtttgagggagatttagaacgaacggtgtgtacacccttcctaacccttgtgattcaaccttaaaatgctcggttgctttagagtcttctcgcttcatatcaccgtaccaaacgcccaccttgttggctgccgtcataccttactcgcttacaagagagatcgacaagagctctaagattcgaccaccaaatcaatcttctatggggaggagggggggagagtgaagatgcacttaaacccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaacatcgaaggtgattagactaggtttttctctttcgaaattgagtttaggaaaaacagtactattaagaggggtttcaagtgtggttccagggtatacaaagtgctcttagtcatatccatgagtctaaaggtttttggaactttctttttttttcttggaaatgattttcctcgggacagagagggctactcggaggttctggccggaacttccgggcaccgaagtttagctagatttttcctaagtgctaaccggaagttcctggcacttttgcccggaacctcctggcaggtttccagttcaatcttgtgagtaacggctagatgacgtcacctagccgttatatatatggatttcgtccccaggtcaccctttggccattccacttcagttctttcatgttctagggttttctagccactcccaagcttcctttgcttcctccactcaaatctatagcctatcttgggagattgagagattagattagagtgtaggagtgttttggagatggcttgaaaattatgttttgttgagcactttggatactttgtgggctgtcacttgggcttattactcttggagatcttcttctagatggttaggtgttgcccgtgagcttccaaagatcttgtggatgtccctggaaagtttgtgaaggatttcctcaccttcgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctctacggagagtaggatccgtgtgatccgaacttcgggaaaaaatcgcctttgtctctctcgtgcatgatctgtgtttgaatctgctggtatcttgtgatttacatcttgtgcaaccttgtgcctgattgtctatagctaggacctgttttgcttccccaaattttgattttctctgttgcccgaaagttcctggctcaagaactccggaagttccgggctgctcatctctgccaggaagttccggtgttcttcaccaggaggttccgggcactgttaatttaaccgctgcgattgttgagaaaatttcaggaaagcctattcaccccccctctaggctacatctctacgcgttcaattggtatcaaagcaaggtgctcttgattcaagcttcaccgctttgagcgatccacgatgttggacttagggggaaaggacggggaaattggaaatgaagatggagcgagcagcaagggaactccatctcccaagggagccactataccttttgattacaggaaacttaccattccctctcacaactttgtctccgtaccttccgggcgtgctcctcaatttgatgggacacattacgccgcttggaagcacaagatgaagttgcatctaatctctttgcatccaagtatttggaaagttgtgtgtacaggtattgacgtacctcatgaggacatggagctcacttcggagaaagaacaactcatccaccgcaatgctcaagcttccaatgcaattctctccgccttgagtccggaggaattcgacaaggttgatggactagaggaggccaaggagatatgagatactttgcaattggctcatgagggatcacccgccgttcgtgaggcaaagattgaattattggaaggaaggctaggaagatttgtgatggatgacaacgagacaccacaagagatgtatgataggatgatgatccttgtcaacaagattaaaggacttgggagtgaggacatgacaaatcactttgttgtcaagagacttctccgtgcttttggtccaagaaatcccactcttgtttcaatgatacacgaaaggaaagacttcaagaggctcaccccaagtgacattcttggaagaattgtgtctcataagatgcaagaagaggaagctcgtgaagtgagacaaatggtgaagaatgccgccatgatcaaaaatcaagaagttgctttgaaggcaaaacaagaagaagagtcaagtggtgaagaaagtgaagatgaagaaatggcttttattgtcaagagattcaagcactttcttcgcaagagtggctatggcaaagggaggaaggttgatgacaagggaaagaggcaatcaaagagagcgtgcttcaattgtggcgaatttggccatttcattgccgattgtcccaagtcaaatgaagctaaggctaagggaggcaagaagaagctggaacgtgctcatgtggcggaggcacacatggcggaagtgtggtactccggagatgaagaagatcccgaagtcaagcccaagcccaagtcaaaagacaaggttgaaggagaaggtggtgttgctactgtcaccttcaagtcatcctcttcaagcaaggagcgtctcttcaacaacttgagtgatgacgacgacgactcctaccactactcttgcttcatggcccaaggccgcaaggtgatgactcaaaagccctctcacacttctcttgatgttgagtctagtgatgaggaaagtgataatgaattagatgatgtgcttaagagctttagcaaacccgctatgcaacacttggctaagttaatgagagctttggatagtacagaacaattactcgtaagacaagaagaattgcttattcttgagaagaaaagaaatcttgccttagaggagagcttagctaaagaaagtgctaaaaataaacaactagctaatgagcttaattttgctaatggttctttagctagccttagagatgtcaatgagactcttcaagagaaatttgcttgtttagacaaaagtcataaagttcaaattgacactctttggaatagtacctctcaaccaaatgtggtttctaattcctctaacccttctactagcaatggttgtgctaggtgttacaatattgatttgaactcttatgctactaatattgtggagatgcaagctcttaagaaagagaatgaaaggttgggcacattggtgaaatatggatgcatgaagacataccattcaaaagatgccctttacaagaccatcaccgctcatcctaacaaggatggacacgg

SEQ ID NO: 73643 - DNA, 20043 bp, Oryza sativa
  unsure (1)..(20043): unsure at all n locations
gagcataatgctagaaggttctggcaagatggtctttactatgattcatatgtaattttcaaaaattcagagggcaaagtggttgcttattttaatgggaattacaatgatgaatatcgcacttgtgtgtgggtgccaaaggctttggtaactaacatcaagggacccaaacttagacaaatttgggttcctaaatcccaagcttgatttcttttgtaggcatactcctccggtggttcaagttgggttgtggacagtggttgcaccaatcatatgactggagagaggagtatgtttacaagtcttgatgaggagaacggaactcgtgagaatattgtgtttggagatgatggtaaaggaaaggtaatgagtctaggtaaaattgccatctccaataatcaatctctctctaatgttcttcttgtcaattcattaagctacaatttattatccgtttctcaattatgtaagttgggttacaattgcttgtttaccgatgaggatgtgaccgtctttagaagggatgactcctccgtagcattcaaaggcaagttaaagggtgatctctatcttgtcgatttcgatgtggatagagtgaatccggaagcttgtttgattgctaaatcctccatgggttggctatggcatcgtagactagcccatgttggaatgcggaatttggcaactcttctaaagggggaacacatcctcaggctcactaatgtcacatttgagaaagatcgtgtgtgtagtgcttgccaggccgggaaacaagttgggaatccacatcctatcaagaacatcatgactacaacacgtcctcttgagcttctacatatggatttattcgggcccatggtgtacataagtattggaggtaacaagtatgattttttcattgttgatgatttttcccgcttcacttgggtgtattttctccatgacaagagtgaggctcaagatgtcttcaagcgcttcgccaagcaagcccaaaacctctatgatctcaccatcaagagggtgcgaagcgacaatggaggagaattcaagaacactcaagtggaggaattccttgatgaagtgggaatcaagcatgagttctccgccccatatgatcctcctcaaaatggcattgttgagaggaagaaccgaactcttattgaagccgcaagatcaatgcttgatgagtacaagacttcggatattttttgggcggaggccgtgagtaccgcatgtcatgccatcaaccgcttgtacctccacaagatcttaaagaaaacttcatatgagctcttgagtggtaagaaacctaatgtttcatattttcgtgtctttgggagcaaatgctttattttgagtaagagacctcgctcatctaagttttcacctaaggtggatgagggattcttacttggctatgaatcaaatgcacatgcctatcgtgtcttcaacaaaacctccggtattgttgaagtcactagggatgtgacatttgatgaatctaatggcttccaaggagagcaagttgttgtacatgttgtaagtgacgtggatccaagtcaagctataggtactaaggctattggagacatacgaccagtcgagacgcaggatgaccaagaagacagggatcaaccttcgtcatcgacatccaatagccctaaattgagtcaagtgtcagtcgacccggaagttccgggaccagatggtcggaacctccggacctctccaggccaggaagttccgggtccatctgccaggaagttccgggcagaggacagtcaaggcgtgcctatggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctagcttttgtcaacactattcgtttgtctcttctttggaatcaaccagggttgaagatgcacttggtgatccggattgggtgatggctatgtaagaggaattgaataacttcactcgcaatcaagtatggacgttggtggagagatccaaccaaaatgtcatcggcactaagtggatcttccgcaacaagcaagatgaacatggagtggttgtaaggaacaaagcccggttagttgcgcaagggttcacccaagtcgagggtctcgattttggtgaaaccttcgcacccgttgctcgccttgagtcaattcgaatccttttagcctatgccgctcaccataatttcaggttattccaaatggatgtcaagagtgcctttctcaatggacctatctcggagttggtctttgtggagcaaccaccggggttcgaggatccaaagttgccaaatcatgtgtacaagctccacaaggcgctctacgggctcaaacaagcccctagggcttggtatgaatgtctccgagattttcttttgaaaaatggttttgaaattggaaaggcggatactactctcttcactaaaaaatttaagagtgatttattcatatgccaaatttatgtcgatgacataatatttggttctactaatgcctctttttgtgaagaatttagtagtatcatgactaaaaggttcgagatgtctatgatgggtgagttgaccttcttccttgggctacaagtgaaacaagctcaagagggtactttcatctctcaaaccaagtacgtgaaggacattctcaagaagtttgggatggaagatgccaaacccatcaagacgcccatgcctactaatggccacctagacctcgacgataatggtaaatgtgtggaccaaaaggtatatcgctccatgataggatccttgctttacttatgtgcatctcgtcccgatatcatgtttagtgtatgcatgtgtgctcgctttcaagcggagcctaaagagtgccatttgattgccgtcaagagaattctaagatatttagtccatactcctaatcttggcttgtggtatcctaagggttgtgactttgagcttttgggctattctgattcggattacgccgggtgtaaggttgatagaaaaagcacaaccgggacttgccaatttcttgggcggtcccttgtttcttggtcctccaagtagcaaaattccattgctttatccaccgccgaagccgaatatgtcgccgccggttcttgttgtgcccaactcctttggatgaaacaaaccctaaaagactttggctacaacttcaccaagatctcactcctatgtgacaatgagagtgccatcaaaatagccaataatcccgttcaacattctcgaaccaaacacatagatattcgccaccactttttgagagatcatgagaccaaaggagacatatgccttacccatgtgagaaccgagacccaattagccgacattttcaccaagcctttagatgagaaaagattttgcgagcttaggagtgagctcaatatcttagattctcgcatcattaggtgatgggtgattggctaatttatagtcaaacatatgtcactaaaatgtaaattagaaaaaaatgagcttttgtgtcttgagatcacttcttgtatagaagatggtcttgataccaggaataaagcttaaacattccccttttatccaaaaacccttttgtgaaaatttttgcaaaatcctttgtgtgccttttattgcgaaaatttgggttttatttccttcttgtgatgtattgtgaccatagttatgtaatgttatttgttggctggtcatatacatcataagtctcttcatgtccatagttcctaattttccttcgttgaattctcatcacctccttgtttttgggcctgactgccctttatctgtctggccggaagttccgggcctccctgtccagaacctccgggtgtcggggagtttttactctcagggggagttagaaaccctagtctctctcctcatttctactccctccccgacgccagccctagccgccgctacagtgcccctagtggcgatttccttttccacccgtgaaaatttgattcttcttcgtggaatcaaccacattggtggctaggaggatcttcccgcgatagttctgcgatttcctctctcaaggtagcactttttgattccctctctcggttcattgtgtttttatcccgatctctaaatctgtgaacctagggagaaaaccacttggatagtcttgtttctgctaccttgtagatcactgatctataggatttgttcacatgcactagctatttttgagaccactgttctttatttttgccggccggaagttccggtgttcttacacccggaacctccgggcgctgtccagccagccagccactcttgattctctcatttttttacctaactactgcactccaatttattgattcctgttgcagtaagcactataacttgtgagaaaagatagaaagtttctcaggatgtgtccggtgatgagagtcctcctattcgttttcctcgtggtcgtttgggaaaagagaaagtggttgaaggtggcagtggcagcggcactcgtacctctcccaggtttagaaggcaaaccagcaatcgcccagttcaaattcgagatgttgacagtggtcagggtagtgatgctccttcttcaagaggtcgtgggagaggtggtggtcgctcttctggggctggaagggcttctcatgatttccctgttgggtctcgtgagaatctcgttcggctctacaagactattggttttgacaccactcctatgcaccacattgggagacccaagtccaactaccttcatcagcttgccaagtgccgaaggggccgattgattgatccagagacacagcctgaggagtcacaggatccacgtttcagaaccttaactcagttggattggtacaactcagtgattatggctagagacaatctagtggttgagatgaagtggattgattggacttacatgaggaagaaaaacaatgaagtgttcaatcaagcaatgcaagtttgccacaacaagaatcttggggatattcttgccttggagtatgattggaatgaggaggtcattgcacagttctatgcgacagctttctttggttctacaaggaagggaactccttatgtaaaatggatgactgagggtgttaggcacaagatttccatagcacagtttgctgagatattgggcttggaggatgaggatctcaataggcctaatattcatagtgaagcacccctccccttgatcaagaccaagttcatgtatactaagaatgctcctagaacttgtatgggacctactcatggtttgcatccaaactacaaggtgttgtactccatctttcgttggtctttgcttccaaaggttggagatgccactgctttgccttccaaacatgctcatcttctcagtcgcatgcgctacaatcagcctcctttcagtgtgaagttgatttggtatgagattgccaacaccattcttgagcctaagcgaggttgcatctatgctccattcattatgaagatgattgagtcagtcaccggggtgttctacatcaaagatgggcgccacaatccttttcgtcctcgtgttccaccatcctcttcttcagtggcacctagatccatcccctctacctcggctggtccttcttctagtgctccaccgccatcctcgagctcttctcccatcaagaaggcacttcaggcaatcttctgtatgtgtgctaagactgcaaagaaagtgaagaagatagaaaggcgtcagaaggaagatagaagagaggctgggaaagaagtgtcagatgattctgaagatgaggtctatgtggatccttttgaggcttatgaggcagcccgtaatgttgccggtgaaggtccatccacctatttcaatgaagagtcttcccaatcagatgatgatgatgatgatgatgatgatgaggatgacattgacgcagctgctgagtatgttcctactgatgttgaggaagctgttgacaccgctgcacaatccgatgagtctcatctctccggcgataccgagattgttccctcagatggagatggagatgagtgatcctcttcttctcttcatggtttcttgctttttggtgccttgatgccaaagggggagaaattgtgaattgaagggggtcatttaatcattttttgctgccttgactgttgtctagtcatttggccggaagttccgggtcctgtgatccggaagttccggccaggcagattccctccctattatctatctctctatggacatgtaatcatattctctattggttggaagtaatgactgttagatgctttatcatcctttatgtcagcaagttagaccatatggatgttgcattttgatgtgatgatgtaatcttttcatctttttgagtgattgccatgtcatctagtttttcaatttgcatcactctttatttaagctctctcatctgcatcttatttgtttaaggatagtgtgaagttacctttgagctttccttcgtttttatgcatattgtatttcatctcattttattatatgcatatctttagggggagcttcatacttctctcatcattccaaatttaaattctattatctttttgtgtgctttaaccatgttgtcatcaatcaccaaaaagggggagattgaagatgcacttaaacccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaacatcgaaggtgattagactaggtttttctctttcgaaattgagtttaggaaaaaccgtactattaagaggggtttcaagtgtggttccagggtatacaaagtgctcttagtcatatccatgagtctaaaggtttttggaactttctttttttttcttggaaatgattttccccgggacagagaggcctatccggaggttctggccggaacctctggacaccaaagtttattttctccccgggacagagagggctacccggaggttctggccggaacttccgggcaccgaagtttagctagatttttcctaagtgctgcccggaagttcctggcacttttgcccggaacctcctagcaggtttccagttcaatcttgtgagtaacggctagatgacgtcacctagccattatatatatggattttgtccctaggtcaccctttggccattccacttcagttctttcatgttctagggttttctagccactcccaagcttcctttgcttcctccactcaaatctacagcctatcttatagattgagagattagattagagtgtaggagtgttttggagatggcttgaagattatgtttgtttgagcactttggatactttgtgggctgtcacttgggcttattactcttggagatcttcttctagatggttaggtgttgcccgtgagcttccaaagatcttgtggatgtcccgggaaagtttgtgaaggatttcctcaccttcgcaaggaaacgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctcaacagagagtaggatccgtgtgatccgaacttcgggaaaaaatcgcctttgtctctcttgtgcatgatctgtgtttgaatctgctggtatcttgtgatttacatcttgtgcaaccttgtgcctgattgtctatagctaggacctgttttgcttccccaaattttgattttctctgttgcccgaaagttcctggctcaagaactccggaagttccgggctgctcatctctgccaggaagtttcggtgttcttcaccaggaggttccgggcactgttaatttaaccgctgcgattgttgagaaaatttcagggaagcctattcacccccctctaggctacatctctgcgcgttcagagaggagaattaaccatgtctgatttcttcttgggctgatcttggtgccagattgatttgctggggattgttttttttggcaaaatcatgtaaggattttatgttcttttggaataattaagcatttccttgtttcatatgtgcttgtttgacatggagtttatcttaataagcatgtcaagagattgaaggttcaactagatttgtttgggattttagtagcagaacggagcttgaaagtccccctttttttttgacaaattggcccttatgaaaaacttattgcgaaactaacccgcacaaaaaacttcaaccaaaaataggtcgcgggctcagcgccaagcaccctggcgctgaggttggccacatccgcaccaaccgcttcggcgctgagctgagcactgccagtgtggcagcccagccgctcccccacacggacgtggcagcgacctcagcgctaggcccgttggcgctgagctagcggcatatatgtcgtggccgggccgccccagcccgaccctaccttttttttcccagagaagctagggttcttcgccccccgcgtcgccctctctcctcccctccaaaaataccctcaaatccacctcaaatcgaggctatttagtgggcattgctttggatattggtttgcaaggtaaatcccctccaaaaaccctaatttccccaatgtttccctcattttttagagtattttggttgaaatcgtgggttgttaaatattgctcggggtgtggtgttgattagggaatatgggtaagggtgcaacgttatagttgtatattgatgttagtatagaggattcatattgtttttgtaagttatgcactattttgctaagggtgaagttgagatggatgtgtagagccgttgtattgtgaatattttggggattcatattgattaatgttgatattgaatggcatagatcgtaggaacattgtgaccggtggttagtcgttagaatttcaaaaatcttttccttaggtctggggtacccatgtcatgtttctatttttatagtgacatatattgatttacttaaacgtcgtaggaatggctgaggattagctcgtcaagtcatcgaatttttcagaaacaccactcacctctagataattaggtatgccacgtcatttgttttttttccaaaaaacccccctgcacttcctattaattgtgcgcccgttcccgccgctatcgtctgttcgatcacgcgcgagggactatctggctgtccacgtgtcccagcgtggctgctcttccaccatcgtgagatcattggatcaggaacggatgccctggatttgccaagaaccctagccacctcagcctccttccctcgacctcgcgcggctctcttctcgctcgccccgcctcgccctcctctcctcacgcgtgtcgcctcctcactctcctctcgccgccggtgcatgttggtatttcttacgatcacagacaaaatctgcaagcgcacggatataccgatgtagcacttcccctatggagtattccaagggtatcgaatccaagggaacgtgtgtggtcagatctttctccggttcatccaaggacaccaagcaaatgataggccaggatagagaggatttactagtgagaaacagtgtctagggaaagcttaactttaatcctaatgcaatacttcaggcactggcaacccgttgttcccagatgttgctctactacgtacccggacagggaagacttaagtaatctcgagggctgtcactacctctacacccacctcaaacgtactatgggatacgcagcaattactagataacaattacctaaacaccacgtctaagcaattactatctactttagtgtttataactcaccaaagtaatcactatattttagttgattatagtgaacaataatcccgtatgctatttaggaactaaccaagagataattcccacaagataaatctaaattactcaagaagaatattatattaaattcagagtaataaacagaataaaagaaataggagaagattaccgacaactccggaattcttccgactccttctactctactctcgtcctattctagtatacaatatagtacaatagagcctcttataattcagctcaagcttggaagtaagtgatatgatgtctttatataggggtaggtatgacggttggcgaaggggaaatgtccgaagtgccccacaaccgccatcagggagtgatctgggacgtccatgccaaaccccaggatcaacggtgatcagggaggttcggccgaaccaggccgaacctaggctgggccctcctggcctggccttcggtcagtggactccctgaaccttcctctatccatttctcggaattttgggttaattcattgatgtttcgatgaagttcataactcatccttgtatggatacatatttctcctcactttagtctgattttcctcccaacttcaaggtttatcacctacatacaaatatacaccaatactatggaatatgtgagattaagcacctatcactatgttggatgttttattatccaaactttatgcaaatgttggcggtatagaatcgatatttaacagccgccaacagtgcaccgccccctctttccccagtcaggctgtctcatctgccagcgggaaggccgggggtgttgaatccggcgaccccctcctcttcgcaggcggatccggctgcccggacgaaagtgtcgtgagccaccgctatcatcttctccaccccgcttggtgtagtgccagatccgctgggaggctgtcgatccggcgcttggtctcccctcgatggatccggccgctcagtgccttggaagcgagggagcaagccactgccaccaccatcttctcctctccttctccgcacgtccaactcccctctctccctctcagcctacctcctctgctcgcgtgcgccgtcgccgccgcatctcccttctcctctaccatgctgctaccaccgcttcttctcaatgagccgccgaatctccaagaaagaaggcaagggccgccgaatccggtgaccccagtctcctcgctgncggatctggcgtcaagaaaagtacaaagtcgtcggcgccttttctcctctttcatccctgccacgccattgcctccttctccgttaacttctccaccacgatcagtgcgttgcgcgcggccatgccctgttctcttcattcctcgcgcacaccgtcaccgccgtaacatcaccgtccttctcgtccctcgcgccctcctccagcctaacatgacttggtttgccagcgcatacgagcggacaggaganatcgatataagtcacaacctaaaaaggagagaggacaactagacttatttaaaaaaaaaaaagcactacaggctgtcgtattcccgtgccttcggggtggcccagcacggcccgaccggccgacccttattgggttgcgcctgagccgtaaggggagcacgtgggctgggcccgaccgatctcgggtcgtggcggactgggcggcccattagaaaagtacagtatgcgcacgattttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttcaggaaaacccttgccgccctctgatggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatacattatatttttagggttttagttgtactaatctagaagtgcgtattgtagatatcggtaactacgtagatctgctagtttggaattaatacattaccgttgcattggcttacacaaaaagatattacgttgtagatgtttattgcatgaaagagtaatatgatctagttatttcgttgacagatatgtcgaacaaacaaatattccaagtttaccatggatgtcacgtcctgataaattcatcccgaaataaaaatcattctctaaaaggaataatagaattaattaaaattcgaaaagaaattggcaatcactaaaatacatacaagaaaaattcgaatgtggttcggagaatttttgttaaattctccgtggtctaacaagagccctcaaattttacttgaattttcagagcgccggaaataattattaagcaacaaaaacaattatcaaagtttactaaaaagaaaaactaaaaataaatcctccttcctcctttgggccaagcccagccaaagtctccctctcctccctctctttccctcctctcccaggcctctcctctccctcccggcccactcttcccctccccctctcggcccactccctcctcccactccctcctgggctgcctctccctcctctcctcctgggccggccgcccggcccaagccgcgcccaagccaggccgagccgagccagccgtgcacacgcgcgccgcgcgtgcgctgactgcgcgcccgaccgcgtggggcccacgcgccggtcgtctccttcctcccgcccggctcctctcactcccgtgaaaccctagctcgctccctcctccaaatccgcctcattcaaaccggggattcccaaattaagtgggggttttaatccccattaattcctcttcaattccccccaattttccccttgaatggcgcccccaatcgtcgggaacggacgcgtctttcccggccgccttccatggccgccggccgtgtttcccgtcgccgttccgccctctcccatgcccggcttgcttccctccgctataaaatggaaccccctccgtgcgttctctcgttttagccccttcccgagctcccccgtggccgcaccacctctccctgccttctccttctctctctccggtgccggccgggcttcagccgcctttccctcctcgcccgagcgccgtccggtcgcgccgtcaccgcccttggcctcgcagctgcctcctctccccctgtcagccctccgtttcacgcggaaatcaccggagacgtgtcctcgccggcaaaacagtggcgttgccgccactgtactgcctccagccacccctgccgcgccgctcaggtgcgggccggctgcgccgtctcctccctcggcgtcgccgcgtcgacctccaccccggcctgccctcggtttcaccggaacgccgtcgcccacgtcggtctcgccctccgcctcgccggagttcctccggcagccccgtccgccgtgcctgtgcgccggccgacgtcgccatctccacctccagcatcgcagcggcaaggtcgccctcggcctcgcctcccctccatccgaaccctgccggtgttcgttatcgtcgtctccgttcgtcctcgtcgacgactcctccggtcggtcgttcctcctcgccggctcgtcgtctcgctgcgccgcctccgttgtcggattcgcagcggcgtgttccacgccgtcctcgtcttcgtgcagccgctgtaggctgcccacgtcgcctcctcgccggccccggtcgtcgtcgtcgtcgccctctcgtcgttcccggtcatcgtggcgttcgtccctccgtcaagccgttctcgttcgtcgtcctcgcttcgtcaagtgccgcagccccatcatcgtcttcgtcctcgcctccgcgttgtcaagcctcgtgccggccgagtctcgccttcgttcaaggatcgccgccgaagtcgttccctcgccgtccgtctccgccgcgcccgttcgtcgttgtctttcccatgcctcgtcgcatggtggtaaggatctctcctctcgctgccccgtcctcgtcctttcggtgtcgcccgtgcccgttgtgcggttgtcgaccccggtacccgtgtaccggtgtcggtagtcgttcgcttgtgcgtgtggtgaccgtgttagtgtgcacgctcggtagccacgtggtttccacgtgtgcagcccatgcggtgtctagtggagtccgtttgtcggccactcgcctcggttcacacgcgggatccgcttccgtcgacccgtggactgtctctgtgtactcggtctaccgtggtcccttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttatcgcttctttataggcttgtagctttgcttgtgtgcttcgcgtagcttctgtcgttccggaggttccagaagcgtggttcgcggtcgtcgccgaaggttcggaaggccgttctctcggagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtagggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatagttggcctgggttggcttgggacgagctgggacccagggtcgggttgccagttcggtctgaatcatcgtaggccttgggttaaggcaggttcgtgcgggttcacgaccttgattaataatactgtgtagctttaggatcgtctttttaaaatggctttgggcaactaagtgacttttaaatgctgtttactgcaaaacttaacccctattattaaccccttgtacccccttgcattaatcatgcatctgccggtgtgacttgctgagtactgtggttgtactcattcttgctcaatctttcccccccttcagtaagagaagcttcggagaagatgtcttaggtggagtcctggcttataccccagttgagcacctgtgaagatggagccgtaggcccgcaagtccgctgctgtttatttttgtttgtcaggcctgaagtgcctttgtaataatgtatatattatcgatatattaaagatgtgccttttgtatcatgtttgtttggtgtaccccggcttttcctgggacggggattaatacactagcgttcgggaaaaggcaattttctcgatcgcgacaatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctaacaacgagcgtgtagaggaaggtgattcgtcagatgatgagatggatattaatccagcagaatgggctagtgaggatttttctggactgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagttgttaccaagcagacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcattcttagctctacatgcatgcaagatggcattcgtgaactgtcgtcctgttctctgcattgataggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgagacatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcctaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtctgtggactgccactagttggcatagtggagttcattttacatgggacatgcaggtattttagggatcggatccaggcagttcttccctctatgccgaacaacagcattttgtttggagctttcaggcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtatgttctcaaagacgacggcacatgtcattgctcttgtgcaaagccgaagctgctccacaggccatgcacccatgtcattgctgccgcagcggagtgtggcataccagatacagtatatgtgtcacagtacttcagtaagcaagcaatatatcatacatggagcggtgagatttatgggttcggcatagctggggagttcacagagactaacgatgaagtactcaatattcctgacccatcgaagctccgaagcaaggctggaaggagaaggactcgtcgcatccgcaacgatatggacgagtcggaggctggcagggtgaagcgttgcagcaaatgcgatgaacatgggcacacctacaagcattgtcaaagacaaggagaaaccaagtgcggcggagccaggactatcaggatcaacagcagatggagctcgccctacgggtgaaggcactacctccactcgaccacgtcctaggcgtcgtcgtgccacgtctggatacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttatgtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaacgcgtatgattttattactatttcataattttgcaagttatcttttgttttacattactattttttgaattgttctaacacgaaacactatatttttcagagatagcacgtcaggatacacctcagttgttggacccggcgatagatcaccgacaccggtctcaccttactgcggtgcagggggctcagcttgggacgtttcgggcacggacgtgcggtgagctactcacggttcacgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgcccttgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatc

SEQ ID NO: 73644 - DNA, 949 bp, Oryza sativa
  unsure (1)..(949): unsure at all n locations
cacctggctttgattgatctncttcgtctgcaagtagttcatcacgcgacagtatggaatgcagatggagaattctgtgcaaattaaaaccttgataactttgccttctggtcatggaatcgagctaggttttttttgacggtttcagaaccacgggcctgacagaagagagactggatttggagagttggacccccagagatttttctagaaattacttaccattggccacgaagcagcggttgtttcggcgaaacgtcgaatatctgagggtccacaactggttctcaacgaggtggttagtatagggatggcacataggacgttagggtgtataggatcgacgatgtcggtgtcaagcgcgtcgactaaccgcgccgttaagttaagctggcgggcgcgacactgtggaatgcagatggagaattctgtgcaaattaaaaccttgataactttgccttccggtcatggaatcgagctaggtttttttttacggctgcagaatcacgggcctcaccatagagagactggatttggagagttggacccccagagatttttctagaaattacttaccataggccacgaagcagcggttgcttcggcgaaacgtcgaatatctgagggtccacaactggttttcaacgaggtggttagtatagggaaggcacataggacgttaaggtggatagcttagacgatgtcggtgtcaagcgcgtcgactaaccgcgccgttaaggtaggctggcgggcgcgacactggaatgcagatggagaattctgtgcaaattaaccccttgataactttgccttccggtcatggaatcgagctaggtttttttttacggctgcagaatcacaggcctcaccctagagagcctggatttggagagttggacccctgatgaactnctgtaccagtgatagcgatcaacaaannnncccaccg

SEQ ID NO: 73645 - DNA, 96873 bp, Oryza sativa
gcgcccggcggcgaccatggcgggcggtgccgggttggcgggtggcggggccgcgcccgacggtggccggcggcggcgctcccggcgggcagccggaggtgccgccgatgggggcgcacccgccggcggccgtgccctctcgactaccggccggcctcttttcttttctttttttttgataatttgtgattgattgagatgtgtaattttgtgattcattgcatggttataagatgtataatatgtgatgtatttaatttgtgtgtattttttaggatttgtgatgtatttgatttaagtgtatttttttaggatttgtgatgtatttgatttatgtttataagtaacttaggatgttactttgaattgtggatttggggattgatttagggatatacatggcactagattcgggagaaaatatagagattaaatctagcaaaagaaaaaaaaacgctactctctctttagtcccggttggtgttatcaacagggactaaagattcctctcttttttcccggttggtaacatcaaccggcactaaagatcgatctttagtcctaggtatttgaaccgggattaaagatagcgatctttagtcccggattcgtactctttattggaaaactgggactatagggggttaccaaccgggagtaaaaagactttctccaccagtgatatctctttgtatatttatgtaaaaagtaaaatatgcatcattaagtatgttgcatacaaccaatcaagattaatttctgttggtgcaatgatatatagtaatatttaaaacatgagcaatctacaggacacgaagcgatagagcaccttaaccaataagaattaatttgagaatgatgaatattttggtgtcctttgctcggaggatgagctaacttggacggggagtattcttttaaagattttagatggtatgctttaatggcaaattttgaaatgatgtcctcttatagacacgtgctaaatagggctggcatgatactatatgttgtaccaaaacaaatatcttaagcacgtacagttgtaccttctactttaatgagcaggccgaattaaatgaacaataatcaggtggtgttgaccctattgttttctagcttaatttgggcaactacacatgcgtgttcattgaactaatggaaagaatggttgaatggttatggtccgctatatatctccattgaattgaactggatggtaccccatgccttgttattggatttaattgttaggtttttcgccgtaccaaaattaaagttaactaaaacatttttcttatgaaacacgatacaaatgtatgagctcataacacgtgaaaactcactcttataaacgcacacacgcgtatagtccattccttccgaaaggctaggctggcacatcttgaaattgatgaagttgcctcgctatcatgaggtacaccacctatagcattaaaaaaaattaattagttgtaaattccaggacccaagttaattatatgacttcaacttaggtgaggcagtttcatcacaaggaactaaataagttgagctacactcgcttcgcgttaaaacattatgtttatacctgcatgataatgtagcttcatgtattgcctcccactacttaaaataattttcggtccacaagaatgcacatgcatgtaaaaatacaatgggaggtattaaaaacagtcttcacatgtgctggtattaaaaacaacgcttgtaaaaattgagctatataggaaccgcatcgtaaaagttgaacgccctgtaaatcactatttttacaagtggaccctaagaggaaccaccaagatgcctctcttatccatgaagtgacaacaacctgatttagcatagtcggacgataaaacggtgcaactgattcttgagtatgaagaatctcttcagttcgtttacgcaacgacaatgatagggtacgctgtgatggtgcatggttatttggccttgctgctgtggtggtattggttgagtaacaaaattgaaaatcagcacacctcttggtgcacctgcaagctcccatacaatgcgatatctcaatctctattttttgtgtgatagatagtagatgtagtatttatgtgaagatttatatgagagctagctattggcatagtcgcctggcctcaattaatatcataggttcaataataaccattctttttttattcctaagctaatcttctgactttatgtaaaaatacacaaatatgtataataataaataaatacactactaagacatattttatgatgaatctaattaaattaatttggtgttatgaatttaatttttttataaagtcaaccaaagttagagaagtttaactcaacacaaatttaaatagtttaaatagttgcaaccaaacttttactcggttaaccaaaatttgtgaggatttaaatagtttaactgagtaaaccaaaatttgtcaaatagcaaaattcgtctgaaatttaattagttaaaaacacgaagtcgcaaaagcaacgaaagtagtaaataatcatagtttgatagtggtatttttattttctcaaatatctatttttatgatgtcttaaaactaaatataaattcgtgatatctatagtagcaaaatttgctaatatttatttattatcagacggtacagattaagtacaatactcaatcagcccttctagcaatcaaccgatggttaggatggcctttgctactaattagcttggaaatacatatttttacattctttttaaaagaaatagagcacatcaacgtgatcgagttgcttagaatttaacatgaatctcctatttcactcttgcagcgggtgttgtagacgtgcggtgtggttgtttttttccctgactatagtttttcaggactatagacttgtatttttcgcttgttatatcaatacattaaactcgcgttgtcttgtgcggctcgtatttttttagaaaaaacatgattgttctgcttttaatttgtctccctcgacgttgcctaagtgagttgttatttatcgatcaggtacgatcattattttcattataatttaggaaaacacgagccctgttaacgattgggttatataacacgtgcatgtaaaagttcagaagacccataaatcaaatgcattttagtcttcttctttttccagcccctctgtaggttacctatatttgttgaaaatcttgataaaaaatctagttagagataaaagaacgggggccatagtagtactactagctatatccagcccacaaaccaatctgtacctcactttggtcattttggtccggaataagttcatatgagatcctttaacttgtcatggagtccgatttgtgcttcaaccaggaatcagatacaacgggtccctcaactgttaaaaccgatccaatacaggtcccatggtggtttgaacagcggttttagctgacggcctacgtggctaatttgattctatcttcatctaacatggtgcttacggtgcaattcaacatggaaaaataataaaatcatgggacccacatgtgagcatcatacatataataataaaaaaatggttgggctcatgtgggccccacctgtcattctcaatcccctcctcttcttcctcctctctctccccatctcccatctctctcccctctgctccctccactcccgcccccatgggcctaacgtcggcggccgccgcccctattccctttcttccccaagacagacatcaccgcggctcgcggcacccgcatccgcatcgtctccatcggaccgcagcacaacaacgaggtgcgccacgttctcccggtcgatccacgcatggatatcgctggcgacactgctagcccgcacgcgcgacctcgaccctgatccggacaggtccggtggcggctctgtcgacgtcacagagcttcgacggcgtcgtgttctggctgcggctgtggctgtgtcggcctcgcccgcggccggggcaccagaggaagatcccgtgaatctccgcgtcgctggacgatgccctagccgccgcggatgcctccacctccgaatccctcgcggcgctcgatgcccgcgaggctgccgtccccgcgttcctcgccgaggccgaggcggcgctgtccgcggctgtcgcggactcgcggaggctgagtgcacggagtccccgcccgccgaccagtggcgaagctaggatttaaggttaggggggtgtggtggggatgaaacaagccataagactaaataaccaatgtcgacaataaaacaacgtattatatgttttgccatacaatcattgtgatttttcatcttcacaaattgagtactaagttagactacaatctctaggtcagggatagaaaacggtcaaatatttaggtattgttgtattgggagagagatcagagaaataactccccagtaggccacaaccatcggtacgtgggaggatggagaggtgcgcacatcatgcaaagctgaagcgatgaagacaagaccttaatctgtgttgtctctctaatatctttctcgttaattaattttctagaccatgtttagtgataatgggtaattaacatgctaatgggctcacgtttgctgcctacctagccttgttacgtaaagcaccaggggagggggagtgtcggataggggggtgttggccccctccggcacccccgacagcttcgccactgccgccgacgtccggagcgcactctggtggatgtgcggccacatggacgccgccgcactctggtgcttcatggcggcgcgctggcggcgttttgctgtccatccgatggtccggccactatgccgggcaacggcgccactgcatcttaccacacgaacctgaacatgccactgcagagaagtcctccatgcgacactccggttgcacttgagttccgtcgctgagcccctagtaacctgtagcactatcgcttcaagttcagaaactgaagaaccgagccttggtttcttttcatgaatcacgagaaaaaaaaaaccacttttgattgcgtgtgcttatgatattactgtgttaaaaaatataatgaagtaacgaacattccaattttggatcctgtgaggtctcgagattgttgagagatggtcatcaatcaatttcatctatatactgcaagcggttctgaaagtttgacgacagcacacgaaaccaccactgcaacgttcggtttggcagcggcgatgccaccgtctagcaagcaccgtggccggaggcaacatgaacaggcaagggctagcaggattgctggtgatgctcctccgtgagctgagctctcgtgtgcccagccggcgcattggccaccgccttgccagccgcggaggtcgcaggtgtggccgtttccttgctggccacggaggtcgccggtgtggccgcctgcttgccaacggccgaggtcaacaccagagtccgcgtccttgacggcggccgaggtcgccgtctgcttgcagccggaagagggaaggagcgaggagtgaggatgaaatgtgcggtccacgtgggagccaccaattttaaattatttggtgtgtagctgacatgtgggctgacagtttttattcttttccagggttaaattaccatgtaaacactacgtcaatgtcacgtgagacgaaagacctagtcaaaccaaccatgtgcccaccacgtcaaccaaaaccaccttccaaactgctgagggacctcatttgcaccggttttgatagttcagggaccaattgtatctggtttttaggttaaggacgaaaatcgaatttggtgtaaagttaagggacctccgatgaacttattccttttggtccgttccctcgccgtcaccgggcagaggcacgtagtaatggattttcttttgttgccaaagggagcagatagttggaagtattggaaatgtgttgctttttatttcattgtttgtccttccctcgttttatgctgcaattttgatccccggtatagaaagctgatataatgaagtcaagcaatatgcaaagtgtctacgtttgatgtcgcgattatagtatttgcatagtatggagatcgttggtactaggatatatgcgagattgtaataaaagagatggagatagggatttttatacacgttcgggctcctgcattgtcaagtaatgaccctactgttggccgaagccggttgttactcttattcaccataatcacaccagtataatatttggggtagcctatctaactgttgtcgacttgatggtctgaagtgttgactcgtagtcgacaatagggtagcattcctcctcgaatccgcatcctgcgagatcaaagacagcactatgtctctcctgacaatatccgtagacaccgtaggggactagtcatacttatctctgaagtcgatattcggcgtcttgtcttggcgcatgttggcttgtatgttgatcttgtgtcttgatctattgttccgtgtcccctctcctcctagggggccttgtatttatacccataggtgtccccttatccaagtagaactagggaaaccattatggatacaatccgagtagtacttgtcgtttccatgtagaactctattcatccttccttatgcggaactcctcctatatccgaagattgtttccgtataagacatggtatgtggtatccataaccctgacacaaagaactttgtgttcaatttattctcccaattgcttttgccgtgtttttttttcatcatctttgattttcaatgctcttttttttcacatcacctgatttatatcgatcttgtttatagcggtgcgaggatctcgatccgttgtaggagggggaacgactgaagatagcactggtggagaaaccatctttcgtcggtcagccaaattccacaatagtcccggttgcaataaaaaccggggctaaagatgatctttagtcccggttaaaaagggtaacgggcatatttgatctttagtcccggttgataacaccaaccgggactaaagtcccacccctatatatatgtcttcttcctcctctagctgcccgagcaagcttcaaaatttcttcaaaaaagaggggaggtcatgccaaaatttctagtgaatttattttggtgattatatacaaaatcggaggtgcctaaaaggttagcaacttcatcctccaatgtttttttgtcatattacatttagagctatgttttgcacacttttttatctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaacaaaaatgaaaattaaaagaagtacaacacattaatattagtttaaaactttagaaatagtacacaagaattagttggtgtaatattttataatttttgtatgaataatgatatgtcattattgtatgactgttgaaagagtttgtaattattttataattattgtatgattgtcattattgtaaaaataattatttgtgtacgattttttttcatgtcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattttgcatccaggactattcatttccacttgtttgagtcggggttcatgccaagctataattgttggacatcccacggagagcgaggtgttgaaatggaagaagatgaagtggaagacgacaatattccggactttgctcagtatgttggatttgaaggaaatcaaacggacgaggaggaaagggatgctgatggtaacaacgttgcggatgatcttggttagatgttgcaggacgccaaggaggactgcgaaagtgaaaagggggcccataaattggacaagatgttagaggaccacagaacgtcgttgtacccaggttgcgagcaggggcacaaaaagttcgataccactctggagttattgcaatggaaggcaaaaaatgatgttagtgacaaggcatttggcgatttattgaaactcgtcaagaacattcttccggagggaaacaaattgcccgagacaacgtacgagactaagaagatagtctgccctctaggactggaagttcagaagattcacgcatgtccgaatgattgtatcctatatcgcggtgaggagtacgagaacctagaagcatgccctatttgcaaagcactacgatacaagattagacgagatgatccaggagaagttgacaggcagctaacaaagaagagaattcctgctaaggtgatgtggtatttccctataataccacggctaaggcgtttgttcaggaacaaggggaatgctagaatgatgcgatggcatgctgaagagtgtcaacaggacgggatgctgagacaccccgccgatggttcgcagtggcgaaacatcgacagaaaatttaaagactttggaaaagacgcacgaaacatagggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaaactgttgtggaagaaggaaggtgtccctgtgtaggacgaggacaaacagcaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtgtacatgggtcatcgtcgattccttgcagcaaaccacccggtacagaagaaaggcaagcactttgaacataaggcggaccaccgtacgaagcctaaacatcgcagcgggaaaacagtgtttgctatggttaaagatcttaaagtagtgttcggaaaagggcctggaagccagcctatagagagcgaagatggtcacacggcaatgtggaaaaagaactctatattttgggagttaccctattgggaattcttggacgtccgccacgcaatcgacgtgaagcacctcactaagaacctttgcgtaaaccttcttggcttcctaggtgtatatggaaagtcgaaagatacactggaagcacgtaatgatctgaagcatatggaacaacgcggcgaccttcacccggaaccaaaggacaaaggaagccattacttgagtccagccagctacactcttagcaaggcagagaaggaaagtatgtttgaatgcttggagagcataaagtaccatctggatactccacaaatatcaagcgaataataagcacgaaggagaagaagttcacgaacctaaagtctcatgactgtcacgtgttgatgacacaactgctactagttgtaataaggggtatccttccagacaatgtccgggcaataataacaaaactatgtgcattcatgaacgcaatttcgcagaaggttgtcacgaccggaaataacccaacgggcgttccttacgtgtgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaatacggtcctagagctatacaatattattaaacaaggccgtgaacccacacgagcctggcaacccgaccctgggtcccagctcgtcccaagccaacccaggccaaccattccacattttagttgttaaacaggttttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgaccaaatcccacctacggccggaacccccgggacaggtaggtaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccaggctgagccacaaactaagccttacccactagacatgtggaagtacggtagtgctttgcaacagaggcccgaagaccggtccttatatggccgaggtgctactatcaaaaccaggcaccccgagcccagcctaaaaccattttggggattttgaatagagggggcggtgtgaatccaattccacaataatcaaaccattccatagtgtccaggtgatgagaaaattcccaaagtctagagttgtaaaaccacctaatgttgcttaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgtgggaatttaaataaagcgataatgcaataatttaaatcaaaataattttataaactgggattcaatatgttcaaggatgatgtgacttgccttgctcgctttcccaaacgtcggctttaacttccacgaagagcggatcttccgaagctgcagcgtctacacgaccaacggaaaagaaaaggcttttactctaataaactccatataacaagctgaaacaaagcacaaaaatgggttcttgacttcttaaggaaaaattagagacttgaacggtccaattccgagttcaaatggccaagttatggccatttgaagtttatatgctctttaaatgaatatttgcaaatttcttcatttaaattttaattaaaaaaaaggtttattgcgtcagccgaggggaggggcgcgcggaccgggtccacgggagtggggcccacgcagcagccgcacccgagggcatgggcggctgacggccgggccccacgcggcagccgctcggtgcgcccggaggcggccacgccggcgcagcggcgtgaggctgcgcgcccgcgcccctatggtcgccggcggcggccataggcacggcggagcggcggccgagagaggggagggaaagggggaaacgaagcggcggtccacggctcaccccgggtcgacggcgacgacggaaacggcgaccggagcggaggaaggcggcggcgcggctcgggtggacagggtcgacggtgctccggcggtcggcgaccgaaacggagaggtggacgaggtcggcgaggatgcggcgaaggcgaaggaggcggcgccgaggtgggaggtggtccggggcgacgacggcggcggaccggagctcggcggtgacggcggagagagagagcgacggcgcgagctcgattccggcggggagagagggcggtgagtggcggaaacggtggtggggagctcggggagggtttatatagggttgggagtgagagagggcggccggaagagggggaaatgggcgcgggagacccggccgccattaatggcgccggcgaggttaggggagcggtttctaaacgaatccgagggagagagggagagaaaaatggggggaaagggggaggggatcccggggaataattccccccactttattacgcgcggggacggcgggaggcggcgggattcgcggcggcggcggcgctagggcgcgggggaggcggcgggagcggcgggaggaaggggatgacgggtgggccccacccgtcagcgagggtggtgggcgggcccgcccgtcagcggcgcgcgcgcggggaggaggccgaatgggccgcggggagaggaaagggagggggaaggagatgggccgagccggcccaagggggagaggggggaaaaggacttttttagagcttttctttttataaaaccattttaactttgtttatttcttaatatttattatttgtgctctgaaaattccactaaaatttatttacacattttagacttttaggaaatatacaaaaatcctccaagccttatttgacttttaactttgcacattttaattgttggaggctttcacacggattttaattattctaggcataatttagaggatgtattttagagttgttttgggacgtgacaaaggtcatcgatccggatagattagaagcccttcagaataatgtggtgcaatgtcttgtcagtcttgagttgatattttcactttcatttttcaatataatgatgcatctgctttgtcaccttgtcaaagagatcagtattctcgggcctgtgtacctacacaacatgtttcctttcaagaggtacatgggcgttctgaagaagtatgttcgtaatcgtgctcgtccagaggcaagcatcgccaaggggtatggaacagaggaggtcatcgaattttgcgtagaatttattgaagaccttcgcccaatcggggtacctgaatcacgccatgaagggagactacggggaaagggaactctcggaaggaaagcaataatgacggtagacaacaatttattccataaagcccatttcacggttctgcaacaatcttcattggtagctccttacatcgaggagcacttggctctagttcgcgccagaaacattggtaagtccgatgcatggattacacggcatcacattgatactttccccgcgtggctacgacaacatctcatgggtaacgagacgatcaaccaacaactggccttcctggcgaggggaccatctgggtcgatcgtgacactctagggatatgagatcaatgggtacacattctacacgagagcccaagacatgaagagcacaaaccaaaacaatgttgttcgtatcgatgccatgggacacaatggaacaactggcacgtattacggtgccatcgaggacatatgggaacttgactatggttctctcaaggtccctctgtttcggtgccaatgggttaggttgactggtggagccgaaatgattgatgacagtgggatgacaacggttgaccttaacaaggttggatactcggacgaaccttttgtccttgccaatgatgtaatgcaagtcttttacgtgaaggacttgtctagcaaaggaaagaagggcagagggcctgacgagccgaagcgtcacgtggttctcccaggcaaaagaaaaatcgtcggagttgaggacaagactgacgaggattacgatcagtttgatgggcaaccccctttcatggtgacgattgaccctagcatcctcctatcaaataaagacaccccttactcaagtagcgatcacaaggagggaacaatagtgaggagaaagtacgtgcggtcaaccgtcaccgccgatgtattgctataattattgtgtacacgatgtaaactattttggatgtattgattatccatataaatcaattgttgtatggcatatgttaattacgtacgattattagaggttttaaccattttaaatcatgtaattgctagttatatgcggtaattagaatttttaaaagttttaaatcatgtatgtggcatttacatatgatacttagagtttttaacaattttaaatcatgtatatgctagttatatgcgataattagaatttttaaaagttttaagtcatgcatgtggcatttacatatgttacttagagtttttaacaattttaaatcatgcatatgctagttatatgcgataattaggatttttaaaagttttaaatcatgcatgtggcatttacatatgttaattagagtttttaacaattaatttaatatcattcatatgctaaatatatatggctattagaatttttattaattttaaatcatatatttgcttattacgttttatccacttaatttactacagacaacaataatttttcgaagtaattgtcatttaattttcgactttaaataattttaatgcattattttctattttagaaacacatatgtaatagaaattaatattcagtgcgcttattagcagtcccggttcttacccctaaccgggtttaaagagaatttagaaataacgggaaaatatctttagtcccggttgatgagaataaccgggagtaaagatagaaaatatctttagcgggaaaatatctttagccagctgcctcgttgccgacgccgtcgccgacgtcgtcgcggccgaacatgactctgccgcgccgacgatgccgaccccgacctcgatgcggccggcaccggcgacgacgtcgcactggcagtgccaatgaagccgcgccacgacgccgttgcggcacggcaccgccgccgtgcaacgccgccaccgcgccacaccgatgccgcgcagccacgccgccgccacgcaacgcgccacgccgatgccgcgccgccatgccgccgtcgtgccaagccgcaaccgccccgccatgccgccgctctgctgccgccacaccgccgctccgctgccgccacgtgaatgaatgaacgatcgtgaacgagaacgaacgaacgaacatgaatgagaacgttgtcacaccctgaagttttcccccttttgcttgctttaaaaatttgttaaataaatcgtccggagaaattatcttaattaacctagagctaaatccctagttaataaatgcaattaataatcggaaatagtgtggtggaatttttcttgagttccccatgctccaatgcattaacaagaattttagtggaatttttagagccttggaaataattttaaccaattaaaaatcaccaaagtgcaattttaaatcccaggaaaaatcctttcttccttttctttttcttttccttcttttttctctattgggccgtcggcccactccctcccgcgctcggcctccccttgtgggccggcccgttctccttccccctctctccgggacgttgacaggtagggcccacctgtcaggtcgtccccttcctccagccacccgcctccgacggcaaccgccgccgaatccgccacgccgccgcctcctccgctcttcccgcgcccactccgcgcccgcacccgcgtccacgtcgccgcccacctcccccacctctccccgctctcgcgcccgcccaaaaatgggcgggattcgcattcgaatccacctctctctctctccctccactccccacatcgccggccaaataggggccattcccggccgtttccgcccctccttcgcccataaaaacctgcccccgagtcccctctctcgtttcacccatttgccgtcccctcccgtgccttctaccgagcccgcgccgctcgccgctagcgccgccgcttgccgctgcctccggccgcacgctgtcgtcgctagagccgtcgcctcgccgctcaatcacctccgccagcttcgccgccgcgagagctacctcggccgccgcttcgttgccgcgaatcaccaccggagctccgatttccccgcgtcgccggtgtgctcgccattgtttccatctccggccggccattttggtcgtcgcggtcgtcctctccatccctaactcctctcctcaccttctttaggtgttgccaccgcccatccgccgcccgtgtcgccggtcgtcgccgccgcctttgtttccccgcgccggccgccaccgcctcctcggtgaggaccggtctccctcccttcctctctctctctttgtcgcgacgcccgccgcttagcgccgccgctgtccgccgctcgccgtcgtgcgccgccgctcgccgccggtggccgcgccgagccgccgcgcgccatggccgggccggccatgccgtgcccgagcgccatgcccgggctggcctcggtgccggccgtccccagccgcctgatcggccctcggccgatcgtggccgtccatcccgtggcccgcgtggccagccacgtggtgccacgtggtacaccaccaccccggccccgtggacccggtccacggcagaccacccctttgagccgctgacccgtgggccccgcctgtcggcgccgccccctggatgacgtcagccctgggacttattgcgcaataaatacattaaggcttttcttttatagtaataaacacagtttatcttctaaaattcataagtaattcatccgagctccgtttaagtccattcaagtctcagtaaatcaagaaaaatgcaaagaatccattaaaaatacttttgtttcctgtttcagtagtcttatagcatgttttgcttgtgtgctttgtttgtcgcgtagatttcggccgtttcgtcgatccgcggtttctcgaagacgttgctgaggtctcatcagtgcaagagcaaggcaagtcatgcaatacgtttgatcatattgtacccaatttacaaatatcccgcatttctattaaatgttgcatccttttacaatgtaatgtgggatgggtcctattactcagccatttattgtttaccatatgccattgataacttgggtatttaaaatgactagatgttggcttaggaaatgcttagccatgcttagttcaactagtacacaaatggggatcactttattacatagactctgtctattggcataactttagattggtgccaccgcaatggtgttagttaattaaaatacactgtatggtgggctgtgggtgcatggttttgctggtcgcacccatggcagttaaagaccggttcacgggaaaccctgggagacctaccgtgcttaccacaagcgggagtgggtaactgcttgatctgaagtatagctcgaccctttcctaggcaccggtggcgagggtgggcgtgatggagttgggtcagccggggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatactttggagcatggcgacatgtgtgggatcgtgtcttgtgggtacagttgtacacctctggccagagtaaaactattcgaatagccgtgcccgcggttatgggcgatcaaccagattcaccgtgattagtctcacccctagtctagcttaatgaactggtgtagttcaggtggttggttgggcctgttgcaacgtggtgtagcgttggacagtgattggttaatattgattaattactacagctattttactgctttcaactactgctttgaaatgtctgctttatgcaaaagaacccctagcttcctttggttatatcctgcatcatacctcctcttccggtatgacttgctgagtacagtgggtagtactcagtcttgctctcttttcccccacaccagagttgaagtttttctcagttggagatgtcttgaagaggtgggtttcgtcgctgccgtcaagggttgcctatggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggacaggggtttaatacacattcagcttagaaattctggttcgtgaatttctgggcgtgacaaacgtgaatgaacgaacgtgaacgaacgaacgaacgtaaacgagaacgtgaacgtgaacgaacaaacaaacgtgaacgagaatgtgaacgtgaacgaacgaacgaacgtgaacgagaacgtgaacgaacgtgaacgagaacgtgaacgaacgaacgaacgtgaacgaacatgaacatgaacgaacgtgaacttaacgttgtatttgaacgtacataaacgaacgaacgtgcgtgaacgaaaagtgaacttaacaagaacgcgaacattatttaacatacgttaacgtgaacgcacgtgaacgaacgaacgtaggtgaatgaaacgtgaacttaacgagaacgcgaacgtgaacgatcatgaacgaaacatgaacttaacgagaacgcgaacgtgaaatacaatatatgttactttgcgtttatcctaatacatctttttgtatgttgcagaaaagacgttgtcgtcgtcgtccctcaagtcggagtggtagctagccctcgaaggaattcgcgcaggcaagtgatgtaaatatatgattgttagatttttaatgcaattaagactattagatttaatatacgacacttagacttagcattataattagagttttaatacaatattatttgagttttaatataagattattatagttttaatataagattattagatttgtaattagacttagcatataagattgtgtagggttctaatatacgacagttagacttagcatatatgactatttgagttttagtataagattatttgagttttaatataagattattagatttgtaattagacttagcatataagattgtgtagggttctaatatacgacagttaaacttagcatatatgactatttgagttttaatataagattattatagttttaatataagattattagatttgtaattagacttagcatataagattgtgtagggttctaatatacgatagttagacttagcatatatgactatttgagttttagtataagattatttgagttttaatataagattattagatttgtaattagacttagtatataattattgactagggtcctaatatacgtcacttagacttagcatagttgactattacagttttaatacaatattatttgagttttagtataagattattatagttttaatataagattattagatttgtaattagacttagcatatacgacagttagacttagcatatatgacttagcatatatgattgttagcatataagattgttaaagcaaaaatgacctatagacttagcaactatttcttgtatgaacagatggctgatcgcgatgaggaacagatattgtacgatacaatcgcggagggaagcagccagtactggaacgaagaagaggggaacgaggatccaaaccagtacttgaacgaggaagggaacgtggagagggatgcggaggggaaccaggaggggcacgtggagagggatgtggaggggaacctggaggaggaggctagtggaagtcaaccctccgcaggacagaagagggcacgcgggcaacgaggtgccgtgaagaagcttgagggtcggcacatcataacggaagtggacgaagacggccgacctagtgccccggcggaagcagccaagaactacgtacgacacagcggttgggttgtgcgggataacatgcctgttagtacggtgtactagcgcagaacaagggcactcggagatcatgagaactttgtcccagattcggagaaagagatgctgtggacaataatgctcgagacattcacccttcccacgggtacataggacaaagtgaaaaggtggactctaaagaaaatggcagaacagtttcaaagcttcaagggagatctgtaccaaaaatatatcctgaagggacagacaccgaacttcgacacattcccaaagctaagggatcactgggacgagttcgttgcatataagacaagtcaacaagggcaggcgatgttggaaagaaacaaagaaaatgccgctaagaagaagtaccatcaccacttggggtcaggcggctatagcgtcgcgatgccgaagtgggaggagatggaggcaagcttgcttgagaggggtatcaaaccggccactgctaaatggccagatcgatcgaagttctggtactatgctcacggtggaacgctcaacccagttgatggctccctggtcttcagcgatcagatacgcgaggctgcgcgtcgactaacggacgcagtggaagcctcttctcagggcacgttccgacctgacagcgagaaggacgagctgtcactcgccctgcagactccagagcatccaggacgaacacgagggaaaggggtgattccttggaagattgggttcagggaggacatccacacgtacaggattcggatgaggagcaagagagataccgaggcgaagattgtagatcttgagtacagggtatcgagctacgagctcagcatgcaagaggaggtggcaaggaaggttgatgaacgcatggccgcacatcggtcccatgatccccagccgaccattcctcctgcaatggtgagcccttcaggaaatcgtagcagctgcgcctcaacggggcaggtaggatcacagagcatggacgccatgcaaacccaggacgaaaccacctgccccgttgatgacatcactcagcggataccatgtgagctgcatattcccttaaagaacttatcaataaaggtaagctcgtagtttatagattttagatttgtccattctgcaagttgctgcttatatatgttgattactaataaacaacctctcaccacgtgaaggtggcgtcgggcatggccatcccaatggacccttcaggtacttaccactgcaggccgattccagcaggatactccaaggtcgaagttcagttggtcgaaggcgcgtacgaggacctcgagttggattaccctagaggagacggtgagacgcatctacgagacacaagccacgccattatactatggcgcaagtggtacatcatccttcctgggcgacaagcggcgtctcgtgcaccatctcctccggcactgccatctcctcctcatgctcctacaccgtctcctcctcatgctccagcaccgtctccacctcaggctcctgcaccgactcctcctcaggctcctgcaccgactcctccgcaagctcctcgtccgacaccttccaagtcaagggctccccaagctccaccgactgcccccacaagggcaacgaagaaggcgaaagttaacgctgccaagaacaaggacctggggtacgattgcacgcaagattagcttgacgcttatgtggcatcagaagtcaggagacaattgaagcctcgaagtccagaaaagaagattcctatagacccgagtgtcaggaacttcttcaggggtatgtctgcacctgccaaggaggccataaagctatcggactatgagcgaacactcaagaaagcatcttctagaaagtccaaaccagtccctcagcttggagagcaaccaaaccaggagatcgagccgttggtgaccggtgaagattttggaatacaagaatttattaatgacaccaagctaactacggatcaattgctacgaggcgcaccaatcgaaaaggcggaagtgaaatacatgtacgaactcggtaaaccgcttgtcaagcctgagcagttgcagtccctacccacacaaatgtacaagttccatcaactgtacatggagatgagcgccaccggtagagagatgatcggagcgaggatcagggacacagacttcttgcaaggagatgacattctctggatcaatttcaagggtatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcagaaagtaaacgtcgcaatgctcgaccagtatccgcaagccacagaggaaaatctcatccatctcctgaaggcgcagcattacaagacgttcatactgttgccgtacaacacagagttagtttaattttactgtcttcctataccaaatttcattcccatacgaacatgctaagtgtttcatatgtaatgcatcccacgcacattgcagattccactaggtgctgttactcttcgacctggaggcctgcaccgtcaacatatatgactcaatggataaaaaagagtctacgtttgacaaggttttcgaacttatagacaggtattgtcataagttcctatgttaattaagaatcttgttataattaattgctactaagaatcatagctttaaactccatgtagggcttggtatcggttccgtcatttggtccgcggcaaatggagagaaagacttatgcggaagttcaattttcctgtgagtacacatgctctacatttatattgaatctccaattcaaatacatacaagtgtatattaattagatgtctcgccgtttgtcatttatttatagtgcgcaaagcaaaagcatggaactaacttgtgtggctactacgtgtgcgagtattgccactgccttgcaaaccaaatcatcaccacaagagagctcgatgtacgtacaaataaattcaaattttcattacgtatcgatttgttgtttaattactaattaatttcatacattcatatagtttattcgcatgagggataacctgatcacacacaaggaatttatcgcggcggttcaagaacaactcatgggattcatcaacaaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtgtacacattttctttaatgtaaatatatattttggtcatatatatatatgcaaaaaaaatgttaagtgctttcacatatatatatatatatatatatatatatatatatatatatatatatatatatatatatatatatatatatacacacacatgcatttgcataacatatatatgtataaatacatatatattatgcatgtatatgtattgaaacatatatatatatatatatatatatatatatatatatatatatatatattatatgcatatatatatatatataatatattatatgcatatatatgtattgaaacatatatatgcatggtatatataaaccatgcagcaacagggccatgcaaaaaaaaaaggtcagctcaatctttagtcccgattgatggctcagccggccacgtggctgagccatctttagtcccggttattttacccgggactaaagatagcgatctttagtcccggattgatagtcctggtttagaaaccgggactaaaggggggttacaaaccgggactacaaacgctttctccaccagtgtagagatcctaccttttaccataaactccctttaaatagcaagttttacggttaggtcctttgccccatctctaccgtttatttttaatccgatggctttgaatcaagtggtgacacgtggcaaatttttagaagggctaaccagatttatagggcgccatgtggctcaataggaagccagaagctataccctgaattcagttttagagattggagttttatatatgtaattatacaagccaagcaacaaccttgccatatgaagtagagtgaaagaagagttggtgtatgttataatttgttaattattaatttttaatttcgaaattaaattaacgaagagccatattgagaaacctaactaatgatgccttcgcttgaaatttattatttaagattgcaaaagaaaatgcatatttaaattaagacaaaaggaagaaaagcacctaacctggtttgctcgctaaatttgtaaattaatcacaactattcctcctgttttgcatccttcattcacccgcctatgaccatattttaaaagaaatcttccacgatcaccttgtcattggtctatgctaatatgctttgtagattgccatggctttgttgcacgggttctgcagcagaactgcatacatgatgcaagcatatacctgtcattagaaccgtcacttaaattatagatggtggaatgattaacgaaacaatacttcactgtgccggcgtagtggcaggagattcgaaccgggggatcacgaacgagatgtggccatctcagcggccgctcgctcctcactgcactgtttctgcagcagatactactactgcaagaattcgccgagtttgacgcccgcgatgatcattgtcaggtagatgcatcgtccatgaagtatcgattttgttcatcaacatgacaacatcttaatggccgcgtgcatgatcatgatgaaaagccactggaaacaattgaaacgaccgtgcggacggactaaagatgatgaaacacgatatggattggtcaacacacttgtatattagatgggtttttggaacacgtatataataaattcgttctaaattaaaacccatatataaatacgtattataatctacggatctttctaattaacgcgtgagagctcctaaaagtgtccaattagtataggtatagatagatagatagatagatagataggttatagatagatagattgtccatatagttgatgagtaaattgtatcgcgaagggcggtagttacacaaggacaaagcgtgattcctacttttatttatggttatcgttcatcactagaaattaattgcaaaaccccggccatctaccgatcatgttctttctatttactcaacctcttcatctttgttcctgttgcaaacgcacaatcaaaaaggctacagtagacggcatggcttcacttttgaccaatcatctactgttggagacatgttacgaggattttcgaccagaactgccaaaacgaatcaacgaccatcggggcgaagcatagccaaggctccgggcaaagccgaagctcttcgctaccgagttggccatcttcgccaagaccttggatgatatgcagattcctcgctccgagctaaaaccaagcaatgcgccttttcatggagtaattccaggattatccgcaactccactcggccagatcaccctcccggtcacttttggcactcgggaaaactttcgcacagagaatatcagctttgaagtcgccgatttcgagacagcataccatgccatactcggacgcccggcgttagccaagttcatggccgtcccgcattacacttacatgatgatgaagatgcctggtccccgaggagtcctatccctacggagtgacatcaagcaagccgtcacatgcgacaaggagagttgcgacatggcccaaacccgcgagatggcgtctgcccgagaggatatccgactggctgcagccacggcgagcgaaggagaagtgcccgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgatttgcacaagacaggaaagatgcgatcaaggaggaattaaccaagctgttagcagcaggcttcatcaaagaagtccttcatcccgactggctggcaaacccggttctagttcggaagaaaacagggcaatggcgcatgtgtgtcgactatactgacctcaacaaatcttgccctaaagatccttttgggttgcctcgcattgaccaggtagttgactcgaccgccggctgtgagcttctcagttttttggattgctactcggggtatcatcagatccgactgaaagaatccgactgcttgaagacttcattcatcacgcccttcggggcatactgctatatcaccatgccgttcgggctgaaaaacgcaggagcaacctatcaacgtatgatccagagatgcttctcaacgcagatcggccgcaacgttgaagcctatgtggatgatgtagtcgtcaagaccaagcaaaaggatgatttgatctcggatctggaagaaaccttcgcgagcatccgtgctttcaggatgaaattaaaccctgaaaagtgcaccttcggagtaccgtcagggaagctgcttggttttatggtgtctcatagaggcatccaagccaacccggagaaagttactgctatcctcaacatgaaaccgccaagaacccagaaagatgttcagaagctgactggatgcatggcggcgctcagccgatttgtttcaagacttggcgagcgggggatgcccttctttaagctactaaagaaaacagatgatttccagtggggacctgaagcacagaaggccttcgaagatttcaagaaactcctcaccgagccaccggtcctagcctcaccacacccgcaggagccgttgttgctgtatgtatcagccacctcccaggttgtgagcactgtcttggtcgttgagcgtgaggaagaaggccatgtccagaaagtccagcgaccgatttattttgtcagcgaggtcctagccgacaccaaaacgaggtaccctcaggttcagaagctgttatatggaattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaaaccccgaatttcaatcaagtcccaagcgttagctgattttgtcgccgaatggaccgagtgccaagaggatacccccgcggaaaagatggagcactggaccatgcattttgacgggtcaaaaagactttcgggcactggagcaggagtggttctaatttcaccaactggagaaagattaagctatgtactttggatacatttttcggcgtcccacaacgtcgccgagtatgaggccctccttcatggactgcgaattgcaatttccctagggataaagcgtctaatagttcgaggtgattcacagctagttgtcaaccaggttatgaaagagtggtcctgccttgatgacaatatgatgacatatcgacaagaggtacgcaaattggaagacaagttcgatggactcgagctcagtcacgttcttcgacacaacaatgaagctgccgacagacttgccaactttggatccaagcgcgaggtggcgccctctgatgttttcgttgaacacctttatacgccgacagtacctcacaaagatgctactcaagttgcgggcactcaagacgtagctatggttgaagccgactggcgagagcccctcatacgatttttgacttctcaagaactcccccaagacaaagatgaggccgagcggatttcaaggcggagcaaactttatgttatgcatgaagctgagttgtacaagaaaagcccttcagggattctgcaacgctgcgtatctttagaggaagggagacaattgctgcaagatatacattctgggatatgcggaaaccatgctgctgcacgcaccattgtcggcaaagcttaccggcagggttttttctggcctactgcagtgtccgacgccgacaaaattgtgcggacatgtgaaggttgccaatttttcgccagacaaattcatctaccagctcaagagttgcagactatcccgctgtcttggccgtttgcggtttgggggcttgacatggttggcccgtttaaaaaggcagtcggcggttacacgcatctctttgtggctattgataaattttccaagtggattgaagctaaaccagttgtcacaatcacagcggataacgctcgagacttcttcatcaacattgtgcatagattcggagtgcccaatcgaatcattactgataatggcacacaattcactggcggagtttttaaggacttttgtgaagactttggaattaagatttgctatgcctcagtggcgcatcctatgagcaatggacaggtggagcgagccaatggtatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccaagtgaagttgaattcgagtctttgcgctttcgaaatttccgtgaagatcgctacgacgaggaccgagtggatgacttgaaccgattggaagaagttcgtgaagcagctttgattcggtcggctcgatacttacaagggttgcggcgttatcataatcgcaatgttcgatcccgtgcctttttagtcggcgacctggttttgaggaaaattcaaaccacacgagatcggcataagttatctcctttatgggaggggccatttatcatctctgaagtcacccggccaggttcctatcgactcaagcgcgaagacggtactctcgtcgacaactcttggaacattgaacatcttcgtcgtttctatgcttaagcttaccattgtatctccctatcttgactgtcaacaccaagttttcttcttgaagttgtcagtcgggggctattatcataataatggagtgtgatttcttatcaatttaatttgcttacttggtttatcattgccttgtttggttttttctacttagtctgcgaggactgaaagtttttaatagcttctttgggttttaggctcaacaaagcttgacaaaaacttttaagaaatcaaagatttggctagaactatcaagcacagcataaatacaccagtattgtacaaattgagcctccatttgttacattcatattcagtcagaatcagtcctttcatcatcagaattattactacttggctgaaggtcgttgttacggaattgatatacaatgtcacttgcaattttgtcagccgcattctgagcattgctgataagatcaagggcggcctcctcgcttgtcccgtctgcaaagccatcaatggagtcaatttcaattctcgggtacaaggatttggtcattgccaatgccatgctagctcccatacttccagctttcttgatgttcttgaagtacacatccggtgcaactcttagcttgtcaaagatctcggttgcgtcaagtgcactcggaccactgttattaagaaacatagcttggacaagtggtgtagcgacattggcgacttcatctcttgctccttcaagcctcttgatcttaccaaccaggacgtcaaactgagcttgggatttgatcttgcggtctgcaaaacacattcatgataagaatttgttgcattaaaaagagataagttcagatcgtcagctggcagtaccttcaacctccttcaaggccgagtccctttctgcagctagttctgccttgtcttttctcaaggcttcaatttgcttctccatttgagccatcctggcggcttgcgctgtttgagattcaaatggttgaggatacggttatgacggcctgaatcaatgggacagatctagagattaccttttgatgaaccactcagctcgtagtttgaatcctggagctgagcgattcgttcccttaattccttctccgttttcttggcatgctccttggcctcgtgtagctggctcctaacggcttcaagagttcccaaatgaggaaccagcttttctaaggttgtggtcttggcctcattgcgaagatggattctctgcacggtggttcatggattagttttgctaacgagaaaacaaagtcatcaaaggcagtcacctagaagacttacattcacaatgcgagtagcttctccaagtactttcttcagctggcacacttcctcatcttctttttggcgatttatgacaatgccggaaacttgagagttctcgtcccatcatttgagtaagataggaggacgagagtcatcagctgcccttatgcggaggatttcttcttcgtcgccgcctagtggacctgatgtattcccaagacattagacgaacaagctggagttattcagaacggcatcacttgagaagatgagttacctgaggatgtgcctggctgagcgtgaggtgatccttgctctttatctggagacccaatcactgagtcattaccaacttctggtccttgagaagttgtctgcgcttcagcttcaggaatctcttgatttagatctacatccgactggtttccagtcgggggctctcgggttgttgcagtttcagttgctgccgactggtttccagtcggcggctgatcactcggattggccttgtcgtccgaagcttgggcgccagtcggctgactttcggcagtcggttggctttcggcagtcggctggctttcggcagtcggctcagcatctttggataaatttggctctgtggcagctggatcaggttcttttccagttggatctatatcggacggtttcctgcaaagtgtcctttcgatattcagcgtaatttctatgagagaagcatgccgaaataaaatggtaccgagaggtttatacctggaagatgttctaatctttggcatttgacggccagccagttttttcctgggcatggtatgctttgggggtttattgggcgttcctttgtccccagatttgttgctgtcatcgccttcgtcgtcattaagtaccagctttctcttgcgagaacctgtctgcccagccggtttggaggtttgaggttgcgggtctgacctgattgtcggtcctccacttccctgaatggtgtgctggcgaggagatcggcgctgagcaattgggggatcagatttcatcaatacgtgctcctgaatgagatgtttccacggttaattaattcgacatggagacaagattatgttttgatcatgggttgccgatttctgatacgtacctgcggaggtggattgaatgcgttgtatggtacaactggcagttggtgtgagtagctgacgacaatggcgttcgagaatatcttgtacatcctctccttcatgatcttaaagtccagagaatctgggtcttcacggtttggatcatgtttgccgtcaaactcaaatgctgtgcgggatctctctttgattggagctaatcggcacttaatgaaatgccgagtgatttgttctccctgtaagccttgctctttgagcttcagcatgcgttccatcagttctaaggcctgggcagcttcatctcccatgggaagagagttccaggtatcttggtatactgggggaagacaggagcactcaggaagagcgggctcgggattttgaatataaaaccagttggcgtgccatcctttgtttgaagtcttgaaaggcatagagaaatacttctggctcagagtgccccttagttgaaatccagccccaccaactacgcatggtttgtttttgttcggttgaggcttaaggaaaaagattcggcggaacagagcaaaatgaggtctaatgcccaaaaaagcttcacagacatggacgaaatttgcaatatggactatggagttcggattcaaatgatgtacgctgattccatagaaattcagtatcccacggaagaacgttgaggttggaagagcaaatccaccataaaagaaatgagagaagaccacgacctcatgtgtatcgggggtcggaaaagcctcaccgcacgctggccgccacccgatgatctccttggcagggagaacgccgtgcgccaccatctccttcaggttctcctccgtcacgtcggacggcgcccattggccttcgaagttttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcgcagctctgtactgtagcaaggagtggggaaaatggcgagagttccggcggggaagacgaagcgtcgtttggatctcgggttttcttgttaagggtatcggaggtgagaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtacgcttttttaggctacaaaagctgtctgggttaacttggaatgacttgtttttatcatagtcatttcctcggtatgttatatgcctgttttcattatggtaaatagtcatagcctaggctattagacttattcattaccatgatttttatgatatttggtgggtaatctttagagtcttatattcggatgcctgtcaagtgtgttcattcgtgaactttttagagtgttaaccactcggattccttttattgtgactaaaaagcagtcggctagaatgcctctttgggtgccgcgtatgcttttgtcatatgatgcatgattgtgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattgtctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgagacttagtcggtcacgactgtatttgatctgtatctgtgtattccgttaaggatatagattatcttttgtaacctggactccttcccatatataaggggggtccgggcgcctctaggggcatatgttgattttcccaaatcatacaatcaataatacactcggcggattcatccccggacaggagtagggtgttacttcttttataagaaggcctgaacctgtataaatcctttgtctccaaacccatacacttttccagcttgatagccacccccttttattattgccgaaatctagtttcgacagttaccgagttggcgctcggtcacttgggggagggggaaaaatcaggcgctccccccctcccgacgcgcacgtacccctgctagcgtgtacatctcagagctcgcctagccgctcagtttcttgaagagcctgacgaccttgtgcttgctagtggccccatcgaaggcaagcccagcgctggaccactcgaatgggaaccacaacatcatgatgttgtggaactgcgcgccgctgaggatcggtagcggtgattccacctccgccgctagcccaatgagagagatgactccgtgtaataatgccgcaacgatgcactgacatgtggggcctgtcgtatgccacgtcagcgaacctagggttaaatttggtctatactgctttaggaccttttttacacggtttgtaatagttgaggggtagggatttctggtattgggaattgggaacctcagacagactaagtgtaaagttcagggatgtcaagtgaacttacatgaaaagggatgacgaattgcattgccacgaagcggacgacacggtgcgtgcgattcatcatcctcgctgctccagtgctttgggagtcgcgctccatcctacaacatcggagtgctaatccgtgcgtgttacccgtgcatgcggtgaaagacgcgatacgaacgattcttcaatttttataatatactccctaataatatttacaacacaccaaattagtttcattaaatctataattgaatgtatttttataatatatttatattgggttaaaaattttattacatttttctacaaacttatcaaacttggagcagtttgacattgaccaaagtcaaaagtatataaacatgtaaagataaagattacccgtatatcgacatcgtatcgaaataagatggcataccaaattttggctagaaatatcttcaatttttctactagcagagattggattgccacgttggcgctaagtgtataccatgccatgtaggacccaaacgttccggattgagtccgggggtaattgtctagtatcaataatttgaggtttaaaatgtccggctttatggtttagggggtaattcatactttttccttaaacaaactatgataatatatgcaacctgtttatttaaaaagaacttactttttttaagtagtactagtcaaaatggcatctgaccgtatcaaacataaaaatgcatttttagacgtattaaaataccaattcacgaaaaacaaatacactactctctccggttgataatacttgtcgttttggacaaggacacggtcttcaaaaaataactttgaccattattttctattataatatgtataaaagtgttgacaaatatatgattttattaaagtactttttaagactactctatacatgtagtcatcatatttgaaagccatatattttaaaaatgattcataatcaaagattctaaaacgacaagtattatcagtccggagggagtactattatctccgtttcatattataagccgttttgatttttttagttaaacttatttagctttgactaagtttataaaaaaatatagtaatatttttaaacacaaaataaatatattatcattaaatattgattttagtgaaactaatttgatgttgtagatattgctaaatttttctataaatttaattaaatttaaagaaaagtttaactataaaaaagtgaaagtgacataatatgaaatatgagagagagagagagagtaggtacttttcgtgtatttttatttccacacgggatgttccgtgtgcgagttaattcaactcttcggaagaccaccctccctcccctcacaaatagacacacacatccacgactcccccgtgcgcacgggcccacctgtcaggagacaacacgtgggcccaccccacgccattgaacccttctattggatgcccggaaaatacgtgcgccccaccaactgactcacatctttccccctccccctcgccccccgcaacgcacgttcctttccgaccgatccaccgatcggaaaccacgccctaaccccagcaaaccccaacgcccccctccgccctgccaccctccgccgccgccgccttcgccggcgaccaccccgccgccctccccggggggacccatctcctccgccgtcccctcgccgcctgcaccccggcggtgcctcggcgtcctgctctgccgcctcctcgccggtgagcgccatcctcctccttcctcatccctctcgcgcgttgcgttaagcctcgtcttctctgggtagatctggaagcttttctcttagtttggcttagccttctctggtaataatggcgatttgtttgttttttcccccaaaaataaggggttccatgcccccacacccgcgttaggtgcgccgctcgattaaatgctgtaatttctgcatcctttcttggttggaatgggtgccctaggaagggtaaattttggtcatgccaaatttgatgattctacaccgagagatgcggaatgcgcatgtggattgcacctgtatggctgtatgcgattgaaatgagaggaattgtgcagctctcaaaatgctataggctagaaaaatcataccataccatgcatacatttgttttaagactacgtgattagcgtggaattgagggtggcggatgtacttgcttactctgggtgaaattggtgttgctcaatcgaaattccacatgttggcattatgatatgcatgctacattgttatttacaatgtaagatggagacatggtcgttattgatacatcgggtttgttttgagatcctgggcaccataaaagcttttgctagccaatccatttagcaccagatgacccatgctctttacttacaaaattactatcactgtgggagtcaccgggtaagcatgacctatggccatgggtttggggaagggaaaaaaattgttttgaaatatatttgatgatgggccttacctgtattttgtcaatctcaaactagaaactaacatcttattagcctgtagcattatcttaaagtaatcccctgtagaattctataaaatataacctagtgtgacgctagacatagggcctgttcactttgatgccactttcaaccttaccaaattttggtaaagttgccaaaaaagtggctacatttagtttgctgtcaaattttggtaactatataagaaatcctaccaaaattttggcatagttgccaaaattttggcaatgcccaaatttggtaaggttttttttggcatcaaagtgaacaggcccataatcaatatacgttttcttagaatgctcgtaaactatatgggagaaacagactggtttcaaggcctattagcacatgttatgcagtttctttcgtaaaactggccatatttataattcatttactgaacatattactacaatcattttctgtaataattgttttgtaactccattaaatcttctgtggcagtgtgcataatacatattcggaaaggcaaatatggctacaaaactccgtcaaccgtcaactgatgcagaaaaaacagaggttggagaaatagacacaagggctccttttgaatccgtcaaagctgcagtaagcttatttggggaagttcgattttcatctgacaaatcagctgcaaggaagccaaagcctcctcaggcagaggtaggtacttatattaaacatttttttcatattagattaataatagtacttcaatgtgtgcatgcatatatctttatgaaggttgaacataccgatttgtgtggaatgttatgcgtgcctactattacatggaatacttataagtacagcaatgttgcagaccttgatgttcttaagccttgttgattccagaactgctaacttcaaatcttacgcaacaaaatgctgtgaccttcaagtgtgttatactgatgccaatatgccataatgttgataaccattttcaaatgtctaagtagtttcatgtagcacttatttgaagctaagtaacacagatcttggaacgatgctgtgttcctcgtccagtgaactttgtcccgaaacaaggaacgggaacaacacaagatgacgtaccgaacgtggatggatcacatcctaacataaggaggtatgaggaaggcaaatctgagaggggttgggtttagggatggggaatgcaccagggtcacagccgcaacgggcgagcactgttattgctccctcgctgcttgctgccatcgcacctgagtgcatggaggaacgccaccgctgttgcgctgaggaggacgggggagtgctgctgctgttgtgccgaagggggttgggggagcgttgtcgccactgacctgagggaggacaggaagcaccgctgtagtcgtgctgcggggcttggggaagtgcggttgccgctgtcgcgccgaggggcatgggggagtgccatctccatcgtcgctatcacgctgagtggctgagaacgatgggatggattctttccatcgatgggataagactgtgagtggataagggattcatcttatttcatttttgctcttggactctgaatattatgaacagttctttattgaattgatttctttcatataagccataaaatttcatatatattcatttaagcttattgtatgcataacaatggaatgctcatatttataagcccttggcttctaatttctgatattgttccggactatcatcccggaaactaatggaacgcattccatactttgaacaaacgttttgaagaggtatttcccccttcataccatatttttcaaaatccctgttccgggatctttttatgacttaggtttgaagccacgcctttgttttttttaatgaaatttgtcatatcagcaaactatttcctgcatgttccagtgaataccacaagatacttgttttttatatgctctaactcttttcatttgcatttactttcctgttcattcctatttcttttttgcaagaaataggtgtgttcccactgttagaaatttcaggctgttccccagcctatttgctgtctttaattaaacagattattattaaattaatgcacattctccatttatgagtcttttcacagcagaaatttgatttgcatttctgaaagaatagtagttttgccttctacttttactttgattatttgtcttggtagttgttgtacctggtccacatctgatgaactacactttagaagagagcataattgagtgacttgttggcagaaacagagaaagaattagcgatgattcaccatatgatactactagaagtctaagtttttgtttgtattttttttttggggggggggggggtgtggggactgacatgcattcataccattaaaaaagttcagtcctgtaagctcaagttttgctggatttaattttcaccttcgttttcgactccaaatagtgccactcctggagattggttgtcccatgcttccttccatgtgcctatttgaatattgcatcatagttgccatggccataatcacataaacgcaatgcagaaacattagttccagcttaagacaggagtatcaaatttgttatatggtataagctttgaacgtaaacccagatacaaatctttcactcactgaaaagttaaaacatcaggtactgggttttttctggattggaattgtatcaagataggactaatttgatcaaagtatcaccccagtctcactcctacaagtagtgatgtccttgagccaacttaggggcctgcgaggcaccatgatactgggatctgacgtgcaatcctttgctcatacccattcattgtctgttgccttggtccactggtcttcatcttctctgagcctggcatggttgccagtatctccaagacctactgttgccatggaaataggggcagcggtgagctggttagaccgttagagcaacagtttggtagaggaaggtggcagctgctggtacttgggactgttaattggatggaaaggtggcagtggcatgatggtggaaagcactgttgcctatgacacttggtgtttacgcagcaggcaagcgagccaatgtgtcctagatggtgcataggcaagcacatttttagggattgcggcaagcaacaatagcatgttatagcatatcagcttcacatgtggacccagtcagtgttgagtgttgggtggacaccaaaatctgatgtcatccaaacaagccttagtgttttacttactaagagtatgttttatttgatgatatatataatttttttatcaacaattacatgcatatcaggcgaatccctgaatcatctttttttagctcaactcagacactcaaatctgagttggactctgacatcagtgtcccagtaagactggacccagttagcaatcttaggctcttagtaagtaataatggtggtagcggcaagtaggcagttagccatgcagcaacagccaagaccacccaagcagcagaaaagagaaaacaaagaaggctaggagtgggctgcctggaagagatggtttggagcttgcaagcggtggctctgtttcaggtgttttaatgacattagtggtgacatcactagtttcagtatggcagtcgaattagcactgaatcatgtcttagtgaactatacacacatcttttgtgacttacatgattggctgatttgtaggtcacttcagcatagctaagcttactaggacaccatgtaactgaaaacaagccaaaaaactatagcggttttgggcgagtgggtgattcttctgcttttatggttgaaaggtgcctaatggtttgtttgtgattgggatttcatttgtagacctaggcaatagtttttttctttaggtgagagtgagtcccatggtcacgacagggagtccacagaagcacctctcacatatgtgtatctagtacatgtgggaggatgctttgttaagcttaaattttatttgatttgttttggattggcatggtcaacataacaaaagaacagttagagacagtgattgaaaattttttttggatgttgtaaatgtacatgcgcagatagttcacaatgcctaatgttgggatgctgtctaatatagatcaactaaaattgtcaactgcctccatcatccagacatgtagtatctcaggatctttcttagttgtttttactttttccaattttatagttttttaatgcgattgtattatcttttgaggatgcatttttgtgcttatatttaacatgttttttcatgcatttaaatttcttcattttaatcgcatggacctcatatttttacatcatagagtataactgtataagtaataactgaacactcatatggtttaactgagtctataacttcattatccatggaatggcatttcactttatctattttgtatttggttatccaaatatactctgatgcttgcaatatcaaaatcctatcctgtggcagagggtgttagctaaggagacagaactgcacttggcccagaaagagttaaataaatacaaggatcagctcaacaatgctgagacaaccagagtgcaagcgttatctgagctggagaaagctaagaaaactgttgaggacctgaccaataagctggatgctatcaacaagtccaaagagctggctattcaagcaacagaggatgcaaaaactcgaacaaagcagcttgaaggtggagactcgcttgaggctgttggaaaagatggccctttaaagcaggaattggatgttgcaagggaacagtatgttgttgctttggcagatcttgatgcagcaaaacaggagcttagaaagctcaagaaggattttgaagcttcattggatatgaggttggctgcagcacagcaggaagaggaatcattgcacttagctgaaacaaacaagcaaaaggctgatcagcttcgcaaggagattgctacaattcaagagtctcttacgcatgtgaaggcagccactgaacaagcacatgaagaagaggctcaaatccttgctgagaaagatgttactaggaaaacatacaaacaagctttggaagaagccgagaagaaattatcctctttgaaaaaggattttgatcctgctgtttataaaagcctcaaagaaaagctagatgagaccaatttggagatttcatctatgcagaaaaagattgaagatgctcgagctcaagatttggagtctattgctactgtcagcacagagttggatgatgctaaggaaatgttacagaaagtggcagaggaggaaagttctcttcggagtttagtagaatcacttaaacaagagttagaagctgttaaggaggagcatgatcaattgaaacagaaggatacagaaactgaatccatagttggagacctacatgtgaagcttcagaaatgcaaatctgagcttgaggcagccgtagctgctgaatcaaaagcaacgtcagcttctgatgacttgatgttggccctccaacagttgtcttccgagtcaaaaaatgccctgcaggaagctgaagtaatgcaaaagagtgctgcagatttaagggatgaagctgaagctgcacgagtagcattagcagaagctgaacaaaagttgcaatctgctttaaaagaagcagaagaggcaaaatcagctgaagcaaaggcccttgatcagatcaagcaactatcagaaagagcaagcgctgctcgggcctcaacatctgaatcaggtgcgaagataacaatatcaaaagaagagtttgaatctcttagccgaaaggtggaggagtcagagaaattgagtgagatgaaagttgctgccgctatggctcaagtggaggctgtcagagccagtgagaatgaggcgattaagaaattggaggcggctcggaaagagatggaagacatggaattggcaacagaggaagcactaaagagggcagagatggctgaagcagcaaagagagctgtagaaggtgagctcagaggtggcgcgagaaggagcagaagaaagctgctgaagctcagcctgctccagaagcgcaagcacatggaactgcatcttcccctgtacagaaagcttctgctggaaaagccaatgagaagaatgatggacctcacaagaacagcagaacactattgaaaaagagctttatgctaccaaatattacaagcatgttccataagaagaagaatcatgccgacggcagttctccttcacatcttcctggggacaaatctgtataatctatctgaagctcacgtctgaatgatgtgattccaaacttggaatcatggctttatgtatgatattatatttgtagttgcttgtaatatataatgttatcctggtctatatctatgacttgcctgttcctgactatttgggctcctgtgataagtttttttcttttttgtacctctgaaattcgctgtggttatattgatctgagcagtttgtctgctatcaacagaaataaccacgttttattcatgtcgtgcattactttcagatataatgcaacgttgaagtgttaaattctggattattgaattgtgatttatagactgtcacagttgccaatgaacatgaagatctagatgtgttttgctggagtatcatatattcatctttgaagattagaaagtgttgcctcatcattggcataatcatgtgatcttaggggctaccttgaattttatttgggaggtaatttccccaattaaattatctttagtttcattttggggatagtttctacagttaaattcatatccaatatgtagttcagtattgtctaattcagccatacatcacattagtagtaatttaattggtaacatcatatctcagcagcacagaatacacaaatgttgtgagagcctgtcaggtgaggtgcccatacaagtacacacaacgtgttttctatatgcatgtgaaaattgcaaaactaaagaatgctaatgtcaatatacttcttttatttacaagacgtgcaaaaataaaatgctaggatacatgtaggcgcaaggtgggaggaacctggcaaggtcgctgctttccgatgattttgtcctgcatcattcatctcacataaccaaatggtctgtttcgtgagaattccacaggatcattttgtaagaaaataatgtcattttcccttattttccattggcaatccactgatccaaacagggcccaaaaccttaaaaagtttgcctttttggggagctactgtaagctcacaaaggaggttctgtatccgattgtgaaataagtaaagctgcctaatcaatcctttctagattatatttcaccatgttctcaagagtgcttctgaactcactccttggaagacactgcagactttggatagctatttcacccttctctcttgcaagctcatgagccctctttattccaccacttctatgaactagctctattgcagtagccaaggaatttgtttcactgaactcggaatcaatgatctccctgagctgtggttcatcttgcaaagcgaaaatgaccggggctgttagattaccctttgccaggtcacttcctgcaggtttcccaagttgttcagctgattgggtgaagtcaagaatgtcatcgactacctggaaggagagaccgagattccttccgtattcatacatttgttcacatatagcagtgctgacaccactaaatatggcagctgaccttgtgcttgctgcaatcagagaagcagtcttgtagtagctcttgagcaggtaatcatcaagggtgatgtcacagtcaaaaagtgttgatgcttgttttatttcaccactggcaaaatccttgattacctgttaaagaagcacctttctggatgcaaatcatgcatagttttaaataaggcacaaaaacttgctcaaactcttcattacctgactgatgagctttataacttcaatattttcaaggtttgcaagaaaccaagaagattgtgcaaacataaaatcaccagcaagtacagccacccgtgttccatatagctgatgaatagtttccttccctaaaaataataaatgtacctcagattaaacaggtaaatttcttgagtcccctatttcacaatgacaatagaaaggagttaagtaaaatcaaacaggattgccatataaataacgaaaacaaataacaaaacagtttcgtttttttcttttagagcgaaacagaacagtttctgtaatgcaacgacagcattttttgttttcaaactagatgaatgcatggaggcaaaattcagacaatgtatttctaagaatatgcaggagagtattctaagaagaataaacggtaggcacatgtgtcacaaaaatgaaataacaaagatcggtttttgttgacagttctgttggctaagagagaatggttattactgccagtactgctggccttccataaaaacaacataatacgtacctcttcgcatcccactatcatctatgacgtcgtcatgtattaaacttgcagtgtggatcatctctatgatctctgccaaacgttggtgttctgtagttagttccctgtaatccaaaaatcaaagatcttgagggaataattttaaaagactaaagtatatgataggtgtctaaacttgtgtggtgtcacctaggtgcttgaacttgagaactgcacattcatgtcctgggatttgtataaatgggttaacaaagtaccatatgccattttatggtaattagaaatgacatgtgacacccttagtccaaatcatagttttgttttccaattgaaatcaatagatattaatattttgcaattcgaaggaaaatttcacacgtcactaagatttttatttactttggtagaaattctttagtcaaacttgatttagcagggttaaagtgctgcctgaacattggtaacttattaagtttgggttggatagaagccaatttgcatttctgtaattcggtgacttaaataacacacatgttatggtttagggacctatgagatagtgcactctattccaaactgtcacaccctgattttcgtttcaggatttataaattatttaataaattattaatagaatttatattaaatgttcattaatttacaagtgaagttaaatgtggaaaataaaatttcctaaatacaaagcatggatggatttaatttttattaaattctccatggttaattatactctctggaattttctcggatttttcggagctcaattgttaattttaatcatacaaagagaagttcagcaattatttaaatattaaaataatcattaaatgatctaattataatttttaagagtttttcttgtttaaaaatccttaaattataaattgttgtttaaaaggaattattagaaataattttaaaagtttaaaagagaagatcttttttttaatttgctaaatctcaatataaaattgaactagataaaattttattaaatactatgcttgctcctctattttctagatttttctgggaattatttgagcaagggaagtatttttaataaatgaaacatcatttcacgaattattttaattgaaaaagttttaaaaatcccttcctaagccgttgggccgttttcggcccaactcttctcttccccgcgcggccgaaccggcccaagccggcccagccgacgccgcccgccctctcctcccctcagccgccgacaggtgggacccacctgtcgggtgtgtcttccacctccggccgagcccaagccggccgagatgccgagcccgagccgccttcttctcctctcaaatctgctccaatccgactctttttcttcgggatttttgaggggattttatcctcacatactcctctatcttttccctcaagaatcggagcaaatggttgagtatcttgcccgaatcaaattcgttttcgagtttatctccaaaaccgagttttgattatcttggatcgattcctctcgtttggagtccgatctctctaatccaatgctataaatagcatcccctagtcgtcctctaccgtttgccccaagtcccgagctctctcgtcgcccgtagcgttgccgccacgttgccctagccgctgccgtcgccggcgaccttccagccgcgtcgcgccgccacggtagtcgtcgccgttgccatccgtcgccgccgttaggtgcgcaaggaggtgaggaacctcggccgcccgtcccccttcgctgccgaccaccggagttcgccgtcgccgtccaacccgagccgccgccgcctcttgcgtcgtcgccggccgtcgtcggttgtcgttgggcgctttggtgagtaccatcgggttcgtctcgatgccctctacgcgtaggtgccctccttttccccggccaaggcccctatctccggcgagcttgctaaccctaatcggccgatcgtgggtgacgtcatgctgacgtcatcgtccctttttccttttccttttttcttttttttctaatagtttaaatctttggaaaatcataactaaataaccgtagatccgttttaggtggttcaagttgccaaatttttctaaaataaagatctacatattaaaattgtccataaattgaattaaatttatttagttttttttaaatgggctttaattagatttgatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcatcgggtggtgtgaacctattcctttgttatggccaatttgcattgaatgccctattccttgataccttgggtaataaattgattagcttgaaccttatatattggattggttcagctaaatgctatatgtaagtttgcttagctatgcttagaaacattagcctaactaaagggattaattataaactatgttacattattcttattaattatggttacatttaatggtagctcacgatggttaatcgtgtgatgataattaattgataattaaaacctggttaaggtgggttgtgagcatatggttttgatggttgtgctcatgacaattaaggaccggttcgcgagctactgttgtgaaacattttccgtgccaaccacaagccagcgtgggcaccggctttatctcttgtatagcatgatttattatagtgtgccagactgtgaagtggcgagaagtccatgggggtcgctggggagtccatgcctctggttgtagagggggtgattatgatccaggaatggtgcaccgtggtgagttgtgttatgcaggggataatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctggtttggagttagatctgtacagccgggtatggttgttcaggatggttgggcctgtgcagcatgggtgtgctgttcagtgttgattaaaatttctgattaattactccactgttttgtttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagaaaaaggatccagaaggagaagacgtttggcttatacccagttgagctgcctgtgggagtggagtcggagcttcgctagattttatttttccgctgcagctttcttcatgatgaggactaagtgcctcttaagtaagtatttatttgctttagttgttgatgaatctgtatattaaattgtcagtttgtgtacctcggctgattcctggacgaggattttatgcacaaataagttcggaaattactagtgaatttccgggcgtgacacaaacctactcacatcaatgataatgcagccaaaaggaacttacaataaaccagccaattcagcagttgctctggataccagaaaaactagtgccggtcttaatctttttccaccggcaccaaatatttgttcagccgcagaaactaaaactggattttctgcaccaacaagctattaaaattatgtcagctagttattgtaacaagaacgtacataagtacaatttcctcttgaaaaaagtttaggtactagtatttgatatgtcattctgtgatgtttgatgtcttgcttaagcagacattgatgatctatagaggaaggattggaaaaatgatagtattgtgcaatgtcactactcaagagcagaaaacatgtcaaagctcagcaattatagagaagttgcataaaatagcaaacatggaagaagttattgagtgtgcaaaagcactacataagagctactataaggcatttgctcattcagtctacttctgactcccaacttcccaagcctctttggctgtgtatatcccagggtttacaatttcgatttcggtgatttcggtaggaccgaaatttaatttcgtgattttcggcactttccagaaattttgaaagattttgactggatttgaaaaaactttgaccaaattccacaaaaaattgagaaaacccgaaaatttcggtcagtatattgattgccggtggggtccgaaatttcgaaccgaattgtaaacactggtatatccatttagagatatagaggccagatttctatccattatccaaaaaaacttcccaagcctccattcctcgataactggggtcattagttagttcaaaaggaatggaccattatgcgactctgcactgtttactcgctcctgcagtatattccagtaacactgcaaatgatgggcatatttctttccctttcaaccttcgttgcacattaatttccctcgacgaacgcaaggaactaagaatacattttatttttccagaagttacaaccattaacatattgttcaaccagccaaccaaccaagtacttaaattgtccacaactttatcactaagtgcaaattttttttattctaaaatttatggactaaaaactgtcacagttcgatacatttccaagcaaaatcagtgcaactttttttttttttgtattggactatgtcgtagcaaccgtgagccttgtaccaaatgtgctaggagaaagagaagctattcaatcatacttgtatcatgaacaagctgaacagaatgatgcaaactttgggaggaaaaggtgaagctcaccgatttgaggttgttgttaagcttgagcaagtcgtccgccacaacctccagcagcgacgacaccgaaatgcgctcggcgacgccgacgccggtcgccgccgcgtcaggaatcgtcgcggccggcacgtcaacagcagcaacacctacaccaaagcacacccaactgctcagcctcacccgcccaacaccgccgccgccgagagcaaggcaaaccagcagaggagccgcagagagagaacctggcttgctgggcgagaccacggagcaaacacctggcgcgcgccgcgtcggcggcgccgcgcgtccgacccagccgcaccggagccgctgcggaggaggagggggagaaggaggagggatcgacggcgacgccgcggcggtggcgcggcgggacaggtgcgaggacgacgcgagggaggacggcgccgccatggcttcgtggccgcttgctttgcttgcttgcttgctagcttccgctcccgctccgccgtgcgtcctcttctgggatctcgtgagcgcgacgcggcgggcaacgagaggcgaggggtggtgggtgggcgtgggcgtgggcgggggtgccctggcgtgcgcgcgcggcgacggctcgttttttgtatggcgccgcgtgcacctgccttatcggcgcgcacgagagattgggatagggggccaagcctcgtgctgcggattcgcccacgtcggcgcggcctaccacagcgtggcacatctcgactcttgctttgcggggggaaatatgtagtagtagtaaaaaaaattgcaaattataaatatataggaaaaagtctaaataaccccttaaactttgaatgtaagtccgtttagcaccctgaactttgaaacaggacattcaatcccctaaattttgtaaaaccatttatacaaccccctgaggtggttttgtatagtggtttttatctaatttatatataagttgtatgagtttgatcacatgtcatacactttatatatatatatatatatatatatatatatatatatatatatatatttatatatatatatatatatatatatatatatatttgacttaaatcattttctttgcttcttattagctctcacttacaaacaagtaccaacataataatggtatgatatgatatcactgtataaggataaactaatgacttataactggtgatatgcaaatatattatattagttattcaaaatttttcgtttaagcttccaaaatatgcaaaactatcatccaaaaccaccttaggatgtaatatagatggtatggcaaagttcaggggattggatgtccggttttaaagtttagggtgctagacggatttccatataaagtttaggggtttatttatacttcttccaaatatataaaacggtcaagatttgttcatgtcattataggtaaaacaaatttaatcatgactaaaaggtttacttatagcatagacgaatctcatacgttcatttttttttaattctgcgatagttttcaggttttcattgtatattttccgtctttccttgactagttattttaaacggctgtgcaaaaacacttgcaactttaacaatgaagtggtctgtgtgtgtgagaaaacatggaagcgtagtctattttggtggacctcatgaaattgggaaatttaactatttgccacccttataaatggcaactctccaaatgccatccttatggtggttcttacacaatttctcaaatgccatccaaatgccatccattttctcttattttttccttttcctgatttgtggggcctacaaggggtaaaatggatattttatatggcacatccaagctgacagcatgaggtggcatgccacattagcaaaagtggcaaattattaagaacttttctctctccgatggcaattgtgtacgaaccaccataaggatggcatatggagagtagccattcataagagtggcaaatagttaaattttccgacccatgaaattggtgaaactgtttcttgtttatctttccccgggtcttatgtggcatagttctacatcagtgaaatgttttaaatgcacataaacatttttgtgatatcaaagtaagggaacgcacaccatttttgtcttatatggttgttttttacaaaattattgtgggagcatatgcctgtagtttagagaaatctcccatgttatttgagcattaatctctacgctaagtaatgtaatactgtataatactagaggttggactttgaattgtcgttgtttaaattaaagataataactggaacaacattacaaactggttttcatgtcataaagtatttatatgtaccttacatgtcaaaaaatgattattttaagatattggattaaaccggcctctaaaaagaattatttatatgtatcttacgtatcagaaaataataactgtgtagtaccttgtttatgttccatatcataaaatatttatattacaaattggttttcatgtgacttagaaaaaaagatctactgaaatttactcattcttcattattgtccttagcttgactagcgcaggtgaaaatgtaagaaataaagagaaccagtgcaaagtgcaaaccaggttcttgttgaatccctgtgtcggcacagaagaagctaaaaacaatgagctacaaacattattgcaactgaaaattgtactagcaccgctgactctgttctggtttggacaaggctgtgtggctcaattctcatgttgttcttcacacactcttcattctccactctccagtgttacaatgccagcaattgccacaaattttgacaattttactctctgcaaaaactaattatacaaatgaacggtgcccaaaacttattttaaaaatgacccttttgtttagcgtcaaatcgtgtgccgctgaatttagacacctcagcgctaaatagcgtggcactgaatacacgttgggatgctgactcagactcccatccgcggtggcacgtcattcaacgctagttgacgtggcgttgaggtgtctaaggtcagcgccatacgatttggcgctgaacaaaagggttatttttaaaataagttttaggcacagttcatttatataattagtttttgcaaagggtcaaattgccaaaatttatgagcaattgctatgtaatctttgttttttttttgccaattataatcgatgcaacgatggaacaacatttccttctctcggatgagaagctaaataattgtagaagagatcaatcatggttttctgactttcaagtaaagtgcaactgaagagaggttctggcaggatcacaggctgtccacatctgaaaccttaaagcccattgcttttaataaatcagcagcttaaattcttgtatctgcccacgttctgttatgcatcacggccagtaagtacaaaagttaaatgattaaggttccgaattgaaatttcagacagtatggtacagttcaataacgaacgattacggccagcatttcagtttcagtttcagtcaataatcagcctagattcacactagaattttgtcaggagttttactgatagaatggtattgagaaatgcaactgcagttgttcaaaaataacaaaaagaaaatccatacctttgcagctcttcaggattctgcagaagtgaacctctgtagcggttatcattccacttgaacgatttcctcatgatcatccttatcctttatcatgtcgcgttcccaccttctgctgatctcaagcgcagggcgtccagggtgaatgctggctgcatccctcatagcagcttccgcagcctccaccctctgcctcgtggctcctcggcaatcgaccgtgacactaagttgctggaggcttgcgaggtgctcgaatccgaactcaaaaccgatcttggaccctgtttcctctgctctaatgtagaaacgcagccgtcggagatccggcattgctcacagcatctcaagcccgccaccgtgataatagcttccaaattcaaaccccttcaggcaccggatttgttgactgctgatgataagcctctcctcgggggcatgctgtgaattcaacttgatcaagagttcctcctgtttaatgctacaaacccatagcgaaagatgagtgagattagcaagacacgccatctgctctgggatatgactaatacgcactctgtatatgaccatcttccggagtgtcggaatagtgtgttgagttgtgatccaaattcatttgcacttaataaaggccaacttctgccgtgcacctgggtacgcccgggggtgcgggggcggagcccccgtgaaacggatcgtcattccttctagggttccaccatatatatacctcttgtaagccgccgtgcggcgttgtaacctcaccccagatatagtgaagatattttgctggctagtgcccgtggttttttctcttctgttttgggagggttttccacgctaaaatctcgtgtcttctgtgattgatctattgttttttatcgtttgtttgcctatcgtttcctaacacagtgcagcacaatatgtccatcagttttcctatcaggaatccattgcagccaatgtgtagtgactgaagcgcatgctcacccatcatagcgagagatgacttcaaagattcttcgtaattttcggtgttgtgatcaccaagtttgttgctgtcatgcagcattatgcgaagcacacttagcctggtcaaccgcctcaactcttgcacaaattttatggagtcatattttccagcatccgatagctcctgtaaggcttgtagatccccaatctcatttggcaattctacatcattgccaacaagtagacgcgctaaattttgcaaacgacctatggtcggtggcaattttttaattccactatggcgtatatctagtgtctgcaaatacttcaggtccccaatttgctctggaagctcagtaataccatcagaactaatgctcaaatatgccagccggaagaagctctcaagatgtttaatgtgttgtgtaccgataccatggcaattttcaaataccagtactctcaaacaatgaagtgtttgcagatcaggtcccacatcttgtacaccatagtagttcagtgaacgaagctgtgaacacttacccataatctcctgcatcgctttattgcccagacagttggattggacagatcagggtttacgattccgacaggccctttcgtttcgggcactggcggaattcggaatttcgcgaaattcgatggaaaaccggtaaattctgaacaaatttcataaaccaaaatttaaatacaaattccctgagtttgccgacaagttctcgaaaaccggtcggttttagcgaaattccgatcgaaatcattgaaatttcgatcagtaatcttgcccatgtaagtgctttccttttttaaattctttattattttctttcctatgtaagtttcagtaaatacacacaatacatcatttttttcaaaaatttatatcccaataggttgtatgaatatcatagtatttataagattttatttgattttttttctttttttatcaattcaaatttgaatttggatgaaactcctcgaaatctcatacggtttctactttcgagccttgttgaaacgtcgaaatttcgcgaaatctgaccggatttcatcggaatcgtaaaccctgggacagatagcctacgaatcttgttagaacaattgtacccttccccttgcattagagtggtaaaattctcctccttcgacagggatacgataagatcaaggatcatgtcatgcactcgacaagcactcgctctgccatcatactggatgtcaattggttggatcatgcttctgtttacgagatcattgaagtagttctcagcaacttgatccaatgttagtcccttcactttactaatgaacccttcagctatccatctccatattagcacttctctttcaatcatgtaatcctctggaaacatactaagatatagcaagcaagtttttagataatgtgggagatcataatagctaagcaggagtatatccactacaacaaaaccattgttttaagacgttttacttaagtcattctataagtcgtctcttttttataagtgaaattgaaatagggacgatgtttgagacgctttattagttgaggacatagtttaagacgctttatatgttagcacaaaattaaatcgtttagagacgaatattgagacgtttttggaacgtctcatgtgtaagaaatgagttttgagacgtttttattatatccgtgtcatcgttattagataatatataattatttatatagaaaaagaagaaaataaacacactgttcctaatcgtcatcatcaaataccattataataatattataattatttggaaaaaaataaatatttaatattcagtcttagattaaaaaagaagagtaccgctacaggacgcatgtttgcagagttgcaatataaaaaaaactatctatttaccttcaagattgtcacgttaatgacttggttagtgcatgaactttgcaacctgcaggtgctgtgttcgagcccagatgaaagcattaatatcaaatatattaagatgtgcgtgcctatataaaagtgtctctatattttatagagatgcaatttacacgtctctagcaacgtcttaaataatataggtacgctttaaaaagcgtctccataattctgagacggtgcaaacagagacgatcctacgacgctttataaaagcgtctcagttatctgtgcgagacaaaataaaacgtctctatcttacaaataagatgtctcctttggtttattttgttgtagtgatctgtcattccttgttgagtaaatgctgaaccaatagagttgtacacttcctcccattgctccacaatatttggttttccaacaagcaggctagctacactgataatagctaacggcaagccatggcactttctaattattccacaagagacttcctccaaataaggagggcatgcagacacatcacgaaaaaccctcttcaaaaatagctcccgagagtcctgttcacttagaggttgaatattgtgaatatgtcctgctacagtgtagcagcatgatgtggctacattagtatctcttgtcgttgtaattattctactgcataaattgttgtcaggtagagcagacttgacaaattcccatgcttttgtgctccaaatatcatcaacaatgatgaggtacctacaaatataagtctagcattaaaatttgtggaatatgatgattttatttggcactaaatatggtatttttttatttacttttttatttttttttatatccaaccggatatatgcaaccttttaaattgggaacttagccccctcaaacaacccaatatgaagttcgctcatatggagatttgaactcaagaccttcaggtgttactcaggtcactgccaccactaagactatatgccctttcacatatatggtacaactatttgagatgaacatgctattgtatggacatagtgtgtctaaagccacaatgctttgctcaatgccatcatgccattgcatctttctttatctatactaattaaacactcttgaaggatctttggtcaccgtaaccctgaaaggataaaaactagaaatgtctcatgttttcttttatacttttatgagaaaatttcgtataactacagatttaaacctcaaataaataaactatactttcaatactaactttatcacaaaactacacatttagtcaatcgtaaactatagaattagaatttatcagaaaattatagtttttaaatgttatccaaaatgcaagttgttcttggctaaatattgtcttcattacaaacatctctactactaatcagaggcttttccattccaaaaagacacctattgatcatatacttaaaaaaatccaagaaatgataagtatcataagatacaaaagaaaatagtagaatttatcatatatatctctatatcatatagcccaaaaatccatctactttagtggccgaacaaggattgtgctaagccccgggccaagaccaatggaggtatcaccagcaaaggatacccacaacactaagacatgaccaaaatagaaacataaattcattgtggtgtactggtgtgatatagacgtaaaacaccaaatcggtaataacattttcagtttttcaccagacgtagctgtagatcttcattccatcagtctgttcctgcaagactttttttttttttttttttttttttttttttgcgaattgggttgcggtgttggtgcataaaaagatggcaatgtcttgaccttcttcattttctctcccttacgaatttaacacaaattgaatggaatcaattcatttcttccttctctatcccgtacgaatttaacacaaactgactcttccttctctcccctttacgaatttaacacaaattgaatgtaatcgattcaagtcttccttctctctctctctcacgaatttaacacaacttggatggaatcaatccttctctaagcagctaacatttttgtctttggtttatggacttcgttagggagtcgattatgcatgattaatggtaatcctgtggtgttgaactaatttagctccaatatatattccgtaaaaaataattctaacttattaatagataggatagttgtaatataatagcgactgctatatgttcactgcagttaattttttttttaacatagctagtgttaaccacagtatttttactaaatatatactgcattgtactatctccgtttcattcatattataagtcactttaacttttttaatgcataaaaaatatatacacacatacacaaagtttgtatacgtgtatagaaagtttgtatatgacgcgtatagaaagtttgtatacacgcatagaaagtttatatgcgcgtatagaaagttctatacgtacgaatacaaactttgtatttatacatcttaaaaaaaagggaaaaaatcgaacagaagataaaccggaaaaaaaaccgaacaggaaaaaccggagaaaaaaataaccaaacagaaacgaaaaaaccggagaaaaaacctcgaacagaaacggaaaaaagggggaaaaacgaaaaactcgctccctcgcggcgtgttcgccgccccctctccgcgtgcgacacgtgtccagtcacgtggggagggaggcgcgcgactgatcgcccagtagcaatctcggggttttcgttgttttaagaaaggctctcggtgagaaaaaagagtccgaaaggctctccttgtttaatggaatttaaacatggattacgtttaaattataatatttcgttaaactaaaattgaacagttatattaacatgaacataattggataatatgttttatttttaaataactccaaatttgtttttaaaatagaagtggttaaagtttaaatatgtatactgtctgatgatgtatacaggaacggagggaggaaattttttaaagatcataattttacactccttgttacacgttgaacagctttcagtaagattgactttgacagccccctaggacccaaaagaaccctactgagataagtaatactgcaaaagggaatttcaattatcatttttgtctctgttgaatgactacaaaaggaacatgcaacaggtggcgcaccaattaaaagtagaaagcactaaattaaaccttggtctagtttaacgtgacttgtaccatacacataagaaacaaaaacattgagcaacaatatataatcaaaactgaatactgagataacacacccatgacgctccatttgcaggcaagatcttcattctgccttgataatcgacagtgttatacataatgcagtgttaccaactgctccagtgttccatggcaagctctaagatatcttttctttttttgtcggttacaattgttgcagcaataaatcgtagacgtagtacacgttttcttatcttggtacatttaaacaagtttagaaattgtagaagtgattaataatatcttgcagactttccgtgcacctcgactcgttgagtaaagtgcaacgcaagcaaccctagcctccgcctccgtgagcgcctcggcctcggcctcccccgccaaaccctagctgtcgccgcctccgtctccgactccgtccccaaattctagcctggctgaggaatcagagtagaggtgggatctgtgacatcacagagagggttggaagagacctaggttttcttctataaaatctccagatctgctctgtcaacatggtttgtggtgctcgggctgtggaagaacctgtgttggaggaggtgcagccttgggaaattgcagttgaggagctcagggtgcacctgtaggatattcaacggaaggtggatgaagatgggaagttgtttcaagaacaactgtagaactaggccatacaagctcaagtccacaaagatgaggtaatgcagaatctgaaggtaatccaagatatgctcagtacttcatctagctgcaatggacaagaggttaagggaacacccagaactcctggagtagctcagtctgtaatggaggaaaaaaacctgaaacttttgctgctggtcctagtaaacacccactgtttgatttcagaaatatgtccaattcaccaaatcaggagaatattgagatgaccatgacacccagtttagttactacactacccttaccaccacctccaccaaaccacattcctacaacagaaagaaatacctcagtttttttcaacacaagcaccataccgccgccaccaccaccacactttccccaaccacctcagtacactccacttaaccaattctttccctatcagccacaatatccctatcaaccacatactccctttccggttccttgggactaccactactacccaaacccaccacctcatgtacctcctatatcatctacacctactcacttctgggaaggaggacatggtgctcatcctgaaccataccaccaaccatacaatccatattaccaccaagaaccattccacccaccccaccaccaccagtacaatcctgaaccacaccaccctcactatgaacatcggccacactatgcagaccctgcaaaacgctctcgaaatgtcgattttcctacctttgagggtgactatctggagtcttggatacgcaaggccgaaaaatatttctctttgtatcaaactcctgaggaagacaaagttttgctagctgaagtgcacatttcaggaagagctgatcagtggattgaaagtttagctattgccactgcttctctttcttggcctgaattcaaaaccatgttgtgtcaacgttttgcagccaaatccaagattgaaattactgaaactttcagaaatttgaaacagtatggctctgtcgacagttatattgataaatttgaggacaccatgaccttagttaaacgcagcaatcctacattgactaaggattacttcttggattattttatctctggactcaaggacaatattaaaagacctctgaaatctctctcaatttactccctggtgactgcttatgaacatgctcgcaactatgatgttatccctcgctctgccaacacctcttctgttccttccaacagaaagactcccaaaattccaccaaagcaacctatcaaagacaacaagcagtccgctgtcactcatacaaaattttctggcaagtatttccgttgcaacgaaccctgggtaccaggacatggcagagtctgtaaagctaccaagcaagtctatttggtcacaatggaagatgagtctgaaatcctagatgatgcagcttactctactcctgacagtccacagaagactgatcaacaggatacacatctgttattacactccttggagggcaccactcctgctgctactacctttacactatatgttctattgggtaccacataggccacagccttagttgatagtggtagtaccactacattcatctctccgaagatagcaagtaaagctgggttacatatggctaatcatgcacctataccagtcagagtggctaatggcagtattttgaatacagggaccgtctgctctcaggttccttattctattcataatgtctcttttatctcagatttcagattgttggatcttaagggctttgatatcatctttggctgtgattggatctatcagcatagcccaatcaccattgatctcaagaccagagcatttacaatacatcacaatgggatgcagtcaataacctttcctgatattacttttcctcggtccaatcttcttctcacagctgataacttgcagaagatgttgcacaaagatatattaggtgctgtggtgttccttccttatccacaatgttctgcgcttgctctaactgcaaccccaccagaggtaactcaagttttggacaaattttcagatgtttttgctgagcctactcagttgcctccctctcatgagtgtgatcatactgtaccattactcccaaatgctaaaccagtcaatgtaaggccatatcgtcttcctcaccacaagaaaaatgccttggaagagctagtgcagcaattgttgaattcccaaaccaacagaccaagtatgagtccctactcttcccctgccattctggtaaaaaaaaaaggacggttcatagtgcctttgcattgattaccgtcaacttaatgctaccacggttaaaaacaagtatcccattccagtcattgaggatctcatagatgaattacatggggctcaatacttttctaagattgatttgcactcaggttatcaccaaatcaaaatgcacccagctcacatatataagatagcctttagcacacatatgggccactttgagtacttggtgatgccttttggactaacaaatgcaccaaccaccttccaagctctgatgaacagcattctggccccttatttgtgcaaatttgttttggttttctttgatgacattctcatatacaatccatccctatctatccctatctgaccatgtaactcatgtcgaattggttttgcaacttttgagacagcatcatctttcaaccaaaccaagcaagtgtgttttcggccagtcacaagtggaatatctcggctatattatcagtaatgaaggggtagcaattgatcctaccaaagtgcaagctgtgaaagattggcatgtatctaaatctgtcactgatctcagaggattcctaggtttggctggttactattgtcagagttatggataccacatacctaatagtaattgactaaatcttggcaggacccaccacataccatgtcttatacgggaacaacctcagatataggaggagttccgcataaggaaagacaaccagagttctacatagaaacgacaaggactactcggattgtatccatattggttttcctagttctacttggacaaggggacacctatgggtataaatacaaggccccctaggaggggaggggacatggaacaatagatcaacatacaaacctacatacgccaagacaaactaccagatatcgacatcagagataagcctaggaaaaccccatatggtacctaccaaaaccaaagagaggaatctagcgctatctctgacttcgtcggatgcggattcgaggaggaaggctaccatgttgtcggctacgagttagcacttcagaccgccaagtcgacaacagatagataggctaccccaaatattgtactggtgtgattatggtgaataagagcaacgaccggcttcggccaacaggagtagggttattacctgataattcaggggcccgaacctgtatcaaaatccctgtctccatctcttgtaccttgatctcgcatataccctggtaccaacgatccccctactatgcaaataccggaatcgcgatatcaaacgtcgacagtggcgcgccaggtaggaggattttggtgcttcaagatttcgacgagatgggttcaagaaatggattcttcaacaacaaactactcaacaacttcgtatgttgggtgatatgacccgaacgaagtacattctccgacggatcgggatcttcgtcaagcttcgccaagtcatcgtcactatggattttttgatgagggatacttcaactactttggatctaggaagtttaacctagccagagatacgcgccccgacaagatcggaaccatcatcgtcaacaatttggactatcgagatcacccaagcctcaagatacgcagtataccaaaagacgtcagatcatatgatgtcgaacgagtacgcagtaaggtaattggtggatggattttttaaatcaatctactaattttgtagatacatccggcatgtatctacaaaggtatgtaatattttatatataatttaccgtacctattttcagattatacaatattgtcagatcaataattattatgtttacctagagcatgttttttatacaatatctattgtgcgagtatttccgatgctaggccgactacggtttaatgctgggggctcgctctattttcttatgcataaatcatgcttgtttgcggtttacataatgcctgatatttaatttgctcgttatattgtcgggtcccaaaactaatgattcggtaactgacttattaaaactgtatcaagccctggatcagtagattgatacaggttcaacaatctggatcttcatagcatacattttgagatgttattataaaataataggatatttacaagtttgtggctaactattacagtagaagctgtaggatgacccaattctaatgttttgctatagacttaaactatctatctaatatatgcttgagaactaagttagaatgagactaacttatacgattgaactcccagcttcggcaagactccaaattgactctgaaaagggggttgaggcaagggtgagtacaacgtacttagcaagctatattatattaatcaacaatgaatgcatgaaatggtaatatttgagtagagctaagtttacttgcagaaggctgagaatatagaggaagaaagcctgtaatgttttagatgcaacagtatttaataaagtttggaattaagtttctaaccaaataccatatgagtcccaaatgcttaaatccgtgagcacggctattcgaatagattcatttatactttactgcagtaaatgtacgctttacccatagcccacgacgtgccgataatcatcagctttagtcatggcccagcattaggttactaacaatagtggcacctgttccatgaactctagtccccatacgctctgaacataacgttaacagcaccgagaggagttctggcgttcccggggtatttagagaggactgattgtatgacaccatgtcatcgcaatcagggtttacaaaatcacatggccataatatagtcccctggactatcactcaaagtatatttacctgcgcctcggtaaatatcataactgccctgctcagcataagttttcctcctgcgcgaggacttaaaaagaaccactgtacataggtaccaccttgttaaataacataataactaggtctgttcccattctagaactgtggtcgtactcgtttgttcttcacaagtatttgggcagtcttatgtcggttggaacaatactagccacccagaaattaaccattttctaccgtactgttccaatcgtttgttcttcacaagtatttgggtagtcttatgtcggttggaacaatactagccacccggaaatcaaccattttctaccgtactgttccaatctaagttcgttatattttatgcaatctaactaggcagggctaagcaaaagctagcatatctggtttgctatattcagtttatacaattgaaatcatgtatgactaatgcatagaatagagatataagaatatatgatcattatgctcaaaggggaggaataataacttgccttgctccaacgcaaataaatccaagataagcaacctgattatccgctgctcgaaataccacgggttgtcatccaaatataatagactctactgaaaaagaggaagaaccaaattcaataaacgccataaaatagcaagaaagagataaacggttaggagggctagggtttaagatatagccgatctcctttatagagcattgggattattggactagtatttcatgtatgggttctaaagggttgaaggttaaggtggagagtggatcaagcaaactaaggttgctcataatttatgtgaaggctttgactggtgaggggataggatgtatattggatatttgaactggtttagatggtatatggctagtggtaggtttaggtagtataatacctaaggtttggttatatggaagttgaatgtggagtaggataacatatcggctaactctatattttatgtgcggggttctaagtggatggagaatatatgatgggggtgaggaaagtggcatataggtaattataactggtgtggagtatggatagtaggctggctaaggtttcatttgtttaagccgatatcgaggtaggataaatatcggctagggtttgggtgtttgctgggctttacaaccaactgttcgacgtcggggccagtagatcgcacgaacgtccacatagaaggtgtaaagttctaaccgacagcttttatggctaaagggtcttttgaaaataaaaggaaatatttggaaggtataagtttcaattataagtttaaatcaaatatttattcaaatggtatttgaataaattaaggaaattcaaataaaatcttaaaatagcaaatttggtatcaaaaggtatattttgaatttagatgaatttagatccaagtttcatcggaatcggatctacggtttgggagatatgggcttctaaagattggattttgaattaaatctagaaaaatgcgaaaatgtactgttggggggcccacctgtcaggcaatctcctttttctttttatttttctttctcttcttcttcttctttttcttcttccttctttcttctcttctcctgtttcttcctcccgagcaacaagagagagggagagagagggggcgccggtgctttggtggtggaacggcctcgacggcggcggcaaagcgtgttcccagatgtttcatacctaggtaaggtggtggccggcagagagagtgagaagaatggttggaacgccggccgcaagagcttggttgaagtggccaaaaggagaggcgatggtggcctagctaggggtggagggagaggggaaagtggtgaaatggattcccctcgttgagacgaagctattggcgcaagggtttggccggtattgcttcggtgagggagatcgggcaatggccggcatgggaggagagagagagagagagctcggggctcggcttggtggggaggaaaggagaagtgctcgccggctatatatagacggcgaggggcggtgatcaatggcggttcaggaggcggacgacggcttggccacgacgacagtagcttggaggagaagaagacggcgccggcctcgttttccaattggtcgacgacggcggcgcgtgcacgtggcggccgcggcagggctgggcggcggcagtggacaggcacggcacggcgacggtggcggcgcgacttggcggcctcggcaaggtggcggcgacggcgcacaaagccgtgggcggcgacgccatggctgtgggcgacggtggcggcgccttgcgcgcccacagagaaggggaaggaggcggctcggctgggtgttgggccggcttgggctgaggaaagctaaaggaggaaaaggggaattcggcccaaacatagaaggaagaaagtctaatatttcatggagactaaataatttgatttagaggagaatttgtatttggaaggaatttgactagaaagttttgaaagaaaaatatatttggagataatttgaatagggaaggttgaaaggaaattatatttggatctaatttccaaaagagatattttctagtttgagtgcaatatttttagaagtggaatatggtggaatttaatgcactcaaatgagaggggaattaacaatctaattcctcaatatatatatgtttggaggggaatggttggaggtaaaataaataggatttgaatcctaaatttgatagtaggagtatttgaagaattatttgtggctaatagagaatcaatttggaagaggggaataaaataaaaatctattcttcttagcacaagagcaattattcacaatgtttataataatattattcttgtgctgagaagaaaatcaagtcacagaaattaaattggtagcttgatcaaaaagaggaatttggatattttgatcgagaatcaaaggatgggttaacacttaattctaatggaatcagaatttcggtggtttaggttcaagggtaatatgggaaggtttcttggaccataattcttaagagagtttttaaaggaattttgcaaaagaaggtttaaggtgcaaaatcaaatcaaagtaaataccttggtttaataagatcaattttagaataaaaaccacgaaagactttaaatagcaaagagagattctacgcaagttaatttttcgaggtctctctaattatattttcctaggtttaaaaagttaataagaacataagaatcagcatgatgcaagattagaaaatagtaaattttcaggatgttacatatatcatgataatactagaagatttatgcaagtttttgagtacatactcgatattctctgctatataacttgtcttctagaaaatatttttttcaggaacaattgagcactcgagtaggttatggtcgagcacaccccattatcgagaacgttctcgacaaatgcagagttgtcgcacccaacctaccaacgaagaccgacgacctatctcatagcgccaactatggctgggctattcgagaaaagggttgttaacggataattgcttgcgaacgatgtcggcttgatcactcgacatgattgcaggtggacatccggatatgctacgagttgggtatgtgagtcatgctagtcacatgagatgcacatgtaataaaccaactctagcgtccccatcggtgttcgagagataattctacttgctggttctcgaaccagtgaatcgtagcaatctctcacaccgcaacttccatcggtgttcgagagataattctacttgctggttctcgaaccagtgaatcgtagcaatctcccgcaccgcaacttccatcggcgttcgagagataattctactcgttggttctcgaaccagtgaatcgtagcaatctcccgcaccgcaacttccattggcgttcgagagataatcgagaactagtaaattgtagcaatctctcgcgccttaatttcagatggtcgaggtacgactacggcaatagcgtagcggtcctcgcaccacgacttcagatggttgaggtacgactacgactggtcttcaaccaacagcgtagtggtcctcgcaccacgacttcaatcggtcgagagataaggctactcctggttctcggaccagtaggccatagcgatctctcgtacatcgacatcaatcggccgagagatgagactactcatggttctcggaccagtaagctgtagcgatctctcgcacctctatttctagtggttgagttaaggctacacctggttttcgaccagcggtgtagcgatactcccactagctttacttctcgtggtcgagttaaggctacacctggtttttgaccaagtggtgtagcgatactcccactagctttacttctcgtgaacgttgtcggcttgatcacccgacatgattgcgagcaaacatccggatatgctataagttgggtatgtgagtcaggctggccacatgagatgcacatgtaacaaaccaacttaggcacccctataggtgattgagagactccttctcctggttctcaaaccagtaggacgtagcgacctctcgtgacttaacttctgatggtcgaggtacgactatggcaatagcgtagcggtcctcgtaccacgacttcagatggttgagggataactacgactggtcttcgactggcagcgtagcggccctcgaaccaactttaaatggtcgagagacacctactcactggttctcaaccagtcaatcgtagcgatctctcgtacatttacttctaatggccgagataaggctacacctggttctcgaccagcggtgtagcgattcttccactacttccacttcaggtggtcgagttaaggctacacttggttctcaaccagcggtgtagcgattctcccattatttccactttaagtggtcgagttgcgactactacctggttctccaccagcagtgtagcaattcctccgactacatccacttctagtggttgagttacgactactatatggtcctcgaccagaggtgcagtgattctcccactacctctactccaacaaagttgatatcaggtacacgatattgccaagtgttttacccagagatcccttgccacgacgacacctagagttgaaaccaatcctactgtccctttatgccgtcctggcaaggcctctgaggaacctaagggaacttcggctggggacgtccagagcggataaggccttgtcggatcatgcagagacaaactaccatgtaagatctggtcatgtaagagttctcaccgtgcgtattaaccaagccgtttaatcggaaattgggtttttcaacttcacggctgggggctagggtaagcgttttttcaaccaaggcaggtcaagggtccaagagccttatcctccgagaacgattctccgacgacaaggctgggggctagggagagtgtatgactatattgtctccatctcttttacctcaatctcgcatatactctggtatcaacgatccccatactatgcaaatactgaaatcacgatatcaaacgtcgacaagtatcgaaagttcaataaagattttggtcttattggcaaaccactatttactgccttgaagaaaactggattcacttggcaagatgagcagcaacaagcctttgcaacaatcaaggataaattggctcatgcgccagtccttgcaatgcctaattacactcagccttttatactgctagcagatgctagtggtaccggcctgggtgctgtcttgatgcagaacaacagacctttggcatattttagtaaagcaattggtcctaaagcagctggactctctacttatgacaaagaagcattggctatattggaagcagaaaaagtggaagcactatttcttgggcacttctctgattattcgaacagaccaagcaagcctcaaatacattaatgagcaacgccttacaaaagggattcaacataaattgctaatcaagctcctcaactacaattacaaaatagagtacaagaaaggcaaagaaaacaaggctgctgatgccttatctcgcataccttttgttgctcagtggttttctaccactattattgttcctacttggatcattgagatcctggcaagttatgcaacagacccgaaatgcacagcattggaatctcagttgagaatcactcctcagggccatccttcttatactctgactggtggcatcttgcgatataagaatcgtctctatgtgggtgctggtactgatttgagagcaaagttacaacaatctttccacgattctgctctggggggtcactcaggtgaaagagcaacctatcaacgtgctaagttacttttctattggccaggcatgaagaaggatattgcctcatatgtcaaactctgcccagtttgtcagaaaaacaagtctgaacataatctgcagcctgggttacttcaccctctgccagtccctgagatggcttggacacacatttctatggacttcattgaaggcctccctaaatctgataacaaggatgtcatttgggtcattgtggacaggtttaccaaatatgcccattttgttgcccttagccatccattcacagctgaccagatagttactcaatttgtggaaaattattacaagcaccatggtcttccggcagttattgtcagtgacagagatataattttcactagtcaaacttggaaggatgtttttgagaaagccggggtaaaactacattttagtagtggctatcacctccaaacagatggacagaccgaaagggtcaaccagtgcctggagaattatctttgttgtatgacattcactaaacccaagaagtggaaatcactgctggcctacgctgaatggtggtacaatacatccttccacactgccttgggcatgactccttaccaggcaatacatggggtcccacctcccttgctagctgaatctttgctatctccatctcttttcactgatgctcgtaacaaggaagaagcaaaatctgtaggatcgaatcacaagaactaaaccaaccagaggggggtgaatggttggtatacccaaaaaccgaaaacttttagcggaaataaaagttaccctcgaattcaacggagatcggtctgaccgagattgatttgtcggtctgaccgtgtggatgccgccagtctgaccggtatagatcacccggtctgaccgccgatgtcgcctgccgcgcctgtcgccgccgccggtctgaccgcccgtatgccgccagtctgaccgccgcttgccgccggtctgaccgccagtatattgccggttggaccgccgaaatccggtgaaacacaaatcgaagaactcttaaagtagataacgactttattacttctctctgtatttacaaagtgcaccaacagcactccttacaaaaatttcgactaaactcgaaaccctaactcaaaactcaactcaattgctctcaaaagcgataccgggaagcctcacgctccccctctatttatacatgaggtaggcagcctaaagccacgaatcaaactcatactaggaatcctaaacactttaggaaaccctctagtacaagaaagaaactttacataaccaatcgtaccaaatttggactccttccaaattcgactctgcaacccatacgcacacaatacctccatcgtatgctatatggaatctccatcaaccacgtgcatcaactctagcctaaatatcccgcatgatctctgaccaccacggacgtcgtcttatccccaagccgactcccggtccatcaccgcaaatactctctcgaggcatcgagtcacctacacatgcatgaaataaacaaagaaaccatattccgagaccaagctatctccaacttgactcattagtagcaaacaacagtattacatacgtatagtatccatctagaagccataatcatgaaacaatcacggatatccaaataaacaacccgaaaccgaaactgacacagagtcggtcggtcagaccgcgggctggccggtccaaccgctcgatcaccgccggtctgaccggcatacacagcccggtctgaccggtcacatgaaataacagcagtatcctgtagattcacctgtaaaatccaatcatctccaaaatccacttcgaaaataaattccaaataacaaaaccaataatctccaatgccaattgtttatcacagaataataataaaaaacacctttgattttacaaaatctgttattactgctgatatcaagtctagcctcctcaaagcacaagcacgtatgaagcactttgctgatatgaatcgtagtgaacgagtactgactgtcggcgatatggtttatctcaaaatgcagccttagtgtcacaattccttggggttacattcttccttgaaattgcattctaaatactatggcccgtttcgtgtcttggaacgcattggctcagtggcttacaaattgctgttaccggcatcttctcaaatccatccagtctttcatgtgagccaactgaagaaacacatcggtccaaaagtggttcctgaacctggcctccctctcactgatgatgacggtaacattctttctcagccaacggccgttttggaacgcaggctgattcctagaaacaatgcacctgtggttcaatggaaagtccaatgggggaatctacctccgtctgctgcaacttgggaagatgctgctttcatctccaaagtgtttcctgcttttaacccatgaggacatgggtgcttggggggggggggggcaatgtgagaactctgacgaagtgaagtcatgtttgaacgctggaagagaaggcaagttcagttatccaatggctgggattattcgataacgcttggggctggagattatgaagatcggacgatggagatgcgcctggaccgtctacagcacgcccctgttgccgtactgttgacatcatctcttttgtctcgttgtattagcgaccccctttataagctagcaccgccgcaatgtctgtatcgaacaattgaaccctaaattactttactcttgtcttgcggtgcccatctatttccttatactgtttactcttcaattcagtgcaaatccttcaatttaatcccactagggtagctacttagcctcttttctctgaaattgttcttgtcaagctctgaatctggctggggcttgacatctcacgctccgccgatgccgccaggtgccgtcgttcaagatcataccggcgaagtcccacgctgagtcaccgcgacgtgctcgatgtgcgccgtgatgtacctgccaaggtcgtcctcggcgattgatctgcagcagcaacctcatctccaccgcacagtcaggcatccacacaatcctcgccatgcgcgtcctctctgcgtcccgccctgtcctcacagtgccgttcagacgccgaaccaggttagttcatcactaattcatgcttcgatcccatgccattccatcgaaacattgatcaattggcttctcagataactgacttctcatataattgatgcaaaacaaatttcttgtttagatattacttgcctcgcctaaatgtagatcaaacgcaggatgctcaacaccgcaattgtccgccgggacaggtaaatactcaccaatattccttttgtagtgctaatacaaattcatatatagtgctaatacaactgcctttctattatactgctaatacaaattctgaagcaatcatgtagaacagaaaacacattttcgtatgcctctcactttttcccaaatcaatattttttttattactccaaattcatgatttgtcgcctattagagcatttcaatttattctctgaacagttaaaagattgcttatttactgcaaaaaattgggaaagctgaaaaggtctgcttggtgacattactatcatttaaaggcacaggaattaagaagaggaaaaaggattgggatcggcacttcgctcagctgagcagaaggcctctgtcctctctgaccgtgccacagcgtttgggcccttttgttgtgccgttttcctgctctcttgaacgtatgcaagctgttcgctgatttgcctacaccaggtcagctaaactgcaagtaacccacttattatgttatttggtactctcagaccacatatacattcttccatctatgtcggttcagccactgcttcatacttgctttgctttgagttttgtttgctctgatctgactttcacattgtttttgtgcattgaagactggggcttgcttctgtagctcaacttgattaagccacaaaattatgcgctttgtatggcaaaagcaaagcactttgttgtcaggggttgttttaaataataatggatctcctttttttccagccttgaatattgtcatgttgctggaattgtaaccggactcacaaattctccgctaatgaggtaatcatgcacttctcccccctattaatattttttaatcatttcaggaagagaaatagataattgttgcatgcatcctcagatatcaaagatcaggatcaaattttcatcctgctaacttaataacccttgtcctatcaatgggctatctttattgcaggaacgttggttgtgtttcagtcaaattttatagctcaccaagcaatccagatttctttaaagctcgtaatatattcaaaaatttataacttcttttcctgccgccgaacaggtgctttcctttatgcctaattgttcacttccgcgttatatatctctaggtattctgtgttcttacttgaacaagtaagttatgctgcagaatatttgggaatttgtggtacttgttatacctgaagtgacccttattatatagcttatcttcaggccacatcacattaagttcagccaaatatgagcataggtctaactttgtgccgccaccaccatctccaagccggcggcaaggtctcaatatcgggacgagtgcggcctttatgcaggtcacaagcagtgtagtaccgcctcggcggcagtcctatgcccgtcgggactggcatcttcccgattccgacgccaatggatgcgtccctgctcgcgattcgtcgctgacgttacgcacggattccacgccgccggccactgcatcggtacccccgagaccctgacactatccttccatattgcaattgcccaactatgcttctttctgcaactttgttatttttccttataatgtcatatacatatactccatgtcaattaccttgtgcaaaactatttcgtcccaatagtgtttttttcctgtgtatcattgatttcagttgattgtgatatcatgaggacacagccatgaaattcagctcacttggtataagtattcattcctgtttcttagagaaaatcaaatgtacatttattaaaaattgaaagctgggggcgagcaagccctacatttttagcttttaaccttatggctccagcaatttcgattgactgtaattttgtttagtttggtatatgtcctgattggatagcctctgccagctgagtacttctgacagaatcaaacattgatgcctgcaatttttgtggcttttgtcattccttgcatggttgacactcttccagtcagatggtaccgtggcttttctgtattttgtgatggtgaaagccccagtgggaatgtgggatgttcagtactagcattgtgtgtagtttgtattcatgctacaaaatgcctctcaaggttctatctgaaatttagatggagaaaatttatactggttacatttcctataggagtttcaaaaactgatatttgaccattgggcatattaattctctgtaggaatataaaatatctatctatatgaattttgattccagcggatccttgaatttgttgttttgcaatgtggagagtagataacagacttaataatcattggttgtacatcatagatcccaggaaatattggatcaattgtgaggacatgtgtgcagcattagcagttgggctgcatcttgtcggggtaaggttagtttatattgatagaacattgaattatatttcttcattttcctttttatgttattcatctggtacacatgttgtcttccagttagaacttacaagtgactgaatgtattttcggcacacgtgatctagctaggtgatactgggatgtgttttgccaactgatcatgtatgagttcaaagagtaaggtggatttgttaatcacaaatgaaaatttagggtgcatctcaagcattggcgtgataaaaaattcagagaagagtaaaactgatggtgagataggtaattttggttccctgtattgatctttcattactcaccgtaaaagacatgatggtaaaaatatagtttactcctaatggttcaaaaaagttctggatgcattgcatggcgcacaatcctttgattcggcctaataattgtcataggagttgactaatagtaatataacctaattttgcattatttgtactattattttagttttttaaataaatgttttcctttgatgggtctatttctaaatgcagagagtgcatgcttatccacagtcaatatatgcagagaacaggttgattatatatgaaattccagtggaaatttctcgagggaaatttgacaggccagaactatttgtatgcaaattgcgtggcgaaatttgaaagatgttatatacatgtggaattgttaaattaatttttattttgttaagcaacgtgagatttgttagatttatactactccctttggcaaaatcaatctactatattgggcaaaaattttgtgacgtttgaattattttgtcttcggggtgcaagtttaagcataatttttttatgctaaaattttacggtataatgaatttatttggtaaatcatttagcattcacacaaatacatataatatctttgcttgattatttggttttcaaatacatataatatttatttgattattcggttttcaaagaaatctgaacacttgtattgccaatgttatcttttttgggtcatttagtttgcaatacaaaatatcatcgtagcgttagtacggacacattactagtcattagtaaggaatccaaggcacttaatcaccattaggtggtagttgtgcatttatcatatgcagcacttttgctgtgaattacattctggactatatctcatgagttttttttttaccgtccttcgtatctactgatacctctcggtgcctgttatctcgtccgtccgttcagctggatccaagagcctaggatgcaaggtacctgtcggcacagctcctaacaggtacctataggacccacgtagtgctgtcatgtggcggcgcggcgctgctttcccgctttccccttctttttatgtatttttcctaattttgttcttcttttttttttatttttgttcctctcgtggtgcggtgtggcacagagaggcacgcattggcggccaaccattctggaaatccctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatgggcattcgccggcgataccaagtcagctttggtggatttctccgggaatagtaaaaatggaacaagggttgggagcagagttcattttcgcgattatatcagcgagatgctaaaaaaaatctacaaattcttactcttcttctactttggtctacagtaacgtattatgcaacccctcctgctataaagtagtcttaaagctgtgttcgctagttgaagttgggaacacttctctcattgcacgcaaaatgaaatgatggtttagcgcatgattaattagtattagctaaaaaatcttgaaaaatagaatgatatgatttttaaggtagcttttgtatacaaaacttttgaaagaaatgacaaaatttgctacaagacactcaaagaatatagtctttgttgcgggacaccttaagaatgtgaatttgctcaaggacactaaaaaaatatggtaatttgctggtagacactatacacattattttataatttcctgctatttaggagagaattttcacaaaatggcacctttgcccctgagacaaatcttcgctgacaggatcaaatccggtcgacttagcacaaaatatggcctcaccgcccgtcgctgtgcccatatccgtcatctgccacaaccgtttgtcgcggtgtgttctcgccgaggacggcaactccgtccattcgaggatggaggtctgtgttgacggttgttatcaaccaattttgaccgtcaatattattcaatcaaagaagaatagctatgtttgtaatgcataatttccaaataaaatatctacttccactatgtgctatgctactaacatatgtgcaggagaagcattcataaatggaggagaatcgacggaacataaccgaataattaatcgaaatccgtcagaggcagacttatgggtggatgggcctccaaacctattaagataacttcaattgggccaaaccaccgcaccacttgactgaggagtcattaggagacgcacctgccgtactataggccaattgggcaagtccaggtttcggccgaaccctgatctcagccgttggctctcccctttggcttggatgctccagatgcctccccaatgacggttgcagggtatttccgacatttccaaaccgctgtaaccgtcaatgggagtctataaaaggacctcacctcctcacttcatccacacactcaagaagaagatcaaagagctctctctcaagtttagttagtgctctagtgctagtggagtagaaatagaatagttttcttagtcctcgagtcttttggagaatccggatatggctctagaagcttctctctcttcttttgtaagacttatcaaattaatagaatattcttctttatacatctttggtattttattttctttatattatctgagtatcgattttattttatacttgtatcgatatagttgtgtagcatggatacagagtagtatttaataatgtaagcatggtgcttagatcattaagtatcattatctggatatatatgctgcgggacagtagaggtgggccactgatggtgacagctcagtacgagtattcctccacgttagtatatattcctaagaaactttcctaggaagggtactcctccgtatttaaccccggttggatagccatgacaggttatcataaggaactcgacaatcaggggtggcttctcaaaacactaggagggcactgttaggggtattggctgcatgactgtatactaggaagtgtaaactaaaaatgattgtatattagaagtacatgaataaattattttcttattctttctccacttagtttagattatattttagtgagagtatcttagttcttttttctgtgtgtcacctttatcctaccttttgaattatttaacccctgcatagtccttgatgtatacaagtaatatatataaattattagcatagttctctcttatcatatcttcccttgggattaaataaatacgataccttggaatacttctgggtgaaatgatacaatgttatatccgtgcgcttgcggatcatatctgtagccataaatataccaataatattttgacgtcattactgggaattatatttctactaatgtcgttaagaaatatcaacagtctggtcgagcggggagggggcatcgagcgcactgacgacagaaacgaggaacacatcgaagaggcacgtgggggtggcgggagatgcagacggcgatgaaggtggtacggtcgaaggtgacgcggagggggcgcactagcgcgcgtgacgtccggtcccaatggttgggcgcaatcatgaataacccgtggctgcacaccgccgcctttaggtcgaacgatgtgacattgggggagatcacgccgcccagcgagagctccagctccacggccgcgtgacgctacagtcgcgcagtcgctgccttctagagacggcatggtcggcgacggcagggatgccccctccccatgcgtgggcggtgtatggcggcgaagcggtgtaaaatggacaatttatgtggtttctttatcctcagctaactgaatattatattttaatgctcatggtgtactctggtaaattaccatgtttttcgagtgtcttcagacaaattcgcgtttttacgatgtctctcagcaaataccacatttttttagtgttctataacaaattctgccttgaaaaaaatatcgtttagcggtttgaaaaacgtgcgcgtgaaaaaaggaggtgagttgcgaagtaggggggaagaatacagcctaagagggattgcataattctacaagaattggagacacaagatgtgagagtgtgacaatattctcattcattctcttctctagcggggctacaatagtgactcgtcgaggaaagggggacagcggatccatcctcgtcgaagctcttgccgtcggcgaggagaggaggaggacgtggggaaggcgacagtgactgggtgggcagtggtgatgtgggtgcaggaagggcggctgcgacgtgggtgcgggacttgctcgtcgccactgcagtttggggagctcgaggacgggcgttcagcttcaatgacaggacaggatcctcccacaactatgcgctctcccatctatcgtgcgctcaaggagctatacctcattgatgctgttggttggcgccgatgctcgagttggagatggcgacagcattcacgaggcgtgggccacaaatggaagagaagatatggatctaactgcaatgattgaaaactgaacggcgatgatatggataaaattttgagtaaatttcacaaaactacatgagccaaagagcgttaaagggtgctaagcgtatccaattgctgtccagggacctcacctctactcttcatcccctccatccagggaaacaagaaatagagacgcagaagattgatgatctatcgatcgaaaggaatatgcctcggttagcaaggataaatcctgaacgacttgttctagccattggccggctctagtcaacttgaactagcaaagagaagctcatgtcgacccgtggcccagcgctacccaatggagacaaggcatggcccgaactatctttcgttttgttattcaataggcaagggcaagagtagtatgattgacgcagttacctagtgccatgaactcctcggttccttcctacccttaaggtaacagcggcatcccacctcttttgagggttcggcaatgattgaccaaactatcacaaaactacagatttaacaccaaatttatcacaaaactacagatttaaggccaaatatcacaaagctacatatttaatattgaatttaacataaaactacgtatttcagagtttgaatccctatcactattgttatgttggagctataaacattgtagttttgtcactaaattggttccagttttgtgttaattttattactaattatatagttttgtgacactccatcttaaatgtgtagttttctgataagtttgatgttaaatctatagttttattatacaacgagttaaatctgtagttttgtgataatttggtcatagtatgtgtagttttgtgaaatttactctaaaagtttagaaaatttcagtggtacccagccaaaattgcgtatactaatggtattttccaacatgacaaattcgcaatggttccaattaaacaaaaaaagtcttgctcaccttatggtgcacttcaattcttttaaatttcattgtaaccaaatttttaggtaacaaactaaaaattattaccatatcaaaatttagcatttcagaagcttccgctcacaaatactactgaagtttgaaaaggcatcaaactaatacacatccaaagctatcaaaatttgacaacgccaaaatgtgccaaaatttggcattaccaaattttactaaggttgattttggcaacaaagtgaaagagcccaaaagttcaacttttaaaccaactgagtgttgtggtgttttctgtttttcctgaaccagaaaaactcaatgagattaaactgtttatatttttgctttaattttatactataaatatgtttgtgtgttgcaatgggtaaaagtgttttttacagtgatacaatagctattaggtgatgagtaataaattaaaatattaggatcgctatatattataattgaaaaggtgtttgtctcctacctatctccctttgttcggccgatctctcttaacatccagaagacagtttgtgactgtacgatgcaggagccgatcatccccatcaaatctaggatcttccaaaatagattgagggattttgatccactcgatcttctctttccgttttcccaaaatcgaagtgaacccacaaaactcgggataaaaatggctgaggcaagatctttggccaaccatcattggcaactgttaaaaggagcttaaatctggcgaattaaagctgaattgaaaaagaaaatcatggggaaaaggatgagggggagtggagaatcgctttttgcaattaattagagaagaaaacacatgggaaggcaaatcaatatggtggcggcattaggtgcccgtgtggagccatggacgactcgagcacgagaaggagtcggaccacgaggaccaacggacgaacgagtttttttttgttggaagcaaattttgttttttactaggaaaagtgcccgtgcgttgcaccggatgattacggagtgtgtatagtgacaaaaaagtgttgctgagggacctagaacagactttttctcggcctggccggtcggcccacgacattttatgtacatgtgcgggcgcttcccacctccccaggctgcaacctgggcctgggccggggaagcagccccacgtgcgcctccacttgggccggattcagtccagccaatgccggccgtccgatcttagggtttcgatcggacgatcgggcggtgacgtcagagggacaaaccccatccctcccagccgctggtgaaaaccctagcctcttcaccccctcgccccctcgccagaaaagcgaaaaccgacgacgccggcgcatgccctctcgctagtgtgcgcactcgcccgtgggtgagtgcgccgccgtcgagtggccttgccccggcacccctccccgtcgtctccccttcgtgacctcgtcttccgcgcggcggcggcgctggactccccctgcccatcagcaacgaccggcggcgggaggtggcgtgcaggggcgattcctgccctccaccagatctagtgggagagaaggagaggcggtggcggcctggcggcccagcggcggcggcgtcctcccctccgccggatccagtgggaggggaggcagcggcgacctagcggaccaaatctggcgtcccagatgcgtctcggatccagcgagaggggagggaggcgatggcggcacggcctcccctccgtcggatccagcgggaggggagccggcggcggaccggcgtccctgcgacggcagcgacgacggcaccctctctttccgttatcaatttttcttcttgtgttcttgtgctcttgtctccgattcatacttcagttttatttgtgctctttcaattagttaagattgaaaggaccttaatgtcgcctagaggggggtgaataggcattcctaaaaattatcacaactccatagcatattagaatgatgagaacttttggttcaaataggaacttccgatatgagattggaagtttcggtctcaactgaaaagttaggcggataatggaataaaacactagctatgaacttgtagctcaaataaacaaaatatatatgaatcaaaaggtgacaaataaggtatctaaacaagatataaggtcaccaactaaatcaattaagcaagcaagtagatcgggtaaaaacaaactcaagcataatatgagagaatgcacaaatgggcaaaccaagagaggagacgcgtgatttgtttcccgaagttcagatccacggatcctatgtctccgttgaggagccacaagggccaggcctatttcaaccctattccaaactttgaactagagaaaagtttggaatgacgaatcctcaaacttttatattagaatctttttcaaaaatgcaatagatttttatttagggagatagatcattttgagcaaaagcaagatcataaaagataatattgagaccattttggctattttgtttcacaaatggaaatttttacttcaaaagccttgcaaaacatttgaaatgcatattgaagcacttttgagaggattttcacaaaatttggtctcttaaatgagttttttgaattttgaccaaagaggctatttgaaattgctataaatccaactttttgaaatctttcatattttgaaagcatgggatataaaaatatgattaagaccactcccaattgatgtatttaacacattaactccatgaggtcaaggtttggaagaaaagaccaagtttgagcaaaaaactacacaagcttctattttaaacatttttcttccaaaatgcaaacacaaataaatgagatggttttggagtgaaatgaatatgaatgaaagttatgtactcatttgagctagtatgatgcatttatgcaacccctacaatgagaagtcatctaagtgctaataggtggacatttatggtctagatagtattttggtcaagattggaatctaaatttcttttgattggttggccttttagagaaactttgaataccaaaaatgtttgaaatgaccaacactatcattttacttttaaaatcactttaaaattccttttagaattaattgtacaaaattttgaagttaaaagccaaaacaagatacttagaactacattttgggttgaaattcattttctttgaaacttagttcttctttgaaatacaaaagtattaagagacatttcaaacatactttaaaatcatttccaattagattctcatagaaaggctatacttttcaaaattttcacttttggctaaaaaggatattttgaaatttccaactagcacttagtcaacttgagcacatatgatggatgtgatatgcatgaatatgaatgagcactaaacactcacaccataacctatcttgctcaagaatgcataaatgaggtctttctcatatgcaaggaatacaattttttaaattctatgagaatgtaatgcagcctacacaaggttatataaaagataattcaatgtagatacatgttaccgagataacattgattcttgatgtgaattttgcaatggttggctccaaattccgaacttggtgagatccaccttttcttgcatgagccatacctccaatgcctctccatgtacctatattctcattttagcacattttagtccctaacaacattgggtccataaaggtaagtcacacgagacttaggcacccaaatggattttgtgctagtatgtggtgaactaatcagcctagtagcacaaatgtcctttttggccttcctaagcaaagcataatcaaatgaggagtttggcttaagaatgttaaccatgggacaatttgtaccaatatgtccctttgcacggcaattgtagcaaagtcgattcttgtctttacatggtgccttcttcaccacatcttgcatcttacttgctaccctgctattaagcttcttccttgatgacacaaagtcatccttcatgtggaagcatgatgcaacttcatgacccttctcattgcatccataacacttcctattgcttcttcttgttctcctctttggaagtgtggcttgctcatcaatcttgttggaacacatcaaggcatagtgtcccactttcttgcacatgaagcaagtaatgagatttttgattctactttgaatttgccccttactcttgttattggacttgttttcttgatagaacttagtgcaagctacggttgatcccttctcaagcttcttcaccatgctctcatggttatcttgagaaggttgagcattgcccataagtccatgatccatgtgcttctccctttttcctacacaatccaagtcacatgtagtgctcggggaaatgtttgctttggagcaacaagtgttagcacaagtaagatcaacttgaacataggctcataagattttaccgttgcaaacatcaccttattagctatctctaacctggcatgagaatctacaaggttcatcgtgtgtttcttgtaaatccacatacttgctagtgatctcctcaagttgagatttaagctcttgattttccttcttcaaagatgctacacaagcaatagaattagtggcacaagcaaattcattttccaattgttcatacctcataatcaatgaagaattatatcccttgagtttcttgtgttcatcggctagatccttgatttcttcattcttcttaatgaggcatgcttgttgcttctcaataaccctcatgagcttgatgaccattgttgtgtccttgttcaagtgatcaaccacggagtcgtcatcatcatcatcacccataaagacatgatcttcagcaatggaagatgaacaaatggatgatgtagattcttcatttaactattgatgttcattcacttcctccttcaaaaggttagtttcacaagtactataggaagtagtgcatccatccatatcatccacacgcacacatttaatgctaggtgatatgcatgagtcaacaacacaatcaaatatagcaatttcattatcggtgttgttggagtccaaagggagagttggaagatcatcaaccttattcaccaatttattaccttgctcatacttgcatgttggtgagatgaataatgaggtgataccttcttggtcggaggagataatcacttgggacttgtcatgatgagacgataaagtagagcaatcaccaaatgatgtttccctaagagcatcctctccatcacatttggacttgtcatatctttcctttaatgttgtccaaattagataagcatcttcaagtggcatgatggttttgaacacatcttcactcaaagcactaaacaaaacattagtagcttgagcattgagatgtgtgcatttctcttcctcttcaaatgatagctccatatcattaggaggagaaatactcacatctacaactcgctctatattaggacccatggccctaaacatattaagcacatgagtactccaagatatataatttgaaccatctagtaaaagaagttctaggaacatttcacctcttgtcgacatcttctctcaagacggtgaagcccggaatgagagaccttgctctgataccaattgaaaggaccttaatgtcgtctagagggagggatgaataggcgttcctaaaaattatcagaacttcatagcatattagaatgatgagaacttttggttcaaataggaacttccgatatgagattggaaattccggtctcaaccgaaaagttcggcggataatggaataaaacactagctatgaacttgtagctcaaataaacaaaatatatatgaatcaaaaggtgacaaataaggtatctaaacaagatataaggtcaccaactaaatcaattaagcaagcaagtagatcgggtaaaaacaagctcaagcacaatatgagagaatgcacaaataggcaaaccaagagaggagacgcgtgatttgtttcccgaagttcggatacacggatcctacgtctccggtgaggagccacaagggccgggcctatttcaaccctttcctcatgaggttacacaaatgcactcctcggttttactcttgatttcttcccttgcggaggcgaaatcgaagcctttacaaactttccgtggcacaccacaaccttgggtgctcaccggcgatgcctagccgtctaggagaccttagtccccaaaagtaacaaacacaatcgaagatttgcttgctatgaactcgagtgctcaaagtatggagtgaagctcactagctctcaacttctcaatcactcaatccaactctttccccttctcaaatccctctcacaaaaaggcaccacaaaggatggagtgaagctcactagctctcaactccttactctctcaatccaactctctccccttctcaaatccccctcacaaagaggcaccataaaggtagggaaatggggatggctatttggctttggatgtgtctaatactccccaagagcagcagccactcaaaggaggggtggaggagtttatatacccgagcccctcaaaaactagccattggaggccaagactgtaattttcggagtttccgaaaagcattttcggacaagttcgaaaacttatagaagcaaatctcagattcgtagccattttcggaatgtccgaaaatttttcggattttcggagtttccggtaatttttcggactttccaaaaagcacagagtaaaacgactataacttttcgctcgggagtccgttttttatgaacttggactctatggaaagctcactcagaggactacccaactcaatcaaaaacaaggtctaaaaccactcaaaggataggttaaagcttgggtttctctcaaggtagcactatgataggtcactttgagcaccgagacatacagaaacacctcgatgttgcatccctcttaatagtacggcattcctaaactcaaatgtaaataagaagataattataccatcaggaatgcatttttttcatctttctttcattgtcttgaggggcgccaatgccgataccgtttcaccatatattcttcaaatgattgatgcggttacttgtagcttcaaatggtctcgcacggtccatcatgacaaagccgtcactcgctcttcaccaccggatttggttcttcggcgccaagctccttgcttgcccttcaccgccgcatggtccatcgtgaccgagcatatcttgcccttcaccgtcttgtcataacagccacttcgtatcacacatcttcaatatcttcactttgtcattcttggtattgttaggtgtaatgatatcacttgagcatcaacacctttgtaatacttgggacctatttctttcattcaactcaataaaattattagtcccaatgatccggttgtcaacctccacatgttgaccaaccgatcgcatgtataaaaggatatgaataaatgatgagtattaatcaacaccacaagtgtcatgtactcaaatatatgttcaaatgtaaagatcccaattaaatgaaggtgaataacttggatcgattacatgcataactaaagtataggatttgctccccctaaatgtatgcatacaaaatatttgtgtgaagcaagagtatgcataacaagatattaaacattgagagcttatcctatataagaatagaaggcatttctcaaatatagatattaaagtaaaaacataccttcatcatctccacgttctcaatgtaaatagactaaataagagataatactcaaacaaaacattagtctcacatgcatatgccaatcacttggaaatattatatacgaacatatcaatatgtacatgaagagaaagagtgatacatatagtttgatctccatgcattttatccttgtgatttaggtccaccaacactccactttcatatccacatgagactaggcaaagaaatgcttataaaaacattagtctcacataattggatttgttattaatcatcaaaatcaaatcaatggcacttgaactttcaaagatgtgttcttgtgctcttgtctccgacggacaaaaaatcaccgcacggacgatgtgacaaaaggaaaaatacaaatattttaattagccaaaaaaaagaaaaaaagcggtgtaacctatatttgagactttttctagcgagcaaaagtaacaaaacagtgtgaaaataacttcggttaaaaacaaatatttttagttttgatacaccgtagcgaagcatgagcattttgctagaaataaacttcttttcttcggcccccccgagggacctaaactggacttccttcggccggcccatagcctctaagcgcgcgagcgcaccacctccccctttcccactcctcaacttgggcttgggccgggaaagtgggtgccgcgcgcctccctcttgggccgaattcggcccgaccaacaccggtcgtctgatctctagggcttcgatcggacggccagacatcgagatcggagggacaacccaccccacccccaccccggccgccgacaaaaaccctaggttttctcctcccttccctctctcacggcggagctgtggcgctcatcggcggcgccggcgcatgccctctcgccggtgcacgcactcgcccaagggggagtgcgccgccgtcgagtggccttgccccggcgcccctcccccgtcgtctccccgcggcggcatcggctacggccggcggaggcagagtactacccgctcgcgtcggcaacggccggcggcagcggtagatcttcccgcgcgcgccggcgacggccagcggcgacggcggactcctgcgcttgtcggcgatggcggtggactcccgcgcgcgtcggcgttggcctgcggcggtggtagatcttcccgcgcgcgtcggcgacggccggcggcggcggcggactcccgcgcggtgtctgtgacaaccagctgtggggaggttaggaattttcgcccctttttttgtttcattctctgtgaagcgtaaaattttcttttttcctttttccccttctatttgggttctctaagtaggacaatcgcaattggattttgtatcggtttcgattttaatctcaaatcgcgcggacggacgaacccgtgggcgaagaaaattcacgcggatggacgaacagacggaagaaacggattgtgacgaaaggaaaaatactaatcttttaattagttaagaagtagataaagacatgaggaaatgtctttcaagtatagaaatataggtagtataaacgtgcacgcaaaagcttcggtgatcatcacataatttatccctctgttttttaatatatgacgctgttgacatcatattttgaccattcgtcttattcaaaaattttacgtaaatattaaaaatactagttagctgcccgtgcgttgcagcgggaatcatttcaataatacactaagagctagattattacatgactgataaagccaccaaccatagtctacgcacaaacatgctttaaaaaacaatccatatcaaagtattgttaaaatggtgaagtatttattagaaaataagaattcacaacaatggttctcaaatgcattgaaacatatttatattaatttatagacagtaaaattgcattcgctatgtttataggaggccaaggcgatagaccaattttcagagaatctgacaagttaaaatcttaaagaaatgaaagctcagagttcgaacttcatttaaacaagcattcaacttccttcttcattagagcggacagaagaaacccctctacagagaactctgctcttgctatagagtttacagtcaaaacaggctgacaggctcacaaagggagtcaagctttcatgtatgtagtttcagtttattacacttggtcgaccatgaaaaatagaaatatcacttctggcaaacaaagattggcctaacaacaagaattcatggagagtttttgttccccttgtattatttttcgctctgaataattaagaaagcagaaatgttacctaaaacaacaggatgctaattgtactctactctggaatcttgccaaatgtcgcttttgctctcctctttacgaaggacctgatcggttagtcccatcaatatgggtttttacttttttttttcattgaagacaaactctttaactccttttgaaacaattcccccggagagacttgatcagcaacttgatattcagtcttgtcatctcatcaccagcgaaacatactcctgtctgagactctcagctgatactctgcggtaaccaataattccaaaggcaccttgtcagcctgtcatccagttttttgaaataacagcagcgataaaagaatagtatgactaacaaacctcaatattatgagcaaacaagagtaaaccaacaagtacattgcatctcagctattagttgatggagactttggtcagttcaacatcgttttctctattgccacatgtatatatcaaaaactaatttcttggtggtcaaaaaaagtacactattttgctctgacataatgaaaatattttcctgttgcaatgtaggtgaactgcaatgggacatcattagtgcagagataaacaatgcatgaaaatataaataatttcggttgcagacgtaactttcaaaagtaaacaagatttctaaatgattcggatttctctcatcctaaggcttagtccagaatagcggctaagaaagtccataacacctgtttatagatcacactatttgctctggtagagtgctaggtgctaaagactattccattggcaggccttcagcttctaagccatagctaaatttgaattttggaattaatttagaggttttctcgttgctttccctccttaaattttagattgcaagggtataactataaaagtctaatcctatgacaatgctagtttacttcactcagcttataagccgccagagtttaactaacgagacattaaattttgttcagagcaactatcttcgaagttttggacaaaattaaaaaaaaatgaattataacactcactgtcagtttagggatctttccgtttctgaaaaagagatgtgcttaagatttgaatggttggaaagatggggattaatcaagagacgcttgcataactcttaatttctataaataaaatagtggaaaactctaggtttccaggtttatgtaagggatgctaggtggaggaatacatgtggataaaaataggcaggaaatgtgcaggacaaaattaacacagcaagaagagaactttcatgtcttctcaaaagcccgtaagggtgttatcccttccttgcaatagagattttagattgcattgcattgaaacgagcacataacagtactccatggattttttgtaaactgagaaaaccagtaactaaaagcatgcttcgtcaagcatttcaattggatggcaagcatgtaagatgattttaaccaaagaaaaggcatatggagtggcttatttacagaaagttaaggaaaatgacttcatattggctgttctgtcctgtcagcaaatttaagtcatgtataataaaaactacccacaaaaacatcttgaaagcaaagtatatagacacaccttttgcttgctctatcacttcagattagcagtttctttcccttttccatattccacaccagatcacagcaaaaaatgaaacacatttcacaaacaactcagggacatcgctttggtgcaatcaaagcataacaaagcattatttgacctgtacagactcaataacacaagcaatacaaaaacacaaatttgtttggtcagcgtactggagattaattagtaacctgatttcagtccgagattgcaacaattggatcacatcgatccccagcaccactgcacccaccacgaatggcatgtatccaattaaccctatattctatagcactcaagagttaagattctcacctagagataatagcacgtgggttcacaaaatctgaataattggagttacaatccttaaagcatcaatctgagcacagaaaaaagcaaaagaagaattcgtaaggtgaaagcatgtgggtttgcagaagttgaaaatagaaaatatatacatcaatagaacaattctcaccggacactatgcacctgggacagtttcctgtcagccagcttgtaaactctgaaactcgaatcagaagaaattcattgtttgcagatacctgtggtcgtcgcgatgcaagatggatgggattgatgaatccacaatattgacatagcgttctcaaaatttggcatcacacattcaagaaaaacaggggaaaaagtagggtatcggtggaccagatgtaccaggatatgggcacaggaggtcaccgtcggcaccgtaaaagcggcaggattggtggggttgctgagcgtgagaaagatcgctgcaaaggcagcggagcggaaatgctgagggggacgtctgcctgccgccgagctcgcctcctcccaccgtcgccccagagtcgtgcgacggccagcggaggggttcgacggcgggagggcgacggatgagcagccgacagacatgccaccgtcggggtggagtgcgggtgatggcgtgcggcagatcgcacaggcggcggcggcccgtccgttgcggggtagtgcgggcagcgggcggatgcgggagtggaggtgggggtgggagcgcgtgc

SEQ ID NO: 73646 - DNA, 5312 bp, Oryza sativa
tcggcattacgtacgttggttccgtatatgatgttccggatgttcttttttctttataaaatagatctaactaaatccaaccattcaaaataatgggtccaccaacataagtaaaaatagatggtcagatttttcttatttattatggtgccacttggcgatttgagagtgtttatagggtgccacttggcggtttgagagtgtttataggaaaatataaatattggcaccatccggcctaactgcctaacgacctaggagcgtttaatggacttttagtatataatagatagatagataaatattggcaccatccggcctaactgcctaaacaagtgcgaacttgtctaactgtcatgaccacgggctttaatacttcgtttaggtgctaaaataaaccaatattaatgaaattataaaattgtaaaatttacataggttatacgcagatttgcctatgggtgctggtgtcagcgtagcagttgtatggctaccttatacttcctacctcccatattaagttcattgttagccatctctatttgtccctaaataaattcgtttttagagtaatcatatcattacatcagaacttgtgaaagtggggaatactccctctagagtaattatattgaggctgatcggttgcagctgcggcagctccaagctgctgccactggcagctattttcaatggccacagccatagccgctaggacagccagcacaagcgaacagcctcattaggagtagataaagtgatgaatagttgcattgagatttgataaagtagatgtattatagtatttttgcttttgtattggtatgtgtgtgatgaatgaaaaataaacttattttgggacggaggtagtagtggctacgatggtacactcaatacatacaagtcctatacgtgcaaagtatacatgaaaatgatttcattcttattgaatgatagaaatagtccctattcaacgtgcgtgcatatagatgtctaattggctacttggcatggtccgcctcgggcacaaccaagacacgacctaagatcagttgggttggcacaccccgactgacacaccgtgcccacccacgggctgtatctacggcgtaggcacgacctagtaagactcgagctatgccgtatcggcccgaagacacgactagttcaccatactcgtccttagaataagtctattttcctccctcgtctctttaggctacacgttattgtctgttataagactatttgggctccctcatcgttttggactgtgtcttatatgactggagtaaatctattttgcctcccttttctctttggaccggctgttgacaagctatgacctgcggaagcgttggccgtgccatatcgaggaagaggctcaggcacaacccaacagtcggtcggaccggcatgggcccaataatagttgagccgtgcctggatcggaccaaaactccgtgtcctgagctagaccgtaaggccatgggccttttgaccaactatagttgcacgtcctaggttacgtttgtcgacccatcactcgagattgctatttagcgatcagtcgcgcgcccccttccccgcgcggctggacacgtgtcgcgcgcggagagggggcggcggacgcgtcgcgagggaggaccggaggagcgagttttccttttttccccttttttttccgtttatgttcggttgttttttctttctccggttttttcgttctattcggcctggttttttttggtgtatcttttgtttggttctttttttgtttatttaaagatgtataaatataaagtttatattcgtatgtataccaagtacgtattcgtacatatagaaagtttatatacgtgtttgtatacgcgtatataaactttctatatgcatatgtagagtttctatatgcgatacaaagtttctatacacgtatacaaactttgtatatgtgtatatatttttatgcattaaaatatattcataaaaattatatatatacacgtatgtatatactatatagtatagtatacatacgtatatacatacgatgtatatagtacttacatacgagagagactaggcgagcgagtgatcgcgcgcgcgtggaggcgcgcggctgatcgcgtatcagcgccgcccggtcactctatcacgtgtacatccgaaagcgaattttttttatttttaatttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaaattttttatattgaaaactatataagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttatgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccatgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcattatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttataagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgtgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgtgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcatggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagatgtccccgtcgagtcaacctgtgaagagaggtaaattatatggctcaatgaagtaagtatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcagcaggatggtgagccagtaagcctggtcgcgtgtgcacaaggacgaaagtcctagcggtgctctcgcagcgacggcctcttctgtgtacggctcccagatga

SEQ ID NO: 73647 - DNA, 25809 bp, Oryza sativa
tactaacctgttccatttttcagattgcagatggtgagcgcttacccttggttgtgaaggagttgggaacctgtgatctttatccacaagtaagttcatatttgctatttaaacgaatgcatcattcgcatattgatgttttccaatagaaccaacttgatgcttgcaaatgagtcccaagtttctttttcctattcattacacgagtcacatgtatacaccatttgaccatgcatgttgaaatattttaatatgttagtttatttgacatttgcactggtgagttgttttatttaaacacaccatggagattctgttgttatagtaaaattaaattaatatcaaatctagtatagtgtaattatggagttggagtgccggttttgaaattgtacttgtcgggttaaataaatgtgatgaacttttctacgttctggtttatgtttgcatgttattaataatagtgtattcatttcagagtttaaggcacaatccaaatggaagatttgttgttgtatgtggagatggagaatacataatctacaccgcattggcatggagaaatagatcattcgggtctgcacttgaatttgtttggtcacttgatggagaatacgctgtcagagaaagcacctcgaggataaagatatacagtaaaaatttccaggtttgtactgcccactgccccttcttttaattatcgttgtacatcagagtaggggtccttcaatgcaatgtgtggggctagaaaaatttagtaggtgtgcacatttcatggacaagctggagtactgtgcacattccaatataaataaaattgccaaaaaaaaattgcaagtagttcaaaaaaaatatagcatgaatagaataccacaaattatataataaaaaaatgaatatctcatgaaacatttataaatcaccaccgtcgatcttcaaataacatatccattgtttcaaatcgtttttcacatttggctaatcacaattagaaaatccattaaaaatcatctacaatttattaatatcactgaaggtttcataatataaagttagttttattcttgtttttctttagaatataaaaaatcagtaaatgaccaactccttctggatagggatatgggagtgagcaatattgcctatagtagttggggtagactgatcaatactaaaatgtgacttgagtaaggggcattatgaatcatttattcttctactgtgtcagggtcaacttgttacttatatttattaggcagctgccaagcttatcacaacaatctcctttactgtggtttctgaaacatagtatgatgataaaacctatctatttcaggagagaaagagtataagaccaccattttctgcagagcgtatatttggtggagtattgctggctatgtgtacaaatgattttatttgcttccatgactgggcagagggcaggatgatacgcagaattgatgtcaatgtgaaagtgagtaattttgttcctggatttaaatttttttttgcgtgtcatttggaatattatgatgctaaataggatctgctttcttatttgtagaatctctattgggccgatagtggtgatttagtgacaattgcaagtgacacctcattctacattttgaagtacaatgtaagtttttctgcattttgttggctctgtagttcaatgatgtaacatctacttgatgtaactataacacaacaattataccttccagagggatgtagtttcttctcatttggatggagggggttcagttggcgaggaaggtgtggaagatgcctttgaactacttcatgagatcaatgaacgcatccgaactggcctatgggttggcgattgttttatctacaacaattcttcgtcacgacttaattactgtgtaggaggagaggtaagtattttcattatatcaaaaatgcattcacatatgatttggttagactgttaattttcagaggtagtataactattcgatgtattacaggtcacaaccttatttcacttggatcggcaaatgtatttactgggatatcttgctaaccaaagccgtgtctaccttattgacaagcaatttaagtgagtcttggttgtctggtatcgtatcatattcggaagccacaatgaacttctgaggttaacttgttttcttactgcagtgttgtggggtatactttactccttactatgattgagtataaaacacttgtaatgcgtggagacttcgatcgtgcaaacgctcttttaccatctataccaaaagaacaacatgacaggtgccccctgttctgctaattattgtactctgcaactcaggcctcagaatctgaagataacccttttatttgcagtgtggcacgtttcttggaatcacggggcatgttggaagaagcccttgagatagcaacagactctaattacagatttgacttggccgtgcagcttggtcggcttgaagttgcaaaggcacagatgattaatttatttatcacatttccaagaatgtttttgtctttgttcaaatgttgttaactatttgcttttcaggcaattgccattgaggcacaaagtgagtccaagtggaggcagttaggagagttagctatgtcaaccggaaaggtacagctgttggatgtattagttactactccctctgtttcatattataagactttctagcattgcccacattcatatagatgttaatgaatctagacacacacacacacacacacatatatatatatagatttattaacatatatattaatttgagcaatgctagaaagtcttataatatgaaacggaggaagtatcttctatgagtggtcaatatatatattgtgctaattaagtgggactgttctgccatggcattttagtttcttgattattagtaccagtataccgtgtaacttaataattatgagcgcacagaaataaatccctcctcccaacaatataagcaagcatttgaattttgttcatgaatataagcatttctacaatgcatatgtaaaatcaatcacctcatttaaatttcttcccatcttacgcccaactactcttcaaccccaaccttctcattaaatgagggcactaaagtactttctcctcaactttaatctttgctcaacagtctagaaatgtttatattgttggacagaagaagtatataatttaacaaaggcatttgtgaagagataatattgcagttttgatgggaagtagctttgattgttgctatgatgcttgaattagaacctaagaagttcttgtgcctttgcttttgctctgtccatcttttgtactacctccatttcattttataagtcgttttgacttttttctaagtcagacttctttagctttgacgaaatctatagaaaaatatagcaatatttttaacacaaaagaaaaaaactattcaaatatattcaatgttagatgtaatgaaaccaacttggtgctataagtgttgctatattttttctataaacttggttaaacattcaagaagtttgatttttttaaagaaagtcaaaacgacttattatatgaaacggaaggagtagttgtttttaaaagtagaattatgcgtgcaaaacaatagttttgcctgatggcagagttctgtgtgtaaaaaaataacttaccatcttagttttaagtagaattcttgcaatttaataactttgccatgttatgtttcagcaccttgccagatacaaaactggctaaaagagtgcactcatattctaacatgtcaagtgtcaattctgcagcttgatatggcagaggagtgtcttctacatgctatggatctcagtggtttattacttctgtattcatcccttggtgatgctgaagggctaacaaaattaacatctatggctaaagaacaagggaagaacaatgttgctttcctttgtttcttcatgcttggaaaactggaagaatgtcttcaattgttaatcgaaaggtattgccatttgccaagactatcctatttaatagtacaatgcttattcagaaaatgtattttttattttatggtgatcacgttatattctctatacagtaatcgtataccagaaagcagcattgatgtcgagatcttatcttccgagcaaagtccctgagattgtaacattatggaaaaaggatctccaaaaggtaccatctgtctcttttttccccctccaaaaggtacccagtttctggtgttaatactgatgatttttagtgatgtttccatcctaacaggcagaatgcccaatctatattttgtgtacctgataaatcatgggcattcaagggcattttgtctattatctgagctagcatgcaaaactaaccaaaagacaatcaatcttgtgctagagtattgttcttattttcagacttgcgctacgcgacactgtttaatttgtaggagatatgtgttttattatcttaccatgccttttttttcattctcgtgccattttctttataggtaaaccccaaagcggcagaatcattggcagatcccaacgagtacccaaacttgtttgaagactggcaaattgctctcaatgtagaagctaatgttgcgcccaaaaggtctgtttgtaaaagtaaaaactatgttcttttgtgaaagttttacctgttctctcttccacacatgggacaagccgtcatggtttgctttcctcttctctttaattgaaagcatctgatgaagtaagaatgatgccctctaccatgtatgggatgctggtttggaatatcacatttagcttcagttgagcacatatagtgaaataaatagaagtaatgtcagtgctcatttgtactttttctttattgtaatatgaaatcctatttgtataggggtatttatgcaccagctaaggagtacattatccatgctgagaggcctaacgagactctggtggaagctttcaaaaatatgcgtatacatcaagaggaggtgctgccagatgaaaatggagatgacactcacgaggtatcactcttacagaaagagttgtaaaaaaatattgttaaatagtgggtagctatttgaagatgttaaattacttctactaaactgatctcttttttttttggcatgcgatgtcctatatttatcaccaatcttttaaagtgatcattatttcaataaaatcacattttttgctattcattatattttcttttctccttgctttaagttgtaatatagtaatatcaatctggtccaccaggctatcgaggaaaatggagtagaagagagccaagaagatgctgttgaggttgatgttgaagctgatggttcgactgacggtactgtccttgtgaacggaaatgataccgaggaacagtggggtacgaacaatgaagaatcattagcataaaagctgtagttgagcaagtgtacagtcctaaaacctttttttcgtcctagtttctcctcccagggcaccaatgatcatagtgaaaacttgctgctggtgtcctcaaaaagaaaagaaagaaagaaagaaaacctacctgcttctggatacaagtgtttattctgggctatatcctttagtttaatctgccgggataatttaattttggtattcgagttaatctgttggtctgaccagttttcttagacagtttgaacataggagcaaattttgtgcttgctatacattagttgttgatgttttctaactactgtcttgccttttgcagtattgactcctgaccaatagtgaatcagcgggacagcaacctgatacactgattcagcttgtaaaggtgaagtgtttttccatctatacaattagcgacagttgttaacaactattcatttattatagctaattattttttgacaggttgctgactcctactgaaactatgtgaaggccgttttcctccacttgtataatcattgggcgtgctttaagatcggcatatccgacgataaaacccacagaaattagtcatcgctttgtccttgtttgagatagaaaattttgtacctttttacacacataggtccttactgtggattctcagggggatgttcccttctcgttgaggttgaatttgattagctaaagaggatccatattttacacaagagtacatagggtaaaagtatgcttgctggatccagaatgtttctttgatgcaatctgcaagacaacactttgtgcgagctatgtatcatttcatttgtgctattccttgcgagcgttattagtgaataataaaagtttagatacaagagtgattcttttatattgatataaacgtcatagccttgtaaaatttcagctcttcttgttgggcctatcatgaatcatcttgataaccaaagggaaagtctacttgtgaacgtactcaacaaaaattgtttcgacactagtatggcatgaacagactgaaattctgctttaaaagaacttatttgccattctgcttgccgccatctttagcacctgacacgcactgatcacataccatgcttgtttacgtcacttgccgtggagtaattttatcatcattaaggtataagaaatcatagtgtaaaatttgatatcttctcgaggtactaaaatttttaattttaaaaaattttctcgaggacccaaaaatttgagaaagcacaagaatcttcaggtacatacaatatggtgaaaacaacttagaagtttcgttttgtcctgagtatcatacaacattccaaaaatggaccttacacaattatacatatcaaccataatccggtattaccatccacataaattttaatagccaactgcactgggggtaaataaacaacctgggccaataagaatacatgatttgcacatggtccatggagaatccgaaaagaaagtcaaaaaaccattcgaggccccgaggcctcatccttcccaaatatacatgttgcaaccgcatcaaacacaaatatacaaacactattggaatgcgcatcaagaactccgaagggtggagcttatgctcagacgcagttacgctcgaccattgtccttgtggaaacgagttgtacaaccaactacagcggataaatacacaaccagtagtatgaattaacaaattctctcgagggctagtatggttcctgatcccgctgggcactgcaaaccctttgtccgatgatgcacaagaactccaaaagagcagataatatcgcacgtcgattgtataatgaccttacccaaaaggatttcccccaacagagccataggaaggtggggtgcttggctgggggtacctgggagcagcttgttgatcaaagcccatgttgagggaacccaaacctccttgttgcctgtaatgccacaacttggacataagcgtcgaaacaacaaaaaattgcacaatggaaccaacaccttggaagtattttaggacggaaatacgtcttgtaggaactaaaacttaaaatgaaagaatgatataacacaacggaaccaacgcaaaggctggtgcctttggttgcagtaccagattttaatgacacaaacaatgggcatgccactagaaggtggatgctattgtttatagtagagcaaaggtgagataattctgaaagctacgggtttcagtggttgatgtcaaccatccaatctggtcgaatggactcattaataattagtctctattttaaggttgcatgctacttcctactcctacatcccaaaagatacaacaaaaatggcagaaaaaaaaaatcaacacgagcaaaaagtatctttaaaaaaatgctaaaaagttcttcactacactttcaacttaggagatacactaaatacagcagtcaactcacattggaagcatggtattaggtaactgctcagacatgtttggaacttgctgcatcatgtaatgatctgaagttgaaccacaaattagcacacagataagaaatactaataaagagcacaatttcagagattatgctgagatatggaaatacttggaggtgcaggtgactggtacagctgctgaggttgctgtggaaggactccaaaactcgaggtaccaagtaaacctgggggagtcatgccagcagatgctcccagtggtccaggtaggggctgctgctgctcaaggacacaaagattaaccatgttaatggagcaaacaaagatggtgagtcataccagctgatccaggtcgggattgctcaagggtacaaacaatatggtcgcactatcgtagtgcatcatcaagtataaaactaatgcacttgacagttttttagaggaagaggaccaacatttacacgaatatcacaatgttaatgaaacaatcaggcataattaatagacaagatacctcaagatttacaagaatagtaagtgaaacgatcttagtttgagatattttgtaaaagaggtatttcattctcttcattcataccgtgtgagcttgaactggagctggctcattcccaagatcaaaaggatttgatgctttcgcaggttgggggtatgcatgttgctgttgcggatatacaggttgttgatatgcaggttgagcaaatgccatctgaggatatgcttgcattccctaaaattggtaaataatttatctagttaggaaaaacatcaacatcagatacacaataaatcgctaatatgagaatgatagataccattgcagtctgatatggcatggcatatcccattccaaattggggtgttctctgccaaccccctattgtttgaggtcctggtggatataacgaagtaaagatatcctgcaaaaaaatgatctaagggtcaactatgctgacacaatgattttatggagcatattagtggccccaccaggtttttttttcttctctaatatgaccatttttcacagaaaaggaaaaggatcgcacagttgtcctcaattcaaagttagtttaaacgatcttgcaagtgaaataggggtacaacgaaaagacaaatgaactgagaagcattgttggtcacaaccagcatgaatgggcgactcagatcactacttattacttactggaagtatagactcaaaccaatagctatatattttttttctttttttcctttttttgcataatgatgacctgaatgcctgtttagctttttcactcgataacctgatttatttccatgtatctggttagtcaacccagatatcacattcaaatgcaccaacaattattaacaccattattcaactcttgccctaccataccatgcattgttttacatgcatatattatcatctctcaataaaaaaaagttaataaccatgtaacccccattaaaatgcaatttaatatgtaaacaatcaacaaatctcacctagttttaaaccaacataactgatcgcataggaaatgatatatcctaccaacgtattaacagttagctaatgcttgctaaacagaaataccacctctgacagatcaaaagatcatcatttaaccttgggccaccacaccttacattatttgacaagatttcaaggaaatactagccatagaaaaactgtaagtgtcagtctcttagcagttttgagctctataccttttatcatgtactcctgttctttttttatctgacactttttaactccataaaatttcagcacgacactgcaaataacttttgtaactttatgtaaattattaaaggcacctgaatatctagggacacatctataatccaatacatgtatatgctcaacaagaattttggagcttgggtatgaaatgtaccccatatgcatatggtaagtgaaatccgaactaagaactcatattgactagtactcaatttagttggactgcagtgattatatgtcatgaaattagttcatgggaggataaccatatcataagtcctgaacctcaaagcatattgctgtcctatatattataggtaatacaccaacaggtatcgacttggaagcctaggcaacaacaaagtgcctcatactgctatcctatatattataggtataaaataatgcagttcctctgcaacttacaacatggattctaaagcgtcaaagagaaaacggttgtgctactaatctggtaagtagttggttctatgccctgtccacaaatttggtaatttcagctttatgattcacaaaatatggttacaataagtttagaaaatggcatcgcatattgcacaagctatactgtagaacatacaaattaacggattacatatctaaatgaagccaatgaagcaaaggggtggggaagatgaaacaagtcagtagtgcagggactagaaaatgctgcaatgctagatgttcaattctctacaagcagttaatcacataccgctggaagttctttccggccaatggatctactgtcagtattaggtgctgcttcttgaatgccactagttgctcgggaattcgcagagacctggaacggaagtccagctgccggagcagctagaccagtttgttgaactgaagatccatggatagacattcctgttgaggcctaagaaaagtatcaagtgaaaacctatttcaaggcaaaaaaagaaatggaaggtacacagatcgacttctgatattcctctgcaaacggaagtacctggtgacctgagactccagggggtgcaccaaaaaatgaagaatgtgactgccccatcatggatgaccctccatcatttggaactgaagtgggcatgaccgaagctggaaaagctgatgaattgggtgcagagggtgtttcagaaaatgatagttgagcaagtgcagactcaaggggatctacactattgccagtttgtggtgtttgttgctggccgaaagaatcaaacgatgcccagtcaccaccaccactgctcactgatgacacatttttcccttgttccacagcaggctgttgtgctggtgcattaacaggttgcactggctgtgcactagcaggctgctgttgtgatgtaggtgtagattgtggaggtggcacagatgcagaaggctcaggatcagcactgaaatcaattaaacttatcgtacttgccacttttatctgttcggaggtcccctctgaagaaccaatactgctggcagttgatgtcctctacaattatgaagtatgtattgtaagctaatgaattgaacctactgataaaattatcagcttaacgtggaaatggagacaagaacatggtgatatttctaaaagcaatgtctgcaaaaaaaaaaaggaaacatcagaggaaaataataacctgcatctgtggtggaggttcgatggttctggttccatttggtcttggaggatcaattggccttggaggatcaatcggtcttggaggatcaatcggtcttggaggatcgattggtctcggaggatcaatcgttctcgctacatttggcttaggaggctcaccaacccgtagttgaggtgcattatcacccagtatatccctcactggccgtacaacagggctagatccatcggtttccttctggtaatttggagacccattatctggcctctgtggttcagaaggcctgcggtcctcaaaccgttgaactggagttgtttttccagatctatcctcacgatttctatcatcaacttcaaagtagcgggggcttttcttataatcattatgttcatagccaggacttcgttctccataggaatatctggaatttctgtcatcgctccttccactataactgcgacgatcagaatagctttcattgtatggcggacttcttgaaccaccccaatttccatcagatctcctgttttcactatactcatccttatcatcctagaagatacaaagaaataaggaaataacgaatttaggatagtataatagcaatttccaacaagcaatggcaactgcaaaaaaacaaggatagttataattagccaacatatcacctttcccctcggtggccgatctgcacttctttctccctgtgtatctccgttccacataaacatgcttaataaagttcctcaatttatccgcattactgagaccaaaagaaacaggtcagaattccaagataaaggaaacaagttgtaatctaaatatggtatggctaaacagaaaggtaacctgctgtcagggaaagaattgcggtgagcatcccattccttgaagaatatttctctagcacgctacaggttatgcaaaacacatgtcaaattagaaaggcctaaaatggtagaaaacatgaaaaagaaaagagaggacaagtcacctcatttcctccttcttgaagggcactaacttcctgtgcagtaaatttagccatagaaactgacttcgctcgatgcgtgaactctcggctagaagcaaaacaaattttgtcatcaataaaattaggatcactgacttcactaaaatgcatctaatttgaccaaagggacagtgaagctagagaggttcgacatattacaagtgtaacaaaacagaactgaataagaatcttactgtgctccactgcaattggtacaaatgaaggtccagaaatttgtacagacatattgtggtccctgttaatatcaatatatgtgattcagtaatatacaaaaaaaattaggaaacaaagtaatgcacatcagtattacacaaatacccactaattaagtctactttcccaacaaaaacatgtgtggagcacctaagcaaggagtactctgctgaagcaaaatatgggcataaatataagcttgaactatcttagagtccacctaattgcaagagtggagtgcaatcctccataatcttgacatgacattattaggcaaacctagctgcttctactgccgattccctccagtacacatattgcaaaactcttcaagttccaaatgatagattttgacattattttgggtgcaccatagaattagaaagcataatactccctccgtcccaaaatatagcaacttttagctatgaatctagacatttacttgtccggattcatagctgaaagttactatattttggaatggagggagtaatttattctacttgtggtagagaaaattaggcaaggctcgctgtgatgactagttggagatttccaaataacctcattgcgctgtagatcgagtaataaacgaactaccaaaaaaggcttatgtagtgaaaatgtcatgtggactgcagatgattcatgcttttccaacagtagaaaacatttgcaacaactgatggcatctaattatataggaccccactgttgcaatagcagtttaagaaaaaaaatcatttattttgcataataatagaagcaatcactaattggcatactctaaaagagtaaaaaaggtgaagtcaactgccagaacaatagacatccaaatgggccatgataatatagtttccttattgatagctgtggtaaattattaatgcccaaaacaactagcagatcagtcaagtcaagaatgctatttgccttaaatagcagatactatgctagcagaaaaagaaaaggaaaaaatcaagcttaaagaaatgcatagagcctaaagtgcagcgtgcaaatgtgcatgtattagcacgacagagtttagggcataaacagaagggaaaaaatattaaacatccatgaacgcaaggtcaactaagctattcaggtggttgaaacaacacgtgaatttttagacatcatctggagagttaacaatcttggtatatagtagaatattactccctccttcccaaaatgatcatcatatatgtttatgcaccaagaccaaggataatttaaatcacatcaatcaagacaccatgcacgcattctcccacaatgcatgcatcgatcaaaacaccatgccaattacaccttagcatgcacacattctcccatgctgcattaattgtattatgatgaaatccgtgtccatgcggttatatgatgatcaatttgagaaattttgaattccattacatgatgatcaatttgggaaggagggagtagcatgtactgccttgcaagtgccagaatgtcacaaaatacacgttttggtccaagacgaccatagtggtttctaattttttttgcttatgatcttcaattcttcatcaactataatagcaaagagtatatgtcaaagctgtttttcgactagggatttattaaaattccacatgttgtaattcaattataaagaggtgttctttttattttattttctgcttgtgctgctttttgaagggctgctttgttttgtcacaccacagacaatgtaagcaagtgtgacattcaccattgactttgactgcaaagatatgaacatgataactttgagacgctcataatccgtttttccgcaaagataagaatactttagcagctcataagcgccattactttcttgatacttgtatcttaggtacctcttggccattgttctagtcctaagtcgtaacgcgtgatgtatatctggcagaaagtagcaacatttgtcgtctacataattaattacatgaaaaagaatatgctgtgtgattacagggcatggcattacatccagcaatagctccacgcattactctccgtcccaatttactgaattgtgatccagtatcaaccagcctaataaaataccgctatccgatcggaaacctacctatccagccagccaatgagatctcctagtatgccgcaaacattcgcgggtagctctaaaaccctcgccattactagcaacgctgaagtataaagccaagcgagctcaaaaaccacttcccctagatcctagccaaccccgccgaaatcctaccacatttagcaagcgaacagtagaaagccagcgggaactcaccaaattgttgcagttgatgcacctcttgttggcgggcagcttgagcagcccgcgtatgatccgctcgttcctctcgtcctccttgagcctgctcgccatcgccgcccggatccccggccgccgctgccgccgccacaaaccctaaaaccccaccgccgcaaaaaaaaaaatcaaacaaaaatatcccccaccgaaatggctcgagatccgaccaacccagccagatccgcccacaattagagcaaagccaccgccaaaatcggcgagcactcacctgccgacgcgcctcctcctccgatggcggcgctcgcgcgagatctcgcagcggaagacgaggtggcggcgagcggcgacgcgaaggcttcgcctctttcgttcgctggctgcttcgctgcgcgtgtaagtaagtaataataataaaactgaaaaaaaaaacttttaattaaacctttttttctctcttccctttctcgtggggggtttgggagaagaaggcgaaggttaggcagccggtcaaccgagagagcggtgaccggcggcagccggtgggttggtggggcctggggtgtgtggggcccacatggcagtggcggttgggtcggttgtgggtgcgtgtgtgagctggacgtgggctgttccttcaccggcgtttctggtctggtcttggtttgtttttgggttttcgctgagtcgctgactaatgatgattcctgtctccgcgctgtctcaccgacaggtggggcctaacagaaagaaggtattttttttttattttggggggaagggaagatgatggttctagaacctttgtggttgagttggtggcatgtagtgatagatgaattcatctttgtttttgttctctttggatgcatgagagggtaatgaaggttttgaatcagttgtttgattagatgttttgaggtttactgtgttttattaagttattactaggtgatatcccgcactttgctgcgagatttatagatatatattaaatattatcgaaatgataaaagttgaaatgttaaaaaaataatgttaggaagattatttgacatatacttgttgatctctataatataatattgtagatataatataatattgtagataatatgttatgcttgcatgggatttaaaataggctagaatagtaatcgctagtgagtgaagatgtggtatacttgcatgggattttaaataggctagaatagtaattgccagtcggtgatgatgttgcatgcttgcatattgaactttagcttctatcaattgttagtgggtactaattatataattatatagaaagtatagattagtatgtgcctgattactatttggaagcatgttaagggaaaattgggtctcctgttcggagaacatgctttacggtggtctttttcaccccaggctataatgttgacgaaatgaaaactgaaactatgacgatgtccacatcttctaataatctaaaagctagctcttttgctagctttcgattggtgcatgtggcgccttttactttgaagaaaaaacataagtttatactagagaaaaaaaaacacctaacaatcatatgtgaggaaaaatctagagaaaaatataattccagaggcttccaaaactatcttctctttccaatcacacagaattctacttatttgcctcctataaatataacacgcctactcgataccgctccggtaactctagaatatatagtaaacctaaaaatattaagcaaaaaaacatatctaaaacaacaaatttacactcattttctttctttaaatatactaatcatactcggtactattagcttgcgcttttgttagctttcgattgatccacgtggcgcctcttactttgaagaaaaattataaatttatactagggaaaaaacacctaacaatcatatgttatgataaaaatatcacatatggattccagaggattccaaaactatcttctatttacaatcacatgtaattctactcctttgcctcctataaatataccacgtctactcggtactactcatataactctagaattatagtgtaaaacaaaaattattaagaaaaaacaaatctgaaacaatgaatttatatttattttccctcttttaaatatactacgcatattcggtactacccatataactctagtctagaatatatagtgaacaaataaatcatttatatataaatccataaaatgtttctttaatatcatatatgtccatttgtcaaaactaaaataatggttcataattttatttctaaaatattttatgaaaactttaaaatttcaaataagaatgtcacagtaattatccagcatgtcacagtaaatcttcccaacactctggtttaaagtagaaactcgtttatcacccccaccatttgtgttcattgtcttctccagcgcattgttcttcatcttcgccaaatgggtgttcattgtcttctacagtgtttgttgttcatcttcttctctagcaagaagatacgacttatataggtcatcgctctcttctgctagctgccaattatataatataaattatcaaccttgtcagtgtttaaataaataaacaaaaataaaaagagtgaaagtattgagcatcaggtatttaggtcaggtgtaagtatttgttgctactgtcggttttcgtagtaacatgtactactctgaatttctcttttaaaccacttatgtgataagcattaatgttcatccatacctcgctagaatgaggcttcgaccgtgctgatatcaacaccaactggttcatccgagtgaattctactacttatgtgatagcactaatgttcatccatacctcgctagaaggaggattcgaccgtgctgatatcaacaccaacgggtgaattctactgtgattacaaggcaaaaacgaaaacatcaaaaatactacaccgtaataataattacttacttgaaaacatcaaaaggaggtctaaattatgttagttcttaaagcgtcatgataatcatggcacatggcacatgtcaatgctacttgagcacttcatatctcgcattatgtctgttttgagttaccaattgtggtcatatctttggattgctcgttcgactatgatagcgcttatgaaacagagctgtaatgaaattattttacatctcatcctctgttgtgaggcacacatgcagtcaataaagttattaacaaaagaggattaaaaaaacagggtgagacacctaaatcaataaaaaaatgatttaaatggtacttcgaaacaaggttgcagttagttgctccggttatatatatatagtgtagaaaatcggtgtgccgttggcatgtttgctagtcaacctatataaatttatcataaaaaaatagtaaatgataaaattgatgtgctcactaatttgtcgtcactacaaagtggaaagccaaactaaatatgaaaggtttgccgtggaaataagtgcaagctgaggtaaatgagttggagaggcgaaaggtgatgttgctggcctcatgcaaggctagcgagaaagagttgaatcttcgatgaatcaaatccttgagctacagcacagcctctacagcacccacctcttcttgaaagacacccggtccagtttgattcgagagcagaatttaagagacaaaagttggaggaaaagaagatcattaggaaggaaagaagaagggaagaaaggatggcattgaaagaagataaatctgatagggaaaggtcatcaactaagaaaaaaaaggagagaggggcagtctgagagtgaaaggaacatgccatcagagaatacaagaaatgggaggtgaagtctcagatatcttctgagaagaagaagtcatatgagagctccaaggctgaggatcataagggaaagggttatgagaagtccaacacggagaagaaggggaaaggcaaggagaacaagagttctgagaaggggaaggggaagacaattgacggtagaaagaaatgacgaggaaggttagaagaaattgtttcagccactaggacaactaaatgccaagtatgaaatgcgactaggagagtaattaaggaacgatccctccagataaaagaaaacttgttgagtttttaagtcctatttctctgcaagtactttttttcatgaaataaagaccatgcacttatgcttcttatgcatttctctcagatccatcatccttattagtatgtgcctgatttctacttggatacatgttaaggggaaattgggtttatgttcggagaacatgttttactatggtctttttcatcccaggccataatgctgaccaaatgaaaaccaaaactagaagatgtctagatccatgtatataactggagcaactatctgcaaccttgttttgaagtaccatttaaatcatttttttcattgatttaggtgtctcactctgttttttaatcccttttgactgtgtgcgcgcttcataacagaggatggagatgtaaaataatttcattacagctctatttcatgagcgctaccgctggtgatcacaagtaaaccaagatatgaacacaattggtagctcaaggcagacctgatgcgagatattaagtactcaagtaacattggcatgtgccatgcgacatgattagctaacaagaactaacataatttagaccttctctagaacacaaatttgactggttttcatacaaactagttctaattccgtgaaaaaaatgccctatttctcccttcacaaataaggcatttgatacacaagacccagacggtgagctctttgatagctaaatagcaatttgacaatatactttaccttcgtttaaaactctttttttgttaagtataatattgtactccctccgtttcaggttataagacgttttgactttggtcaaagtcaaactactctaagcttgactaattttgtagaaaaaagtagtaatatttttaacccaaggctagtagtattataaaaaattattaaattatagatttaatgaaactatgttggtgttgtaaatattactacctttttctatagagttagttcaacttagagtagtttgactttgaccaaagtcaaaatatcttataacctaaaacaaagagagtagataactattttgaatcaaagtaaacaaagtgaatccaattttatggataacatgttactacctattttgataggtcacacacgtaccgagtctgagtcagcgtccgagcggctttggctaggagtccggatcagaattcgaatccgaatccgaaatagaatgagcgccccgcactataaatatatcaaccggcgatcgtataaggaatttggcatcgttgaatagcctcatcaccgtcgcagaccacccatcgcctgatctgcgcctgctgctacccatctgcttgctagccggggccgatcgatcgagaggcccaatcagtgatcagcttgcgagcatggcgacggacatggaggtggacgagatgcgccggtgccggcgatcgtcgggaggaagaggtgcgcggcggaggaccggaggatggagtcggatttgcggcaggaggcggagctccgtgcgaaggcgctcaaggacaacacgtggggggagatggtggcctgcgacgacccctggctgaaggagatcttgcggaggaggtgcgtgaacgcaatgcggacgagggccctccacgcccagatcaccaggctcatcgacgacatggatcgccgccatcgcaagttcttcctcacggggaacgaacaggtgctctggccgccctcccatgtgtactagtatcatggatgcatctcttctgtgcaattgttcatggttgaatcctttgttcctctgttccagattatccaataattctatgtgtaatcaagtaggtaattattattacggtgtagtagcaaacttttcaaggttttttttggccttagaatcataatagaatttactcagatgaagctgttggtgttgagatcggcaactgctaatacggccgaatcatcattctagcaagtcaagagagatttagaggcatggatgaacattactaatagtgctatcacataagtggtttaaagagaaattcagagtagtacatcactacatctcactataaaaaccaaccgtagcaatagctacttacacctgacctaaatgagagctcctagcgcgggattaagtgacgcacgcgggattaacgctagcacgtcatggaaaaaaaaaggggctgctagcacgcacgcacggcagccgctttcctttttctctctgatctcctattttggtgctttttggattttttttaaatctctttcttttttttctccacacgcgcgcataattttttttcaatattttacaaattcaatctttcacctttaatatcagtcgagagttttaaatttgagttgaatgtttattaaatttaagttgaatgttttaaattttgagatggaagttttcaaatttaagtcgaaggtgaaagtttttaaatttgagttaaaagttttcaaatcttgacttgattttttaaatttgagttaaaagttttcgaatccgagttgaaagttttcaagtctgaatagaaagttttcaagttcgagttgaaagtttcaaatcagagttgaaagttttcaagtctgaattgaaagttttcaaatccgagttgaaagtttttaaatctttaattgaaagttttcaaatctgagttgaaaaattcaaaaaatcttaagttgaaagttttaatcttgactcctatacatgtgcggtagtcaaaggcgaaaaaagaaaaaaaaacgtgacaacgccatatagtccatgggaaaaaaaagaaaaaaaggaataaaaaaacgtcacaacgccaataaaaaaaaagaaaaaagaaacatcgcgtctacacgggcctccgtttggcggcgtcgtaggcgcgtatgcgctagatagcttttccggacatgaatacctacctgaagctcaatcctctcactctttttttttcttttttgcttattcatctaaatactaacaagttgaataaactagatatcatgaccatccaaatgtgaaatgatattacaattaggcaaaaatcaacgacctcttccattcttcaatcaagaaaaaagaactgaatttcattctgccacaaaaatattgcattactgaactacaggcccaatactgaatgttggtgatatgggcctgggggtatcatgtttagagtgccccccaaggccacgtggccctcccccgaggggagtgaggccagaggtggggcggcggccactccttcccaaagactagtcagaggaggctgccccccaaggccacgtggccctcccacgaggggagtgaggcccgaggtggggcggcggctactccttcccaaagactagttagaggaagctgccccccaatgccacgtggctctcccccgaggggagtcaggcccgaggtggggtggcggccactcctacatagactagtcgaaggaggctgccccccaatgccacgcggccctcccccgaggggagtaggcccgaggtggggtggcggccactccctcccagagattggacggaggaggctgccccccaatgccacgtggccctcccccgagggggatcgggcctgaggtagggtggcggccactccctggccgagactagagggagaaggctgccccaggcgccacgtggccctccctcgaggggagatcgggcccgaggtcgggcggcgaccgccccctcccgtgactaggggtcggactcccccgaccccctctctaggtcaccacgtacggtgggttaggtgtccgcctccaggtgcccacctaccagcattaacggcgacccgagcggtcgcgccacgccgcatttaatgcggtgtgcagtgcactcaaccggtctgtgaccggtcgaatgactgatgggacccaggatgtcatgcgcaccatcgcttgtgtcaggcgacgtgcagcccgacatatcccatcaaataatgatggtgagaggttctcatcctcttatcccagccggagtcggtcctcccattttggtcaaagcaaggctcccgtttcccggtgtaataggagcccagaagtcttcacccattaaatggtgactgacaggggcaccccccgtgtcaggcggcaagatttgataggccccatcatcaagacgacgtgcgcatggcttcccaagccaagagacaagacatgcatttaatgcaaagattataatacttctccaccggagctaggttaggttgttgggcccatgtggtaaccccttgaggtataaaaagaggtccaggcctagtggtgggggggggggacttccgagcgaactggcgcttgagtctcgcaaccccaggcacttgtgttctacacttgaccataatcccaaacacaggagttggcccgaacctgtataaaccccttttgtctcatcgtctttgggggattgaaccccctcaagatcacacagcttcgctcaccgaatccttgaatctcacccgctgcccccagccgaactcacaaaggggggcctcacagttccctggtggaggagttcattctccgacatctggcgcgccaggtagggtgtgtgttcgtgatttttgaggttctttcgagcgccggcgcgacgagcgtcacaccgccgatgcgggggaaggcgcagcctcctcgggagagccgcgccaccctaggcagggggctaggcctcccacttcctcaccggaaaaggctagcggccaggcctttgtggcgagtcttcggaatgtccgatggcccctaaagttccgacccagcctcaccgagaagtacgacggcggcgtcaacccctccgagtccctccagatctgcacgacgatcatagaggcggcggggggtgatgaccagatcatggggagcttcttccccatgaccctcaggggccaagcgcggggttggctcatgaacctgctgcctgcctcggtctactcttgggaggactcttgcagttgagctccgggtgccgtcgaagcccgggaccccctgtgctggttcttccgtagcggctagctttggtcccgccggctggctatggtgcccggcccggctcaactaatcgtcctttcaaccttcaagtattttcaatttttcaattcatcagcttaatacagcttgaagtcttatatttcttttcccccattcttttctcatggccctgtgacgctcgtgtattgcgcattcgtttgcttcctcggtggtaagagcccaacctctttctcatctacatgaacgtttcctcgccaagtgtgggggctaagttttctagccctattccagccttaagttgagctccgggtgccgtcgaagccagggaccccctgtgctggctcttccgtagcggctagctttggccccgccggctggctatggcgctcggcccggctcaactgcagacagggatcgctggctctagagtttttcggctctcacactcgtgcaaaagtagtcgtccgtgtagaagggagagatattggaaggaggccaccgaaaggaaagagcaaacagaatgtgtagcgtggggacacaggctcgtgggaacttgacctcgtttgctaagtgatcacaggcttcccaagatggttcggaacccatggtggggggctctcttcgagctaaaggtttgaaaggtcgtgacatgcaagcaaggtttgtgtttgcttcattcatacaagcaattctttgctataagtctggggctacgattcctagctctatcctagccctgcgtcgagctttgggcgccgtcgacgcctgggcccccctgtgctggctcttctgtagcggctggctttggccctgacggctcgctacagcgcccaacttggcttgatcatgggtgaagattgttggctatggaaaatttagtcctcgcactcgcgcgaagataatcgtttgcatagaattattattgcttatatttatctgtcgcccatctcttcctcgtagtcccgcggtacccatgtgtcgcgcgctggcttgcctcccttgataacaaaaagtttgtattcgcttcatctattcaaatgattctttgctaaaagtgtgggggctacgattcctagctctattctagccctgcgtcgagctttggtcgccgtcgacgcccggggccccctgtgctggctcttccgtagcagctagctttggccccaccggctggctacggcgcccagcctggcttgatcacgggtaaagattgctggctatgggaagttcagtcctcacactcatgcgaaaataatcgtttgaatagataaagtagaacaccaacagaggttaacaaaaggcaggggcaagcgaggtacgcggcgtaaggtcacgggcccgagagaatctaaaaccgtttgctgagtatatacatgaaataagttcacgacctaaggtacgtgctaaactcccgagcccacagcgcttcggaaaccgggaggaaagtgagaagttaaggcaacgtatgaacgtgactaaactcccaccgcccaactcccagaatgataggatagaagatcgggcccacatgtcaactgactagaagattggcgtcaaccctgaccacctgggaaagggtttggtcagggctaacgccgggggctactgtcggtgatatgggcccggggtatcatgtttagagtgccccccactagtctttgggaaggagtggccgccgccccaccttcggcctcactcccctcgggggagggccacgtggccttgaggggcagcctcctccgactagtctttgggaaggagtggccgccgcccacctcgggcctcactcccctcgggggagggccacgtggccttgggggcaaccttctccgactagtctttgggaaggagtgggcgcctccccaccttgggcctcactccc

SEQ ID NO: 73648 - DNA, 13604 bp, Oryza sativa
tcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctcaagcaacatagggcagccagcgataatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcttacaattaaaaatgaaatgttagtacaaaacactctgttgatcgcaaataagcatgtctgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaacaacaccgtccacgggaccaactcgtgctcccgccagcggtagcccgagcaggtacgacacgtcctgcagtgtcggagccatctccccacagggaaggtggaacgtgtgcgtctcaggtctccagcggtctaccagagcgacaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaatgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacaccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacacacatcacatcacaacagcgttttatttcctaaatcgatagcattgttacaccatggaatcgcctgctgcgcgacgacgccttggccttgcgcgcctgcttgttgttccttcaccatgtggtcgcctaccatcacttgcctgtccagatagactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctaagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagacaacttctccttaggctcattctcaatccactgagtgaaatttctgatggccgaccctgacctccttctcattgttggtgggtcatcatgtaatgcaccaagaggtatgggaggctcgtcaccttcaacttgtggtctgcaagattgctcctctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgtatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactatatcttacaattaacactactgtctatgtctcaattcatactattatattctatgctctggatctacacatatgtgctgtgtactacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggaggccggcaaggggaccgcctgcaaaattccatgccccctcgccgcccatttgcaggcggccccccgcacagtacaatatcgccctagcggagggcggcaagggggccgcctgcaaatttcgttgacggccgtcgcccgagagcgaacggctgtctgccacgtcattttcgccgccctctgggatggcgatttttaaaaatcgccctcccagagggcggaaggcgactacttccgtcaattttcaaaatggaaaattattttttgtaaaacttttaataaaaaaaattaaaaataaaaaaaattcatccgaaagctgtgcacgtaactgacggccccatctgacacgagatgggccggcacagtgcacggggctacagctcactttgcaggaaacttagttagtgggttatgcggtggcccatgtaggataagaagatggtctactcatgcaacggtcccaatgaggcccaatattcgcaaaaaaaaaacaaaatattggacctggccccaccaaccaccacgcctgcgacaccttatccagggtcccactcgtcataatctctgtttggccataattggaaaccgaaactgcgcacagcagtactccatcccattttaatcctttgcacagagttcttatctcagttttcctaactcacctatcttgttttccgcgtgtacgttttttaaactgctaaatggtgtgtttttttaaaaaaattctatacgaaagttgttttaaaaaatcatattaatctatttttttaaaaaatagctaatatttaattaattgtgcaataatacgtacccaacccctccttctgaccacactcttaagagatcttttcaaattgatcatcatctaacctgtctatttgtttatttatgcagaagtaaatgcaatagttgcatgtctatttatccatgtgtgtaggagtaaatgctgtagttacatgtctgtttgatcgtgcatgtggacatcgttgcatatccacatgtatgcttaacacaacactttgattgatgaggtttaattaagagataattaaaaaatgccattgacgaacgtttaaatctaagaaataccatcaacgtgtgggttttaaaaaaataccatcgaacaaacgattttatcctaaaaataccatcaccgttaaaattccgtctattctacgctgttaaatacattgttcgtcctattacacttaacatagcggaatgaaaggaatcataatgacgatgacatttttgataaaattgtttgtacaatggtattttttagaactcacacttatcgatgatatttttttgtatttggacgcttgtcaatgacattttttttaggttatctcatttaaaaaaggaaggatgttttattgtcttggtcttgacgctattgcaaatatgataatcaaatttaaatagaggaagcaaccctttttttcctttcctttgtacaataaatgagctcactgctcacccatcttccatttctgctggctttcgtcaacgaaaaataaaggagaaaaaaaatatcttctcgccgtctcgcgtgctgccgtctccgtctccggcgatggcgccgccaccgccgccaccgacggcgacgaagtacttctggggcgactccccggagcccgacgagtactacgcctcgctgggtctccgccacgccgaggcctacttccagtccccctgcggccgcctcttcacgcactcgttccacccgctctccgccgccagcgacggcgacgtcaagggcgtcgtcttcatgagccacggctacggctccgactcctcgtggatgttccagaacatcgccatcagctacgcgcggtgggggtacgccgtcttctgcgccgacctgctcggacacggccgctccgacggcgtccgcggctacctcggcgacacggaggccgtcgcgagggcggcgctctccttcttcctctccgtgcggcggagcggcgcctacgcctccctcccggcgttcctcttcggcgagtccatgggcggcgccaccaccctgctcgcctacctccgctccccgcccgacgccgggtgggcggggatcatcctgtcggcgccgctgctcgtcttccccgacgacatgtacccgtcccgcgtgcggctcttcctgtacggcctcctcttcggcctagccgacacatgggcggtgatgccggacaagaggatggtggggagatcgatccgcgacccggcgaagctgagggtgatcgcgtccaacccgcggctgtaccgcggctcgccgcgggtggggacgatgcgggagctcgcacgcgtgacggcgctgctgcgggagagcttcggggaggtggcggcgccgttcctggtggtgcacggcaccgacgacggggtgacctcgccggaggggtccaggatgctgtacgagcgcgcggcgagcgaggacaagagcctcatcctctacgacgggatgtaccactcgctcatccagggggagtccgacgagaaccgcgaccgcgtgctcgccgacatgcgcgcctggatcgacgagcgcgtccgccgctacggcgccggcgccggcgccgcggcggccgacggccacgccgaggcgcccgcggcctgacgacacggcggtgcgattctactatgctcgatgtcctcctccaattcgctagattttttcctcttcctttttactagtatcgaattatctccacggacaaatgttttttttttaaataatgtaaatgatttacactcctggtctctaataatgtaaatgatttacatttgtggtttctacaagcaggcgcacaatcaataagtaaagagaagataaataaaaaaactcgaggttatgggataaatcccatctaggcatctaccatctccctcctgataatattcaactataataccaagtagaaaatacgtagaaactataacgataatatcaagcactagaaactacgccatctaaaatagaactcccacggaatatgtgtaggatgaggttgttactcttgcgaagattccaatatgatttctcatctaagataataccaacaaaacgatactcctactctataatattacgttcgttctcaaataaacgacctaaataaacattatctagtacaacgaatttaaatagatacgatacatatccgaaataggtaatgcacagatttattgtaatactccctctgtcccaaaatataagtatttttaaaatagtgccaagttaaatataatgtttaactttgactattaatagcaaaaatcaataaagatcaatcgtgtaaaattgatgttactggatttatcattaaacaaactatcataatatgcaattctttttatttaaaacattttacttttatagatattattggttaaaatagcatctcgaaaactacgtcgaagttcaaaactgtttatattatgggacggagggagtaaaatataattttgttatagcttggttttgattagtgtgcctcctcgtacaaacaaatgtctcacgtggtaatagaacttttgccgacagtcagacacaacatgcaaatgttcagagttgagttcagatgaagagctttatactatacttcctccgtgcaaaataaaaaggcaaactgtgggtttctgtgccaacgtttgactgtccgtcttatatgaaaaatttttataattagtattttcattgttattagatgataaaacatgattaatactttatacgtaacttatctttttaattcttttcataattttttcaaataaaacgaacggtcaaacgttggtttgtcttttttgggacggaggaattactactgaacagatcacatggattgcagatcagatcagttgactccacgagaggatccccaggtccggagctaattcccgatcagtgtggaaacgcaagcgatcgaccaacgacgtcgcgatggctggttcagcgtggtcaggaatgttcgttcgatcgacatagacctcccaacgcgggcgccgcaacgattcccggtagagtgtttagggtgcgatgttcaggctaaaattggaagtttgaataaaattgaaacgatatgatagaaaagttagaagtttgtgtgtagaaaaattttgatgtgatggaaaagttaaaagattgataaaaaagttggaactaaaccaggccttaatgcgctgatcgagatgacgattgagatgtatggtgccaccaaccggttgcgaacagccgacggtttggaccagacaggcgttgagctatgatctcgtcaatgcctcctgtggatgaacctggagaacgctacgcgtcggacgaacggcgcgagacgaataatcggacgcatccatgagccgtccgatccgcgcgcacgccatcagccatccaacgttatcaagcatgcatgcatgcaaaactatttaaactattttttctcttaaattattatccaaatcatgatccgattgcaccattaaatccgttgcaattaaatctttaaaataagaccacacatgaatatattccggtgaaaaaaaaagcttattattgaattatttttaaatgttgcacgctgtttcaccaagtatattggaattgtttcactaggtagatcgaaaatgttttaatcgtttaaatcggacgctgcttcaccttatataaaaacaatgtttcagcaaatagcgaaagaatatttcgagtcaccgcaacatttgatccatataaagtgaaacattttttgtggaagaaaaaatgaaacgaattctcttaatagatgatttctataatatgtgagtgatttgttgtaaaagaatttttcaattcactacaacattagatctatacataaacattgtgagtacactaggtaaaacatttttagtggaatattgtgagtacactagtgaatacttattgtaacactcaaccaatacatatgcaacatttacaaataaactagtgaaacacaataaactacttactgaaacatgcaaataacaccatgagatatattaaagaaagatatatgcatcgtgacactaaataaatatgtgcaacataatagaatttcagctgaaacatctaattttcacatgtgaaacattaagtttaattggttgaaacatatgtgtgttttttattataatatagtcatatgagatcttgttgtaaagatttaattgcaacgaatacaatggtgtaatcgtatcatagattggatgagtaatctagaagaaaaatcatttttcaagtttgctaaaaaggtgttatgtacatgcaaataacctcgtctcatctctctttcatgcatattaatgctcagaaataaagcgtatgtaacagagagagcatctgacaaagtctgtatgaagcaaagtcatagtaagatgtgtccgatttttttttcaagatcggacgaccgatctgaagtgttttcctagttgttgctatgtgtacagtgtcgtttgtagagcgtccgatttttctccccgtgtcgaatgttcgagacgaagcattttcgaatgaaccttcataacatcctgtagaaagatggtttcatatactttatgtcggggaaagcaatagaattgaagctgatcctggcctggtcgacatgaatccaacagaactacagtaagctttttcagaagtataaagaacaacaccaacgaacccggcccgtccggagatgacgataagtagtagcttactaagagcaggtacaatagcagactattagccagttataaatatattttaatgagataaaagatgagagagaagagcagcgggctacagatatgtagccagctgcagcacggactctaagacgcagtgtgtatatgacaggtgggaccatatattaatggtatagtaagcaactattgtatgaattgactattagattggctatagatgaattggagctagtagtgggctatactattaaacttttttaacgtgagaatgaataagggtgtaggggttcatgttcatgggttagacccttagaaattaattagatccctcccctatacaaatcacacagcaccgtataatttcacaaactcaattcctccctaatacaagtataatttcattctattacacatggtttagtaagcaatattctgctattggtaacctattacaaggttggtttaataggcagaatatatggttgcatggtaccaagtcatgttattttacgcgtgcgtgcttgcggtaatataacattaacctctcactctccttaccatcccacctataaaattaacactccatgaatatgagatgaatactattctttggacttcatctcaatttataacacatatttagcactccaaataacatcaaatgaaaaatttatgcataatttattgttgaaacaaatacaagttgagatgcatataatgtcaccagtcgtcgtttttccatattccttacattatgttgttgggattaacgtgatatggtataaacaatgttaataaaacatgagttaggttgggattgatcttagaaatttgaattttattgattctttgttatactaagtaacaaagatataatttttagatcttattgtttctgtatgtatactactatgctaataagttatatattagagtgtgtacctagatttcttcataccgtacattatgatttcaactagattattgatatggtatgaacaataatgttgataaacatgagttagcttaggattgattttaacttttggattttattgattttgcagtatactacagtaacaaaaatacaatttggatcttactgtttctgcatgtatattactatgctaataagttatatgttggagtgtgtaattagatttcatcataccatatattatgattccaacttgatgattgttatttttactcaatatttattattttcaatggttaattttgactgaaagattgtaacctttcttgtctctgttttatacaacttggatggtttatgacccggctaatccttgttagttgatatgataaatatcttaccactaaattccatgacaataacctatgtactttatttttgttgggaggataaaatttgttttttaaaacgacacatatctaatccttagcattaaccatctagttttcaaatttctatttaagatgacatgttagtgctatttgtttttctccaaattctcatagagcaaaacaatatactatcctatatatccctaactttcaacaaataaaagagaagaaaagttctacagttgcaggtgaatctgcaggtagactcactgtgtttatataggagatgattctatcatctaggttttgcctttggtcattcatgcatatgactacatcacgtatacatgatagaccagtgagcttcagaccagtgagcttcaggacattttccatgatcttttcttcagcatccatcttttttcatgaatgttcatgagtttgggaccggccggcggtaattatctctcacactcctaccacgaaagtacgtacaaaattttcttcttattacaggtctctcgtgtgccgtatatgccgtcttgactgctcattaaaccatcatgcatcatctgtgctgttggcctgccaccaacccttgttttctgcatgtcgaaaacataaaatttcatgtgcaagctagagttacgacgactgttttcttcttttattttgtaaaacaaaaattctaccgactatagggtggcctggtgtggttcctggccaaggccatgttagcatcttgccaccgttaagaaacaaaccctatatatgcatactttatcctttctgtagagacagatgcgggcctgcagcaaacatgggtgatgaacaattcgattgatctggctcgagacagaggacagttggagatgtccctctttttcttcctaaaacatggtagaaacgcacaagctaatatagacatgtgcacactcacttatagaaagacatatacacgctctacccctatgaggttagcgacctaggctagatcggcacacgcacaccccctatccctatgatgttagtggcatcttcgatagactgagttggtatatcttaaggttgatgaaatcatcacacacacatcaatattgactgtagatatacgcaccgattttaagcctaggaaaaaaatgctttttctctcgttctctctcgaatcctgtcgcatcccgtcttagcacagctctcttccatgccatcttccccattttcgcaagtggaggatagaggggttgggcttcacggctcctctagtagtagtacttttagtcgggtcctcctactttctcgggctattcccatggattttactcttttggtcttcgagatggctgttggcttcggatgccatcgtcctactgtcatgatgttagtctccgggattcctcctgctaacgagctgcagcatcgccatcatttctttcctagcagccaactgtggtactactagatgtgcataaggaaatgttgctccggcctacacatatctcttcggcgagctctgtgcaagagaggcagccttcttctagatctcagggaggattcctcaataggtggttgaagtggttaagattcacgaaggattaggccccatttaaaaatggacctcggtttccttcgtagttcaccatgtttcatctatcttctttgatggggttatagatctggccgattcttatg

SEQ ID NO: 73649 - DNA, 23830 bp, Oryza sativa
ggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatgtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccgctgatggtgacagctcgctacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacgtacactgtgaagggcgtcagtcctgatatcgtcaggctgaggctgttcccattttccctcctcgggaaagcgaagaagtgattctatgccaatcgtgctgtgataaactcttgggaaaaatgttcgacagcattcttgtcaaagttcttcccgatgggcaagattaatgcccttcgtgggtgaatttcgggcttctagcagatgcgggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacgggtaccacccgcaaggaggtcaggggtggaaccagccccgtccgtatttccaagaaggcaataaccaagctaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagaaaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaagattcggggtgtcccacaatcacttgctcaatctagacacaaaaattcgaccaggcactctgcgaccttggggcaagtgtaagcgtcatgcccaaggacgtcttcgacaaactcaactttacggtgttggcaccaacaccgatgcgccttcagctggctgactcgtcggtccgctacctagccgggatagcagaagacgtgccggtaaagatacgggattgctttatcccggtcgatttcgtggtgctggacatggacaccggtaaggagactccgctcatcctgggcgtccattcctgagtaccgcagaggcaaacattgatgtcggaacaagaagcatccgtttccacatcaatggaaaggaggagaagttcgagttccagccgaggacgaaacaatgctccatggtccggttaaagtacgggccagccccgtagaatattcagacggtcgaagtggagccacccaaaatggacagcctcatcgctttcatgaagaaatctctggagatacaaccttccaggatgaggtcccgttattggaagacaccggcctagaaggaagagaaaccggctcaaaagaagccgccgcccataccaaggacaaataaggtatggtggctgaaacagaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaaccggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccatttttataacaggaatcaatcgtgtaaatagtaccatttccctggatcaagtagtctggtacacacgaattcatagctaaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtaccaaccgtactcagcaagccatcatagcaatgatgcacatgacagaggaattcaaaggatggctatggttctttttgcacaaagcaagttttgtaattcttttcacaagcctaagacctagcatagactgttcaagttttaataccagtgttcatattaaataatgacggttctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatatagggcacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactagggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctacaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcaggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggcataaatattttgttgtcataagtttttaatttactcttcccgagcattatatccatataataggttagaaatttctattaagagctaaatatcggaggaaatcctagaaatattatacaatttaatttattctatgactaaacgattaaatataatatgcggctaagattcttagtaattaaattcgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaggaatttccaaaaataatctatgattaaccccgaccatttttatttcctaaatcctcctaatttctcccccaatttcccttctattttctccttttcttcttttctattttcccaatttttctctcctctttttctttttctctcttttctctccctctctttctttttctctcttttctctccctctctttctttttctctgccggcctctcttttctttttcttttctttttttttccttctcttctctcctcccggctcctttctttcttcccttctcttcctctatcctctttcggctccttctcctcctctctctcgtcctgcctaccgcgaccggctgaggaaaggaaaaaggcggcggcggcatggcttaccggcggcaacggcaatggcggcggcgcacggtggctgcgacggcggcggcgcacggcgactgcgacggcggcggggaacgcggcacggccaaggcgcggcgcggcagctctatgcgacgacgcggcggcgtggaggcggcgtggtggggtgggtagaggagaggaggtgaggatggagggaaagagtgggagtagggggggattatataagggaaggggaaagagataatagggaagagggaagaggggcggcggcctcatggtgtcggcggggtggcagggcgcgggacgcgaggagcggcagcggcgacgcgacggccgaacggcgacggcgcgaggcgatggaacgggcggcgcggcgcggtagcagcggcggcacggggctcggggaagcagcgcggcacggggcgcgaggcggcgggctcgcggcgcgaggcgacgagacggcacgcagcgcggcaatggcacggctcgaggcggcgatggaacgcgcacgcggcgacgggatggcgacggcgacggcgcggcaaaggtggcgcgcggcacgaggcggcgatgggatgcacgcgcagcgcggggcgggacgcgacggcgacggcgcggccgcggcgatgagatggcgatggcgacggtggcgcggcggcaggcgacgagggcgacggcgcgcggcggctagcgacgatggcgacggtgcgcggcggctcggggcgcgaggcggcaacgcgcggtgacggtggcgacagagacagggggaaaaaggaggagctgggttaggggaccccgtcgaacactttaggtgcaatgaacagtgccgttttctaattaacccgattttagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgatatcaaattcagataaaatagacgaataagatcggcatgatgtaattagtttaaaaagtttttgaaaatccgtatttttagagttttgattttgtcggtcgaattttcagggtgttacactttgtttcctagaggtgatctttgacccattcaaggagatgaattgattatcatgtttgccatggttagaaaaattaaaattgctcctgttaaatgtatgattaggcaatggttagtgtcgcgaccgagaaaattgcattttcccgaacgctagtgtattaatccccgtcccaggaaaagccggggtacaccatacaaacatgatataaaagacacatctgtattatatcgataatatttacattattacaaaggcacttaaggcctgacaatcaaaaataaacagcagcggactagcgggcctactgctccatcttcacaggcgctcaactggggtataagccaggactccacctaagacttcttctccaaagcttctcttactgaagaggggaaagattgagcaagaatgagtacaaccacagtactcagcaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattttagttgttaagcaaattttaggaattaaaacgctaacttgggtacattgctcggcttgcccataaccgagggcgcggctattcgaatagattatactctgatcagaggtgtacaactttacccacaagacacatcttcctcacgtgcaaccacgtgccacataccaccacggtatacaggcggaagacgcgacatagtttccaacccatcctagccatagagaagagtaccgacccaatcccacctacggccggaacctccgggacaggcaggcaggactgagcccccagcagcagggcaccaaccctgtaccatgacatctcgactaccgggccgcagctcgtgtagccttcatttgccctggagaatgtccatcgacccccgacttcatccacctccaatcttacttttgtttataacttgactgagccacaaactaagccttacccactagacatgtgaaagtacggtagtgctttgcaacagaggcccgaagaccggtccttatatggccgaggtgctactatcaaaaccatgcaccctgagcccagcctaaaaccattttggggattttgaatagagggggcggtgtgaatccaattccacaataaaccaacaattccaaagtgtccaagtgatatgagaattccccaagtctaaagttataaaaccacctaatattgtctaattaaacagcgaagcatctacctaaaatcatactagtggtaccatgagtagagtatccactagttggggttttgtttaatctagggtggacaaggtaataataacaataacaacaataatacggtcataacaaaggtaaataggcatggcttagtaaaaccgtgataacgcgggaatttaaataaagcgataatgcaataatttaaatcaaaataattttataaactgggattcaatatgttcaaggatgatgtgacttgccttgctcactttcccaaacgccggcttcaacttccacgaagagcggatcttccaaagctgcagcgtctacacgaccaacggaaaagaaaaggcttttacgctaataaattccacataacagcagaaacaaagcacaaaaatgggttcttgacttcttaaggaaaaattagagacttgaacggtccaattacgagttcaaatggccaagttatggccatttgaagtttatatgttctttaaatggatatttgcgaatttcttcatttaaattttaatttaaaatcgaattattgcgtcagccgggagagagggcgcgcggaccgggtccacgggagtgggacccacgcggcagcctctcggtccacggtggaccgggtgcacgcggctggcgccgtgggtcccacgcgtcagccgcacccgcgggcgcgagcggctgacggccgggccccacctggcagccgcggggcgcgcccgaaggcggcctcgccggcacggccgacgggaggcggcgcgcccgcgccccgatggtcactgccggcgaccaccggcgcggcggagcggcgcccgagagagaggagagaagagggaagtgaagcggcggtcttcggctcaccccgggtcgacggcggcgacggaaacggcgaccgaagtggaggaaggcggcggcgcggttcgggtcgacgaggacggcggtgctccggcggtcggcgggcgaaacggaggagcggacgaggtcgacgaggacgcggcgaagccaaaggaggagacgccgagacgagaggaggtccggggcgacgacagcggcgaaccggagctcggcggcgacggcggagagagaggacgacggcgcgggctcgattccgaaggggagagtgagcggcgagcggcggaaacggaggagggaggcacggggaacgattaaatagcgtcgggagggggagagagcggccgggcgagggggaaacggccgcgaaagatgcggccgccattgatgccgacgaggtttaggggaaagattccgagcgaatccgagggagagagagagggaaaagtgggggaaaagggagagggaatcacggggaatgattccccccactttattgcgcgcggggacggcgggatgcggcggaatccgcggcggcggcggcggcgctagggcacgggcgggcggcgggagcggcgcgaggatagggatgacaggcgggccccacctgtcagcgagggtggcgggcgggcccgcccgtcagcggcgcgcgcgcggggagaggccgagtgggccgcggggagaggagagggaggggagggagatgggccgagccggcccaagaggggaagggggaaaaagaagactttttaggatttttctttttataaaatcattttaactttgtttatttcttaataattattatttgtgctctgagaattccactaaaatttgagggctccttttagaccaaggagaatttaacaaaaaatctccgggccacatttgaatttttcttatacgtattttagtgtttgccaatttcttttcgaattttaattaattctattattccttttagaaaataatttttatttcgggatgaatttatcaggacgtgacagttagaaagtattaagtatactgcccctgttgagtgtacttctttgatcacccgtatagcgaatggccttggagttattaccaccgatcagatcgagtatatatccactgtccgtccctatgaggatgaaacatacttagtacaagggcatatacttaagcatggagacgatggctcattgatatactttttccccggttgtacaaatgaaatcccattacccaatgcggggtatcatttgtacaactgtcaggaactaaccattcccctacagaccatagaagaatcttgtgcaggtacatcttacaggaagacacgcaacagaccaaggcaagagcatgaggagtcatcctcatcgatacctgtgcagatgtacgaggcggactgggagccaacgggagatgcacccggttggacccaggcaccacggcacagcaccggtggttcttcctggcacagtgccaatgagaatcgctggcaagcaccgcacgacgtacactgggggaacgcgcacacccgttcctctggatcaagtgggatgcctcctgcttccaactggtggcgctcgagttcctctcgggacttgggtttctcacgatgaggctggacaccctttatatgcaggcgggtgagaatggcagcaaaatgctgatgctcagttcgtcaacatcaataacctgatgcaacaatagcaggctgatcttcaagcatactttcgcttccaagggttcaatccctaccagggacctaagtgaagggctcaattcctttccaattgcatatttggatttccacattgcatcctataaactaaaaatgacataaaaaaatttgcaaaatagaaaataccaaaaatataggttagagtttattatgctaggtaagacaactagttctcttgttgagatgatgaatagtttctctgttttatatctcttatatatgggttcacggttaagtacgctctgaaagattgaataaatagtagccacatattatccgggaacctgaggtaagtgggctgcacttgccgaactaagtctaggttgtcgcgagatgatatagtgataagagttgctatgatcctgttctaagtttgacttaaattccggatgttttattttccaaaatgataaacttaaaagttcctcatttgataaaaattcctaccagagccaaaaattttcatatttgataaaccatatatattttgggcgcttgtacttccattgaactttgtcaaaatcttgagacttgtgtagatacttttgatactctatgatcaagatcatacacccacatatatgcacatgcaaacttctgcactagaagttagcattcattcattccatctatatccatcatgctatcacccaaaatcaagctctccaattatatgctttctccttccaatataatatcctttccaaaaagagataaaaagagggaaaggcatggttaggaaaataaagtcttgctcctcaaaatattgagcatgataaaaaaatgagtagccatgccccctccaaaaaaagaaatgaatgatcttgggagaagaaagaaagcacaaaggagaagtatttcctttttttttccacattctatttccaccatatagcacacacactttatgcacgatcttgatcttgagtatgtctagtcatctgctctagtctaaagttttgacttagtaataaatgcaagtatgctatgtttgatacctaccaagctccacatactaaaccttagagtaggaatcaactaggctactttggtgaggaattcatttatatacactctgagtgatcgagagggtcatttgaggaacttggatttcttttgaaagatcatttgaaaacttccggaataaaaggttgaataaataatgggtgactagtgcttgattgctgttctatcttccaaccgcacaagacaaggtaaagcaatgtctcgcgggaatcagttgtaagggtaagacacgtgtcaaaattatttgatttgagagagtatatctaccttgcacttgtacatttgagaatatacagcatagtagcaactcctgatcaacaatcaagttttgtttccttttgtcctttactcgagacgagcaaaggttcaagcttggggggttttgttgacggtcgttatcgatcagttacgtccgtcaatattactagaataaaagaactagttatgcttgcaatgcatatagtgtaataataaaataaaaactactagtacttggttcactaaccctctgcagagaatgggccataaatggagaaaaatcggcatcaaaaccgtacctctggtgtcttagctttatgaggtgcccagtttcaaaggtacaggaacaggtgtcttctctttaacctgccatacctcctttgtttttggtgcggtcaatggcttcttcgaaactgggaacgcaggttgaccgacttgtgttcctggcttcttgggtgccagcctaaggtatcaacggatcctcatttcttcttgatctttaggaaattcatcatgaaattgctgaaactgtcacgcccggaaaatctatccaaaattccgaacgcttacatgtgtgttaaaccctcgtccaggaatcaactgaggcacacaataacaaattgataatagagtacaaataaataactatttaatattcgcaaataataaattattacagaggtagatagttcctctcaaagaataacattctacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcaccccccttataaacaaggcatggactccccagcgacccccgtggacttctcgccacttctcagtctgacgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaacattaatataacatagtttataattaatccctttaattagctatgtttctaggcatggctaagcaaacttacatatagcatttagctgaaccaatccaatatataaggttcatgctaatcaaattataacccataggaaaataaagtcatcttcggccattatttaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaaaggaaacgctctcctccggaacgtcagaaactaaagcaattaaacaaaaatcaacaaaacagtacaaaaacaagcataaacagtacatgtggatatttttaacatgtaaatcttgattttagaaaaatttaacaacttgaaccacctaaaacggatctacggttatttagttatgattttccgaagatttaatctattagaaaatcgggaaaaagaaaaaccgatgacgtcatgctgacatcacccaaggcggccgaaccacgatggcgacctcgccggagatagagcggccggctgcggaattggagggcaagaacacgtagaggacgacgagacgaacccaacggtactcaccacaacgacaaacgacgtcggacgacttccggcgacgacggggaacgagcggcggctcgggttgaccgacggcggcgagctacggcggccggcgacgaaggggaaagggcggccgagctactccttgctcctatgcacctaatggcggcgagaaaaggcggcggcgatgacgcaagcggcggcgcggcgcggctgagctccggccggcggcggcggcgtcttgtcacgcgcggcggcggcgctacggagcactagagaccacgagagagggggcaaacgaaagagggcgacgaggtggtcctatttatagccttggattgaagagatcggactcctcccgcaagaaatcggtccgagaaatcaaaaactcggttttggagataaactcgaaaacgagtttgattcagataaaatacccaacgatttgctccgattcttgaggggaaagatagaggagaacgagaggatcaaaacccctcaaaaatccggaagaaacggggccggattgggtgcggatttgaggcggcaaggcggcggctcgggcggctcgggctcggcctatgccggccggaggttagggacacacccgacaggtgggtcccacctgtcggcggctgaggggaggaggggcgggcggcgtcggctgggccggcttgggccggttcggccgcgcgggaaagagggagtgttgggccgaaaacggcccaacaacttaaaggaggggtttttgaactttttaaataaaataatttgtgaaatgttgtttcaattattaaaaaaatacttcccttgctcaaataattcccagaaaattctagaaaatagaagagcaagcatagtatttaataaaattttatctagctcacttttatgttgaaaattttcctagataattaggttttagcttgtaggcttttaaaatattttctaaaaatcatttaaacaatgcatttttaatttaggcgatttttagggcgtgacagcccagtttcaaaggtacaggaacaggtgtcttctctttaacctgccatacctcctttgtttttggtgcggtcaatggcttcttcgaaactgggaacgcaggttgaccgacctgtgttcctggcttcttgggtgccagcctaaggtatcgacggatcctcatttcttcttgatctttaggaaattcatcatgaaattgctgaaactgtccgtctttcggggtagaccttgacctccttgtgggtttggtccgtacttgatcttccccatggagcaatgctccatccttgatctccttatggacgatacccgttgttgctctcgtgagcatgagtccttacgggttttcggatgatccatcccagtgtgactggcattgccacggacctcacatgtcatgtgagtccagggccttaacagcaccctgcttggcgtccttctcattgttgtccagtctcttaataagaagatccaactgagtggccagcatttccgtcctcttgacggtgtgcataccgtattgacggattcggagtcgttcctcgctccaacccatatttgagaccatcttctcaatcagctcggtggtacctctgaccgtctttaagaagaatgtctttccaatagcagtgtctaggtgatcccaagatgagggggttaatccattgaaaaaactctacaggatgagccactcgtccatcccatgatgaggatgggcggtgacatattcctgcagcctttcccaagcttcaggagttgtttcatccttcggctgctgaaagctggatattcttccacgaagagcgttggtcttacccatcgggaagaattttgagaggaatgtcgttgagcaattattccggatattcacaattgcacagttggcgtagaaccactgtttcgctttcccgaggagggagaacaggaacagtcggagcctgatagtgtctggagtgactccgtgctacagattttcagcaattcctgcatatgagcacttgcatcctcgttaggattgccacagaaccggtaaacctgcgccatcgtgattaggctggtcttcaaagttaccatctcccatgctgacttagggtccaacgggcacattgtcggcggagggagctgcgaacttgcggaggatcttcccagccatatcgttaaactctagtggcacgaaaatggatggtctggttgctgatagagtaacttgaggagggacaacacggggtcgaggctcgctccacaagtgactcaagattgaaattggttggcagatcagaactagtcttgtactaccctgttttcacataaaagagaaaacatacaaggtttgcctacataggatagtgattatacagaggtaaatataaaattattagcaagtagtaaactctgaatgatttatcttccccgacaacagcgctagaaatgcttgttggtatttcttagcgacagtactggaaatataattctcagcaatagcactagaaataatcccggtatactatggttacagatatgatccgcaagcgcacgaatgtaccattgtagcatttcacccggaagtattctaaggtatcgtatttaatcccaatggaagatatgataagagagaattatactaataatttatatattagttgtgtacatcaaggtctatataggggttaaaataatccaagagtagagtaacacacagcaaaagacctagcattcttaataatcatcaagtatcacattattcacattagtgagtagtgtgggactaatcacgaaaaacattgctcaacccgcccataaccgcgggcacggctattcgaataattttactctggacagagatgtaccaccgtacccaccatgtgcgtcaataccatcatggtacctaggaaaggagctgtgacaatacaccccatacaacacaactcaccacagcgcaccgttcctggatcgtagtcacccctttataaaacaaggcatggactcctcagtgacccccgtgggcttatctccaccacttctcagtctcttgccccgtaataaactatgctatacaaaaggtaaagctgttgcccacgctggcttgtggttggcatggttaatgtttcacaacagtagctcgcgaaccggtccttaattgtcatgagcacgaccaccaaaaccatgtgctcacaacccaccattaatcaagttttaattggcaattaattaattaaccaaacacgattgaccaccgtgtgcaaacattaaatagcaatcattaagtaataatgaagcattagttatccccaatagttaactaatacttctaagcatggctaagcaattatatctaatatctagctgaaccaatatataaggcccaagctagtcaaattataacacaggaaaataaatcttcggccataatatagggaaaaggctcaccacccaatgacattcgaaaataaatgcatatttgaaataaaaagagaatttaattatatgttcaacatgctcaaaggattgtgtttagtatctgtgtgacttgccttgcaataatttcaattagtcttctggatcacttccgatgcactcatgatccttccaaacgacgaaaacgacaaactaatacgcaaaacgaggaaaaaaactaaggaactccaaataaacagtacgtaaaaagtaaataaacatgtagaccatgattttagatgaattatgagacttgaacggcctcattctgacttccaatggattaattatgaattttacaagatttaatacaattaaaacctatttaaaaggattaaacagattaacaacacaatttataagtaattttaatatagatctctattttatacaaatttagcaacttgaaacacattaatccgagttataatgaattagatatgatttttctaagtttaatatgatttttgcctaatacagaaaagactttactaatttattaatgtattaaataaaaggaaaaagaggatgaaggacggtggctcgggaaacgaagttcgccagcgatctagggcataagggcgcgaacggagggcactaatgcgaaaagtacaacgcggcgaactcaccggtggctagaacggccgagattgacgacgaacggcgacggcggcgaggttttggcggcggcggccttcgggtagtcggcggcgatggtgctccggcgggttgcggcacaaacggagggcgggacgatgtcggcgacggtcacgcgaacccgtggacgtgaaccccgtgcgactgcggcgaccgaggctacggcggcgctcagctgaagcagctccggcggcggcggcgcaaaagacgacgcgggaacggcgctagagggggcggcgggcgaaggtggaggtgatgaggggtagaggagtcccagggggtccttttatatgggtcaagaggcaccggggagggctatggcaagccggcggcgacatggaaggattagcgtttgattaggaaagagaaattcgaatccgatttgatttgattaatccatgcaaaattggactccaaatcttggggaatggaaggaggaggatatgggaaatatttcccctcaaccaatttttgaaacaaagcacgggagagatcggatttggcgagggggcggcggctgctcgagctcggctgggcggctggaggttgaagaaggcactgtagcgatagggagtcacactagactttttctgcggtttccttcactaggcccgattgaagaagggacgcgaatcagactacgacagagagagggagagggctgctggatcggcagggctgaaggagagagatcggccagattcagcccaaggcatagaagaggattttgattttttttttcaatttaaataaatactgaaatgatctttcatttattaactatacttccaacgctcacataattccaagaaaaatcctgaaaataattggacactcaaagtattcaacaaaattataatcagaccatttaatgattaaaattaggatttagtatttatataattgctaaaatgctctttgtattattaaaattaggatttgagctccgaaaaatacgagaaaattccagagagtataattaatcgtagagaatttaataaaaattaaatctagccattcttaacatttaggaaattttatttcccacatttaactttacttgtaaattaatgaatatttaatataaattgtagaaataatttattaaataatttataaatcctgaaacgaaaatcagggtgtgtgttgatgcgaaaaacacacaccggcctgagatatgcttaactctagtgcaggtccaaatcttggtttcgagttcgagggtatgccagttggtttgatcctgcaacgaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaactaagtgattgggatagatcggacagcttgccgagatagtataaatcacttatgtttaaaagtaacttgaatcagatattatatatgttcatagcatagccggtgttttagatctaacatgtattggctaatactccgataccactttatactaagataacaatataaacaaaatatattaaatagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacaacattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttctactataataaccggaatgccgagtagtgactgcgagagataaccataagatagcttgccagtccactccgtcatatgctcgtcaaaccatatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcaagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagtaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatagaatcccatccataataatccatatttggtgctaacataactgactaacacatcaagcattgtccataaccgaggacgcggctattcaaatagattatactctgattagaggtgtacaactggacccacatgaaatgaacaaagatcaaatgctacacaccccgtcgagtgtggtacacaagtgattcaagctcattacatgcccatttttagccccaccccaaccacctataacatgctggggttcccgacgacttagtcacgtgcgtgcatgatgtgaccagtggcagtagggtataaggacaggggctgcagg

SEQ ID NO: 73650 - DNA, 50431 bp, Oryza sativa
  unsure (1)..(50431): unsure at all n locations
ccaaagtcaaaatatcttataacctaaaacaaagagagtagataactattttgaatcaaagtaaacaaagtgaatccaattttatggataacatgttactacctattttgataggtcacacacgtaccgagtctgagtcagcgtccgagcggctttggctaggagtccggatcagaattcgaatccgaatccgaaatagaatgagcgccccgcactataaatatatcaaccggcgatcgtataaggaatttggcatcgttgaatagcctcatcaccgtcgcagaccacccatcgcctgatctgcgcctgctgctacccatctgcttgctagccggggccgatcgatcgagaggcccaatcagtgatcagcttgcgagcatggcgacggacatggaggtggacgagatgcgccggtgccggcgatcgtcgggaggaagaggtgcgcggcggaggaccggaggatggagtcggatttgcggcaggaggcggagctccgtgcgaaggcgctcaaggacaacacgtggggggagatggtggcctgcgacgacccctggctgaaggagatcttgcggaggaggtgcgtgaacgcaatgcggacgagggccctccacgcccagatcaccaggctcatcgacgacatggatcgccgccatcgcaagttcttcctcacggggaacgaacaggtgctctggccgccctcccatgtgtactagtatcatggatgcatctcttctgtgcaattgttcatggttgaatcctttgttcctctgttccagattatccaataattctatgtgtaatcaagtaggtaattattattacggtgtagtagcaaacttttcaaggttttttttggccttagaatcataatagaatttactcagatgaagctgttggtgttgagatcggcaactgctaatacggccgaatcatcattctagcaagtcaagagagatttagaggcatggatgaacattactaatagtgctatcacataagtggtttaaagagaaattcagagtagtacatcactacatctcactataaaaaccaaccgtagcaatagctacttacacctgacctaaatgagagctcctagcgcgggattaagtgacgcacgcgggattaacgctagcacgtcatggaaaaaaaaaggggctgctagcacgcacgcacggcagccgctttcctttttctctctgatctcctattttggtgctttttggattttttttaaatctctttcttttttttctccacacgcgcgcataattttttttcaatattttacaaattcaatctttcacctttaatatcagtcgagagttttaaatttgagttgaatgtttattaaatttaagttgaatgttttaaattttgagatggaagttttcaaatttaagtcgaaggtgaaagtttttaaatttgagttaaaagttttcaaatcttgacttgattttttaaatttgagttaaaagttttcgaatccgagttgaaagttttcaagtctgaatagaaagttttcaagttcgagttgaaagtttcaaatcagagttgaaagttttcaagtctgaattgaaagttttcaaatccgagttgaaagtttttaaatctttaattgaaagttttcaaatctgagttgaaaaattcaaaaaatcttaagttgaaagttttaatcttgactcctatacatgtgcggtagtcaaaggcgaaaaaagaaaaaaaaacgtgacaacgccatatagtccatgggaaaaaaaagaaaaaaaggaataaaaaaacgtcacaacgccaataaaaaaaaagaaaaaagaaacatcgcgtctacacgggcctccgtttggcggcgtcgtaggcgcgtatgcgctagatagcttttccggacatgaatacctacctgaagctcaatcctctcactctttttttttcttttttgcttattcatctaaatactaacaagttgaataaactagatatcatgaccatccaaatgtgaaatgatattacaattaggcaaaaatcaacgacctcttccattcttcaatcaagaaaaaagaactgaatttcattctgccacaaaaatattgcattactgaactacaggcccaatactgaatgttggtgatatgggcctgggggtatcatgtttagagtgccccccaaggccacgtggccctcccccgaggggagtgaggccagaggtggggcggcggccactccttcccaaagactagtcagaggaggctgccccccaaggccacgtggccctcccacgaggggagtgaggcccgaggtggggcggcggctactccttcccaaagactagttagaggaagctgccccccaatgccacgtggctctcccccgaggggagtcaggcccgaggtggggtggcggccactcctacatagactagtcgaaggaggctgccccccaatgccacgcggccctcccccgaggggagtaggcccgaggtggggtggcggccactccctcccagagattggacggaggaggctgccccccaatgccacgtggccctcccccgagggggatcgggcctgaggtagggtggcggccactccctggccgagactagagggagaaggctgccccaggcgccacgtggccctccctcgaggggagatcgggcccgaggtcgggcggcgaccgccccctcccgtgactaggggtcggactcccccgaccccctctctaggtcaccacgtacggtgggttaggtgtccgcctccaggtgcccacctaccagcattaacggcgacccgagcggtcgcgccacgccgcatttaatgcggtgtgcagtgcactcaaccggtctgtgaccggtcgaatgactgatgggacccaggatgtcatgcgcaccatcgcgtgtgtcaggcgacgtgcagcccgacatatcccatcaaataatgatggtgagaggttctcatcctcttatcccagccggagtcggtcctcccattttggtcaaagcaaggctcccgtttcccggtgtaataggagcccagaagtcttcacccattaaatggtgactgacaggggcaccccccgtgtcaggcggcaagatttgataggccccatcatcaagacgacgtgcgcatggcttcccaagccaagagacaagacatgcatttaatgcaaagattataatacttctccaccggagctaggttaggttgttgggcccatgtggtaaccccttgaggtataaaaggaggtccaggcctagtggtggggggggacttccgagcgaactggcgcttgagtctcgcaaccccaggcacttgtgttctacacttgaccataatcccaaacacaggagtaggcccgaacctgtataaaccccttttgtctcatcgtctttggggattgaaccccctcaagatcacacagcttcgctcaccgaatccttgaatctcacccgctgccctcggccgaactcacaaaggggggcctcacggttccctggtggaggagttcattctccgacactgaaattcttatcgtcatcatgcgacggcccattactggcgagtaaataaaccagatatcatgaccatccaaatgtgaaatgatattacaattaggcgaaaatcaacgacctcttccattcttcaatcaagaaaaaagaactgaatcttattctgccacaaaaatattgcattactgaactacaggcccaatactgaaattcttatcgccgtcatgcgacggcacattactggcgagtaaatacgacggagagatctcccttttttatttctttctccggtcagtctcacgaataaataacaacaacgttgcgcttggacacacgagccagccatcatcgatccaaacctgataaagaacttgatcttgccgtcttggccatcttgctgtccctgtaaaatttgtcaattatgtgtgtgatgaagtgtgaacagcgcgttacattcgactgatcctgaaaataatcccccaaattaatatctgagctagtagctagctgcaatcgatcctgcaagctacaccagcggccaaaaaacgagccggattaaagccggtgcaattgcattgatgctcccaacgcccaatctgatcgacaatttgcactgcacgatcggctcaaatcagctcgtcagtcacactcgatgcgtaacagtgacagtgacatgtcactcctgtgtctgtgactctgtgtggctctctgtaaaaacgggatcgagagcgcgcgtgcgagcatgtgctcgtcgacggcggcggcgtcgcgaacgagtggatagggcggtgcgccgacgatctgatcgatccgcggctccgaccgcgacggacgtcgatttgggaggaaatgggttaatggaatggatgcacttgcagttacagttaagttaaccagagctttgctttatttgctctgctctgttttgtctgttcggtcactccgctggtccactaaatatcaccctttatcctgatcgattagttggatgggcacgaggaataactggtatgcttaaaaggtaccggtatttttttattgaccggtaaacagaatcaactctgtactcttcccatcaaaataaaggaattaacttcttactataaatttaaacatagaaagaaaatactagcaccgttataaaaaaagctatctactactccctccgccctaaaatataagtgtttttaattagatgagacacattctactatgtggatagattatcatacaaaacataaggcagcaagatcatttgaaccaagggactagggtagtacatagagaggaacggatcatgaagttaaccaagccataacaactttgtcacacataaatcgacgtatacattcaagacttcgggttggccatagcttcgttgaaacaaaagtagaaataacctaagtgagcaatagtttaactgattaggtttcttgtgatagaatttccctctgaatttctaaatgtttaaatttatagctgattattttttttattgctaggcaatgtaattgttgacaatgagatgtccgtgttgatttcatcaatattaagatataccaatccaatcttttaatatggtgtgcatatgtgtatttatagaagtgagtatatgaacgtttacgtttgtactgtgttctaaaaaatcgaaataaattttactacagtattaaaaaaaacttgtggttgtacgcacatatagcctagtcataccagccggcagtggctcgtcggcaaaaactccatcaaattttaatattgatgtgtaaattgatggtgaaatttatagagtaaatactatgaatccagttactctgcagtaatgttgagcaacattggtgatgtgaggagaacagtgaacgaatgcattgagcatcagcgctctactgtagctacagtatagtagatgttgctttacagcagaatttactgtagcagatcatccgaaccatcaatcacacaaccaacgatacacagtatccctaatgccatatattgtacctctctgccgtattacatttacatgctactcctataatatattaatatattatagtaacataatatcggatgagacatttcatattataatgtagacaccctcttatctagtatattcgttgtactatgaaatatctcatccgatactagtttattatattatgggagagagagagagtactgtaatagaggatcccaatccaaatacgaagttatattgaaatctattcgggttaaaagaaaatcttaagcgacgggcgccttcgtgactcctcatttgcatccaattttccccctgacccaaccgtgtgcccgcgccgccgaatacaatagaaacacacgcaaattaaaacacacctccaaaaccacgcgacgcgacgcgacccccggttcccctcaaaccaaacggttcgccgcaattcccaccccccccccccccctcccccaaaacactgccgcaccacgcctcgttcccgcggactccgacctctcccgaatccctttctctcctttgcccgcctatttaaacctctccctctattcccaaaccccaacatctccacttgactaatccacagttccactctctgattctcaattttcaatttcttaatagagaagaagcgatcggattaagcgatgagtgatgacgagctgattccggggctaccggaggaagtggcccgggaatgcctgctgcgcgtgggattcgaccagctgccgtcggcgaggagcacgtcgcggcggtggaaggcggaggtcgagtcgccgttctaccaccgcctccgcagggcccgcggcatggcgcgcccgctcctcgccctcgcccaggccgagccgccgctcgccgccgccggcccggctaacaagtacgccggcctgtccacctcctaccgcctcgtcctccacgaccccgtcgccggcggctgggccgcgctgccgccgctccccggcgccggtgggctgccgctcttctgccagctcgccgcggtggcggcgtgcggcggggagaggaggcggctggtggtggtcggcgggtgggatcccgagacgtgggcgccgacggacgcggtgcacgtgtacgacttcctgtccgggtcgtggcggcgcggcgcggcgatgcctggaccgaggcggtcgttcttcgcgtgcgccgcggtggggaggtgggtgttcgtcgccggcgggcacgacgaggagaagaacgcgctgcggtcggcggtcgcgtacgacgccgaggccgacgcgtgggtgccgctcccggacatggcggcggagcgggacgaggccaggggcgtctgcgtcggcggcaggttcgtcgccgtcggcgggtacccgacggaggcgcagggccggttcgccggctccgccgaggcgttcgacccggccgcgtgggcgtggggccccgtgcaggagcgtgtcctcgacgaggggacgtgcccgaggacgtgctgcgccgcgccggcgcccgcggcgggcgcgacgatgtacatgctccgcgacggccacctcgcggcgcgcgacgccacgaacaacggcggcgccgcgtggcgggcggtggcgagcctgcccgaggacggccgcgcggtgacggccctcgccgccatcggggacggccgcgtggtcgccatcggcgcggggagccacggcggcgagcaggcggtgtacctgctcaccaccggggagggcggcgacaagaacggcgcggcgcagtcgtgggcgcgcgccgcggcgccgccggagttcgcggggtacgtgcaggccgcgtgctgcgtcgaagtataacgatacgtgcaagtaatgtacgtacagaaacgtacactgtacgtacgtacatatgcgcgcgcgcgcgcgcgattgtgtatacgtttttgtgcgcaatttttatagtgtatatgtttgtgttgtacacttaaagctcagcgtttcgtatatacgatgatccgagatggagatgatcagttttgcataagctctgttttgtttgtttacttcacataagcagataagctcattggagtcttccgtgcatccacaaattgaacgctatttttttcttttcaaatatgcaaacagcatcaagcgtgtgtacactgcacggaagaagcttcttttgatataggacgctgacatgtaggcccgtgatatgtaggctaatgaactgtgggactatcaggcattcaaaatcagagagcaggagagtaagggggttagaacatgtttaaagagacaaaagattataataaattcatattcttgctgaaatccttttaaagtgttgtatatatatacttcctctgctctataaaaaaactatttttaacggtgaatctgaacatgtgcatatacatgtttgggttataacacgttctgtagaaaaatcccgcatattactgctaaacttattttttgataaaaaatatggcgccataaatatagctacacccaaagaaaaataccaccacccctaccatatgtcactgattaaatttacaaatcccaaaaatagaataatgatgtcagtaatatccgagacaattgacagagccagctttcggatgatattttggcaatcatctgtgacatttccctcttgaagacacggacaggacaaaccaaaaaaaaccatgagccaaatggattcaaagtggaccctgtagacacatcacacatatccctgcagcggcaagtgacgatgtgtaaaccagaagacgacgaacggcgacgatctgatccgaaaacccgccgccggtaaatggcgcgcgagagcaaccgcccgccgcaggataccttttttttggggcgcccaacggataaccgttgccggcacgaggtcccacggaaggcgaccatgtcgtgtgccgtttgacggcgacgtcctccaatccaacccgggcagctgctgaatccgccagctgaaactggcaagctgatgaggatgtttttcagtcagcgccatcggttactcctcaactcagtagcccccagctcaaatttaaaattgagtaaatttcatcatggactacattttttttaccagtgtttcatattgggctagggctaagtcaagattttcactttacaccatgtttctttgccaattgccaagagttgcactttggggcagggtatgttcacaacttgggcatgtgtgactgacctcgccgtagatattatgattggattgtgatgacactcaattcaaacaacttcttgatgcgcggtgtggcacggttcaggtagagatggctaaacccactcatgacatgacgaaagaacgagatgtgtgctatcgtttcatgcgtgcagaacttccttcgcatatctaggtgttgtcacattgcaataatctctattacaagcttgccgacgtccacaatccaatcatctccatcacaagcttgccggcgtcctctcttatctcctgatctactgacatgtgagagcatccagtccaaagtgaaagcttttggtaaaagaaactggcccaaagtgaaaactttgtctttaggattgtccatgttgaaacttaggtaaaaatacctagaccaatgtgcaatttactctttaaaatttaaaagttattttaaaaattgatcttgattttttttatcatactttatttcagaatttatattaaaagttaattttatagttgattttgattttttttaatcgtaccattgaattttaagtcgtccaaaatacatataaaaaagtttttcatatgaacaaccttctctatctcatattataaaaaagtcaaacgacttataatacgaaacaaagggaatattttttaaccgctaacaaaagctacagcttgtaatagctgtaggcgaaacgacggtttctagtgaatggatactgccacagtggatgggaagaaagggctgcaggtttcgattccaacgagaggcaaaaatgcctttttggaacgccgacaaaaaagcgaagaaatttctttaaggactcctcttgaaaaagagggaggtgaatcaaactaaaaactttaagaattgagataccttggctgcgtactctttgttcatgagcttcagagtcaccgtgctgccaattcttaaagctgacttaagaaagagccaactctgtcaacgccagaaagttcaccagcttgtatctgaagcaaagatcatttctggctgcttcgtgatgaagtgcccaaatctttctttcctctgctttgcacctggttattgactgcatacggcaaagcataatttaaggtcaattcttggtgcaaatccaactccaggcacttctacttcataataactgcggagaacaaagccacaaaaaatgtccggcacatgcagaatactaactattttttttttgcgaggaatctgacctaaaaattggcagcatgttctgactataggctaagacagaaaatggatgttcccaagccaatatccacctgataagctggaccattggtaaagttgacatcaacaaatatatccagaagtcaagccgttggcaccgatgaaacctgagtttactgagtacgatttctgcatgctgatgacacaattgccattcactaaatctccaatgttgatcacataagggcagcatatcttaccagatatggtggatatattcatgagaagtgcgttcagcaatctaaaccaaacagaccaagtagaacaaatgagcccggtgctcattctgaactctgaacttggtgatggaagcagtctatctatcgacaggctgttggttttctctttcttctttgcaccagcaagctttgcactcctagcagcatcctccattttgcagcatgctttgcagccccatccacctctgccggacttctttttggctgaagctatcttcttcatcttctccttcatatacacagctgtgatttcctcttcagatttgtatccgccacctctccatggtccttgctggaatccatttcattgggctgctctttagaatccttgattgatttgtcttctttgatttcttcttccttgaagtcttgctctctgaaggtacaggagcaccattcttatcaccaccattctgcttatctggctttctttcagctgtaaatttgggaaaaatcaaaatacttgcttgtttattaaaatatatcatatgatcaataaacaatagttaatgaatactccctccgtccctaatataagggattttgatattttgtttccactgtttgaccactcattttattcaaaaaatttatgcaaatataaaaaacgaaaagttgtgcttaaaatactttggataatgaagtaagtcacaaataaaataaataataattcttttttttaaataagacgtatggtcaaacagtgcaagtaaaatgttaaaatcccttatattagaggacggagggagtatgaaatagtgaagatgttcttaatttggtacaagtcacaccatgagtaagttctatacatttactaattgcatcaagctgggtaccatgtccagaaatccccagctcagccagcacagtatctagttctgcaagctctttcttcttccattccttcttcgaaagctgcctttctgtctctttagattgtgcaggtattagaccagaattcttaacctcaagctcagatggtacatcacctataccaacatcaaggtcatcatcttcactccccgattcctagagagcaaacgtacaagtaattaattaaaccagagtgagttggaggaaaaataattaggacacatacatcttaagggtggacagctggacacatgagccacataccaatttacatacctaagataaagagcagaatttattttatgcctaattagtctctgaatcagagaaaatcttgttcatgctgtccctcatagaatcgtgcaggagaaataaattagaagaatataaagcttaaataaacatttccccctttctgttctgtttagttaacactttcatatacacaagaaaaacatgtatcgttcatctttgctttcagcagtgttcgctaggggattcccacaagcacaaatttatgtttataatgagttcaaaattttctttattgcgaaatgatctatcagactatctggtatggtgtggtatcgcagaatgttgtgagcatagatactggcatagtctttagagaatactttagcaaatattggtactaaaatatatttaaaagttctgataaaattgaatataataaaaatatgcttgagataaatttgcacgcttgatatttatgcgttcaatccaaatatttaacaatgttgacatttttaaaagtaatttttgattaaatctctaacatgatataattaaaaatatatatgtagagtttctaagtagaggaatgaattttcttttttttctcttttttttggtaacacacgaacattatggtacttcaataaaacaagagaatctcccctcaaagaaaaaaaagaaaagaaaagaatctaccacttaataggatggggaaaaaccaaagcattgccatagatgggaaggtccagaaatggtagcgcactgtactaccgcatgcattgtcccaacatcaacatcattcatgatacgaaaaaggtgagaccacaaattcttctggcaagtcaatagtcgctttgcaatttccactagtgcaccgaatgccacctgacaatttgacaatttaaaccaagcagattctgctttgcattacattattatcgtttaatcaattattcgaagtgtctacgaacagattggttcgaagagaggagctattgttcgaaacgaagatttaaaatttcttttcctacgattatgaatacaacccacaactatctctagtttatccagattacatcccctgtacgggtgtacacgactgactcatgcttacattgaatcgctgaactaaaagagagaaagagagaagccaccctacaacggacgctcgcaggttgtaaaaccagcataaatttcaaggttttacaggttctatctcggtctccatgccattccacccacactcccagaaccatagctttgcgcgctgttattactgttgggtatcacaccatactgcgactgctgcaccatgctcgccggcgcagcggcggcggcggcgccgccctgcgccggccaccaagcattggtctgctgccaggcttgcgctggctgaagctgctgctgcatcagaggaagttgctgcaatggttgctgggttcggaggtaagcctgggggatagagttgctgggtatctgaggttgcaatgcattttggtggtggtaaagctgctgctgctgctgctgctgatgctggtagggatgatgcaattgctgaagcgagggcggtggtggtggtggaggcagcggttgctgtggtgtgggtggaactgggagctgccttgttggctgttgttgggtgacaagctggttggggttccattctggtatatcatcgtcgtcatcatcatcccaaggacgagcctgaacagatgatcttttaccatacttctgaaccagttccctcatttgctctaccgggcgagcagaggtaaggggtacatgctgccggcccttgtaggcctgggtggttgttacattagcagcaggattggacgagttaacaaaattaaattcaggaagatcgtcttcatccctagcaacaccagggccaaagcccggagggacatcatcagttacatcttcctcgtggcggtgacgctgaactggaaaacccggcggcgcgccgtgcgagctcataggcagggagggcctagggcctggagtagaaccagtaacctgcggtttctttaaaatcgacggcctccgggaaccatcatgcctagggtgtgccggcatcctgggaacgttgggcctccgccagacgatgaccccgatgatggaggatgctgacacagcaagactctccaaatgctcctttggcaggtgccgagagagaatctccacagttttcccttgagaagggcacaggtacagctctattccatctgcaggttcagctaaccctactctttcatctgaaatatacgagtcaattgtctgcagaagaatagacaaatttaatgatcaaatccacaaacattcattaagctagctcctgaaggaaggtctttctctgaaagaaaaagggctacgatagaaaaacctgcaagagatgttggcgaccactctcatgagaaccttccttccaacacaactcagttacctatgaacaaagttggacatattcaattactatcctatcaacaccagcatgaaccataatctgtgatgacaaaagcgcactaactatagtttgaggcatttagttaaataaaggatagatcgagtaacaactcccaaacagagtgatacttctagatgctaagcatacaatcataagaagcatttcaaaagttaagacttaaaatacatgcaagagatcatgtcaagagttgttttttttgtctgtaacaattgttttcttttctggctgacacatgctccaattcatagctttttgttttcttggcaaatttagcatataagtaccaacatttttcaaacatcctgacccagacctcagacatttaaacatattagttagttttcaacaggaaaaatgcaagattaccattatagcacggctcctagatttgggaagctgttcaacaaactcttgaaaggcactaagtttgactctccccttgatttcaacaaagctccgccattcttttactggtggcttttcaccactgcaaagtgaaattttaatacatgtcatcacaaatacaaaaataaaatacagaataaacacatatcaacactatctttcaggtagagtggatcatgtgtacttggacagtagcagggcattctgggccacaacaatgaagaaccagttgtaaattgttatcaacattaattaaatcagcaaactttgcaaaagggatgatttagatcagtattaactaacaagacataaatcgaacaaatacacaagtatacaagttcccatcagaaagaggtgaagtagccaagctggaccctcaatgacatacacctacttaatgcactctctgcggaatcaagagaagtacactgaagcatgtcacatttggcagtgcttgctaattataaattattactcttagcagttctcacatgaagatatatttatatacttgcatgccatgagctatcagtttttacttattacttaatttgatgctagatgtctagcttctaaacctaaagtaatttaggtagagcaagaccttgagcctcttgagaaaccaatagaaacaaggaatcaaacaacagcagctagcttcaccagatgaggaagaaagacttccataactcacttgcctgaggcgcgaaagaactgagatcttcaacgaaagccccccaatttcattgacccttacttaatgaccagtgatggcgatttatgcttttattgcctcccaaacttatcattcttactcaagcttaagaccaggacagaatagttggagtataaataaataaagttatcatacgagtcttggacatatgcaagttgtgtgtgtgttttgccaaggagtgcatatgccatatagttcaacaagtatctttctgaaggaacagacaatcaatttccaaaatacgaccaagcgaatacaatgtagaagatgaaattgcagaatacagttcagtaaaagctttgtgcaaaagaagatgtacgtgttctgtaaagcactaatctgcttttaataaattaaaactaagacaaaggcatcgaagagaatgtgtcaaatcatcatggtatgctaacagaaacgattgtatattggtaattcaaaggaaaaggctgcagatgaaacaaaccttttgaagatggcaacgacatttgtgagcgaagacatggtaagttgaattgcaccctcccatatactttcacgtatcataggaagagtagttgccatattatgcacagtagagtcacgattcagcacattttcagtagttgtttgtttgacttcaacactatctggggaggattttatcagctttccttcacgctgctcaacagggcccaaatttgaacccacctcatctttgggtgactctaacttggactcagatttatcctgcgaagatggcaggtcagcttcagatacaatcttctctgctgcagaaactttaacttcttcctcaggaagttccgcagattctgcagtagtgtcagcttcgtctcgatcatctgaatcttcttctggcgtcccagctgagagattttcaaaaggtggttcagaatctaaaccttgcatgaattcatctagtgaagggatcggtggaaggttttcagtgtctttcaagtcatccaccataagttcttgcataaggtcacttttctcattatcaacatattctaaatcatcttgtggatcgttcttgcctgccccattatcttcatcttgtgaagtcccatcaggtgcatgcctgcagatcgactctagaggatccctgttttatcatctgtactttctttatcgtctgatttggtctgatcttcaggggcttttgatggaacttgagtaagaagattacctccaagctcaacctccactgagataccatctgtttcttctacttcaacttgaaattctcctttgtgtgttttcctaaccaaacgtctaacatcaacctcggtactaggaaggacaaccatttgtgctagttcttcagctttagctaaccgccactccgatagctccttggaagcaagttcctccgcagtcattgaacagaggcgatcaggtgtaatatctccagacaataccctctctcttaactcaggattacttttatcttttagattaaatagaagagatctacctttctccttatacttcttattaactccaccaaatagtttgaacagctcctcttcaaccctaactgctaaatcatctgccttctgaataatgctatccttatctatcgcttcctcatcattggcagacttcattcttttggactcagattctgagagagtgtctgcaacaacagggtcaatgtcagaagccctggacctttttaaattaggttgtgtggcaggttcaggaaccccagcatcaaagtcagaaacccaacaaagtccatgaccttgcaagagttcatcagcaacaactgtatattgtcccaacatttcatcttgtaaagaagcattctctggttgttgctggatgtccgcgtttaatggtgtggctatgttcgaaactaaatcactgtttaacttctcatcttcagcacgcctctcagcaccaacacttgtcaatacttccgacttggctgcactcatgccttgggatgtggtggccacttgatctgcatctacatccatctctttcttttggtctgcagacccatcaggctgcacatcagaagattgattcttactctgatcagaatctgttctcagagcagcagaaagtgactccctgaactttgatctcacagattccaattgctgagtttgaacctttgatggtgtctccttctgtgcagaacgtttgttcgatgactgtgactgtgtagatttcagtatttgaacctttggagaagcaattgtcggttgcagtttcttgccagcaggagagtgttgtgatccaaccattgttggcaaagatgttcgaatacttagcacttgctggggtggcctcaatgatactctgcttagagaatgtgcccctgaagaacgcggagtctctggcctagaagcaccaatttggaccgattgttgactcataggaacaataaaatacgaactaattggaacagaagctcccatagaaaacattggctgtgcaccccagtcagcaggcaaagatggataaaacatagacggatactcagcctgattaggttgaatatttgaagaaggcaatggttgagaacccatgttagttgacatgggtgtctgcccttgatttgacaactccattatgcaactatttcaaaaactcccaagatccttgacgagaaatagttgtgttgcttagaacagttaatacatatatctgaaatagatatgaagcaatggaggtcttagaaccgtaaacgggaaaggagtaaatacaaactgtggaggacatcaaaatagatgctccctgggccagtatacatagatttaagaattaaaaaaaatattgaattagaatttcgtaaaaaagcaatccctatgtaaaaatgatacatcccacatgagtatgaatattattatggtggaaaattgaatttattagaaaagtacgcacacagattccattcatgataagtattctgaagaggtgtccgcattaatcagttctagattaacacaacaatagtctaacagtaaaaagaaaaacaatccagaatacaatcgtgatacaacaaaatgccaacatggctgttcatacgcatacagtaaaacataatcctccacagcgcattgacctagagtgaagaaatgaattaacgtttgattagcaattgctaggaaatgcaccaggcggtgatagcagtgaaaataggaggcatgtgaatgaagtaacactaacagatctcaatacagcttaacaaagcaaaccctagagctataacattcgtctacatcgaaccaatatcaaggaacacccaaccatcatcatcaaatctaaaagggcacaacgcccagagaagggacgataacctcgctccgtagacgaatcccccccggcagcgcagacccaacccaaccaaaccctaaacgtctccctccacgtatccgacgatcccaatcactcaaacccaacgaacaaatccctcgctcacaccgagccgcggcaatcacgaagcaaacacgccgacaaaaaaaaaaaagaactacacgcatcgatcgcacgaatcatctggagctcagaagcgcccggcggaagagggatccacttttacctaggcgccgggcggcgacggcgacggcggcgagagggaagggggggggggggttgggagatttgcggggaaggtgggggattcgatttgggggtttagggttagctatgggcaggggcagaggtcacggattgtgcgcttcgggtttccatttggttcgtctcgtctcgtccccgcgcgaggtggtgaggtgaacggctgctgcgtggtggatggatggatgaggtgggtgatgactgggtgagtggggtgaggccgccaccaacgtcgcaagtcgcgactcatctcccgtcatccgtctccttcctacccacgtcgcgtgcggtgcgggtgcgggtgtttctcgtgttgggccgtgtctacattggggccttttgtgggaacaagtctattgttgactccgtttctctagctccaaatcnaatgtcttccccccccccccccacaccgtaaaactgagtataactatgacatctctcccatcaacggaaatcggtataaatcgactcctttaacggtacgagaactgacgcctggagaaagagagatgggggaggggagaggtgatggtgatgagatgaggatgacatgtgggtcccgctacttactcggtgaatcaacctcgatcaacgtaccatgtcagcagaaaccactttgcaaaccgttgaaggagttgattttcaccggtttttcaagatggaggatgtgttatatccagtttagcagttgccggttaagggaggcgatttaatcaggagcaagacatgagagaggcacaatagacttatttccgctttatcatgtgttcgatgggacgtgattttgtggtttgggcctcttgttgtggtttgtggtttgtggctgtgccctgaacctttggcacaatagtaaaggtccatttgataggacactggctctcagatcctctctggtggagttggagcctatagatctttacttttacaaattaaagtgaaggattcaccccacaaagtacatactaggaggggtgaaaccactttcctagcttcatatagctctaccaaataggcctgtagtagcaaatttggtaggatagaatcttaggggtgcaagcggaccgatccgtgagtttaaataaataataatttatggtttttcgcgtcgcggtccggcttgccgcatttaaatatacaagtggatcgatctataaaccaatttataagtcaaattcatagttaacccgctagtcaaaccggcgggttacgcactatttttgcctataagtggtttcgcgggtaaacccacttacacccctagaatagatgcttttagaaagaagcaaatcttcatattgtagggggaaaaaatggcaccatccaaaccagcgcttagtctaatcactgcttcctctctaacgcatgatatttacaagatctagacactccttggaagaaacaaattttatagtattttcaagggtgttgaattgattcacatgaaaaatcctgtaaaatttatatgttccagcccccataaaatcatcttaggattttcggagcccacggatcatccaaaaatccgcccatacaatggatctccttttctatgttggacatgcaatcctaacaaattattttctctctccatgtgctcataaaaatatatatcttgtgtttgttctgttgttagattttaggaatcatactgttgaaacatctctgtattatagttccaagagtaattttacggtccttaaggaggtaccatgaagtaccgttttttctattgtaaatttggtacctcatggtacctaggtactgcgaggtatcatgaggtaccaaaatttaagtgtaaattttgatacctcatgatacctcctcaaggacagtagaattgctctagttccaaattgtgtcctgcaaactatttccaggcatcatcactgtgtagaaggataagaatacactggcccaatgtagtagctgttcctggtaaggcctcctctccaccaatcaactccagaatccatccaaacttactacatactgttaagtagctcaattgtctctccaaatcaatcagcttggatgatgagcttcaaaaggacaggacagggacacttggaattctgttccctgatcacctgataccctgatatccaaagatgctaatctatacattaggtttccaaccatggctgtgctgtttaactctgtttatgctttcctgatcaaaagcttgacagtagaattcatgtttgtaacttgtaaaaaataactggtgtttacaaaaccactaactctctaaaaaaaagaaatttatatttagaattatctgcttaaatcatgtagttcaggaattcggtaagacgatttcaagtatttgcaagaacagcttgatgggagttgcttaatgcttttgtatgggatgatgcaattcctatgaaaatcttgtagaaaacttccaaggaaagacttagctactattgccagttcaacgtactctgacaaaaaaaatagtaatataaagataatctgcaatcaaatattctcagttggcgaacgcctgaacgggatatgctgatgcaaaagatatatattctccgaactcagatcatcttatggaaaaaaagaactgatttgccatatgattggttgcttcaaacctctaattgtgtgacacattgccccatagtgcttgatgtgccattgagatgatgtttacatccaatatatggattattggatgctggggcataaacaatgagtcactgaaaacaacatcttctgaaaatgtcaaaataatatttacaatcggtatgtaaattcaacttcaattgagctattctatctctaactttgaatcatgcacgcctggtttaaagagattaattgaactgtggttcattttgcttggatatgataccaatgagctatcactaattcggtggcaggtcaccttaatgaatattaaccatggattgtgattgatgaattattagaagtttagaacagtctaactaatctaaaatctgcacctgaatggatcaatggaaggataagggctagccacttttatggtctgaaattgatatgttttcgcactaactgcagatatatattagcctgcatctttacattcccataaaccatatattattatattttggagtcagtatgaatgcaaaatctgtgatatgatataggagtatatatacttttttcaaaagtagtttttctacctctgcacatcttcttacacattaatcttcagaagctgaatcttaagcctgtaaaatatttgactacaattactacttttttttactgttaaatatttgatacaccaaactgaagcactacagttactatctaagggcctattcggtttggaggatttacgcgagaattttggaggaattgaactgtcctgtgaaaattctgtaaaattcctacattccgaagatggctaggttccttgtggtggaaccagtccacctgggttcaaatcctagatttgacacgggtgctcgcatttacggttaattattcttttagtaatagaccatgtacctatcaacagcgatgcgtctgtggtaactttgttaatctcaagatacgttgacttagtcttccggaggtgctcatatggatagggtgtgtgtgcgtttatagggatgagtgtgcgcacgttatgggcacctacattcatactatgtttctaaaaagaagttgatggagaaaaaaaatggtgcactgaatgcggtcgtattggctttgtattttggtgttgagtcccttccatacaagaactaatggacacttcttttgcagtttcaaaccaatgttgcattgttcaacatacactgttttagtcccatctgttgcaagaaccaatgcagatcactgctgcagcaactgaagcatccgaaggggttagccatatccatcaaaccatcagcatcactatcacagtaacagttcagagcatcttcagaggcatctcctaatcctagctatatatgctccttttctagctgaaaattggtggggaacacgatgaccacgacgcgatcgtattagtacacaaatcaaaagagaaataattaaacaatggtgcactatcagtagctgttaactgaaacagtctgctctgaattctgaagattgcaaggggttaggtagagctctaggcctctagcctagccagcctttctcttcccttctccttatataccacactagaacacaggagcaagaacaagccacaccattgctcatcacctctccatctttagtttgaagtatctcagttttgcgattctcctcgctgttcaccgcgaataatcaagcatcgattgacgacgacgatggacgaaccatcgcagggcggtgaccagaagctgtcggccatggagcatgtcaagaaacgccatgaagagaagggcttcctctatgcctggtttgtacagaaacacaacactctgcatctgcatgcatgatcatactgcaagttcttgctgcatgcagtagcttcagttcagtaccagtgctttagctctgaactctgaacttctgaatgcatctcagcatgtgaactctgtatcagactgcatctgcaacgatgtggcactgcaagaacaatcacacatgcatacatgatgattaattggttgccgttaatttgggtgtcggatttattttttttttccttttttgcagcttgttcatgctgtgctgctgcttctgctgctacgaaacctgcgagcactgcctcgagtgcttctgctgctgctgcaagaaggacaactgatagagatcaagatcgatttcctggatttgttagcgaattgttcgtcgaaataataaaaggctagcttggtgtgattcttctcggttttaatttgtgtgttaactatgcgttaaccgtggtgagctagctaatagttatgtactccatgctgtgactatgagtgagcgagtgaattgcaggtggattgtggttgtaagtttgtaagctggatttctgatttttcatgtcagttcattgttgtagtacaaattcttgtgtaaacataagtgtaggtgattcatgttgcagttatccagttatttcttctgcttgcataaactgatacacagaagttcagattagacgggaagatatgcagaactaaataactgtagagttcagtggatcatgaaggcatcttgtttgtgatgaattatttttgcctttcttttctttctccctatcttcagttttgcattgcgagaatagaaagcaaaggagaaaatgaaaaaaaatgttcaaatgttataaaaaaaattctccaattcaaatttggaaaaagctctaaaatttgaaacaaattttcagcaggttattgcaacgatttactttattgtacagataaattttaaaaatagcttaaaacaattggtataaacaaaagattatttttttgggtgaaatgtattttgagagatgtgaaacaattaatccatcataggataatcgatggatgtgtaaagaaatggacaagagcaaaaagctcttatgctaagttggggtcggggagactggggagcttctcgttgttatagcttctctcagaattagaagctcccctatacagtttagtttttggtccacattatgagaagccgtagttgtataatctagaaagtgaactagaagtcagaagttgaaaaacccatctttttcatattctcagaaactggctgccaaccagttgtttctcaaaatcttaaactccccaaacaggcctgagagtgatcccacgcctatttcttatccaacggtggttagatcattaaagatatttttttttgtcagaaaggggaaaattgaaaagtttatatgtactcaattttgtctgttatactaaaattctatctgtcacactatgagtccagctatatttttttataattttatctaattaaattaaactttttttatacatgccacactatattttttttttataattttctctaattaaattaaactatgagtacttaaaagccctgaaatctgaacccaacccaggcgcgaaatccgaggtgccccgcgaccgcgctgaccggcggcgatgccgatccggcggccggcccacgggcggatcgtggccgccgccgcccgcgttactccggcgcttggtcggcgtggctctgggtaacgatcctgtaaccctacttctcctcagagtcagatccatcccgcgcctaatcttcctgcgggtgtatgttgccatcgcgaattaccagtctatagttgctgtatgaatgtgggaggcgatcttgttgatctgtacttccatcgattgtttagtgctgggtagttggatgatcccctgcaaaatgtgcctgtttctgtacctgagctagtgcggctggaggggaattgtttggggatttctgagttgcgctgaatttggtggtgcgattgctgtttatcaccatttccacttgtgcttttgttgtggaacactttggcaattttgacaaaatcttccgaggattaccaagagtccaatgtcaattttggaggattacattgtttcgtgaaaacaacgactaatctaaatcaacaatttatttctcacagtcagttaaccatcgatattgctgcaaaaaaaaaagttgactatcgattctatggatctgttttcgacttattgttagttaacaatgccatacttttgtatagagaagtcccccctcccccggtttttaagcaactaggccatgttgtttttttgcctaagagaaactatcacatgttgaaatgtgcaatatagttgttgaacagtcatctttctttcccttggttgggccaaattgattgacagacaaaggccgctcaataaatggcacaagttattttgtgaatatgactgcaataatccctgatgcagtccatgctctgtacattcttgtaaaccagaggtttgctggatgtctgttcaaaagtttgtgtcgaagtatagttgcttttggaatgttatttttatatgacaatctggcctgtccttgctggatgtctgtttaaaactttgtctcaaagtatagtttgcttttggaatgttattttcatatgacaatcagtcttgactataaaattcgtttcttatgcaaaattgcaaacctttatcgatattctttaagcctcccaaattatccaatagttaaatatatggcacaccttagaagcttcaatagttggatatctgaatttgtctttggttgtcaatacttttgctgtcctgctgtctagaaatgtgagtcacgtctcatttaaaattcgcatcaaggttatttttaatccaaatggtaatatgttatcacaataatcgtaaattattaattatatgctgaacacacaacatcatcagcaatcttgaattattgattatatcagttcctaatgctagtgtttgtagtagatttctaaagtttctactgttttcagcattatatagcagtgccatcttttttttttcacattaatgtttcatttgctgctttttgaaggcagtgagattcaattgaacaaatacttgacaatattatggaaaaaattacatcatggaactattgcatatttttacagtttacatacatgcctcttatctgtttgataaatgccaaactgaacagatagagatgtcaattgcctacgaatgaaacaaatactgaatacattctctcctcatttacagtgctgtgtgccagtactcaacagcaaacttatccaaacttgaatcaagatgagatggtgctcttatcttctttggaaattgaagactttgatggagaaggcaaagacgaacgcgaagagagcagcaaacccaacaacggcagttgctacataacctaagtagtcatgcctaaacccaaagtatcgtctgatgtaatcttgcaccacttccccgtcctccagtgtagagtttgtgatatcaccatattgtgaggcaacaagtccgtacagtgtccatgccactgggcatgcccaggaataccacctccaccatattggtatcctctgcaaaccagccatgtatatttcagcatcaacagtatagaaaaaagacttaaaggttggtatggacaatgaatgaatatcagatacttactggtcgggggattaggaagccggcaaagatattccatatgcaatagaatgcagtagagactatggcagcaatgtcgctgtttggtgtcatggcgactgccatcatcccatagaatgtgaagtacatgaaggtgaagaacatgaagaacatgtaccagaagaatttttcaactgtccagtcaaagccaatcaggctgtagacgatcagaccatacacgacagtctggaggaagatgtgtggtatctcaataagaacctgttgaaaggataaattgttagatttttttccgtataataaaggaagcacactgcaattgttttttgtttaaatatgcagctatgaccatttacctgcgcaaatgcatatggtagagcggagtacattccagcggccttttctcggtagaacactgttcgctcaacgtctacaattggttggacagtctggccgttttgaattccaatgaaaaggactgctgcatacatggatcccaaagagttgaacagatccaatctcttgtttctgtaggcaagataagcacaggtaagtttctttctcacaacatgccaacatagatcaagttaattgggtttgttagcaaagatacttacattttcttccctaggttcaagaatatagtgccgaaaatgagggctataactgttgtgaagaagattctagttgctgtatacgacggatttctccagtatgatttgtgctgcttccacaggcaagccatgcattgtgtgaagaagggctgtgaaaattgagttgggaagtgtaggtccgttgatccaggtggaggtgtgcttaattcacttatcaatgttttattcctcctgcaatggtgcaattgaatcagtgatataacacagaaaaagcagaaaaagaacattttggggggcttttgtcatgaaacatactggtatagatcagaattcctgtatacttcagcaaagttgatgccaaggatatcttcttgggctagggtggtaacctccaacatccatgttgcaggattgtaaccatccttgattttcctcactccttgtataccctaaatttggagcagcgagcaaggttaccatgcatgtcttaagttggaaatttggtgttcacttcagtatttaagtatcgaggctcacctcaaagtaattgatgagatggcatgagttgtgtcccagggggcccacatatatttcttcacctcctcgtttcatcagaaacagctgcagaagttcaagaatagcctgttagtgttcgtatgagaagggcatccaagaattgtgcaattttggcccttgcttcaacttacctcatcaaaagcttcaaatatgtcaatgctgggctggtgaattgtgcagacaacagttcttcctgtgtctactgtgtttctaactgttctcatcacaattgcagctgcccttgcatctagtcctgaagttggttcatccatgaatatgatggatgggttggcaacaagctcaacggcaatagtgagcctcttcctctgttcggtggataaaccattcactcctggcagtcccaccagtgctcccctcagtgatgtcagctcaacaagttccatgacttcttccacaaacatctgcatccgtgaagtgagtcagcatcacaatgcaaaatgtgtaatgagctagcagagtaaaggctgtttgactaacctttcttgcttctgagtctacttcagagggtaaccggagccatgctgagtacagaagggactcgtaaacagtgacatgtggagagtggatatcattttgctcacagtaaccagcaatccgagcaaaggtctcttgcttctttgggtatccagagatggagatgtctccttcaatgtaaccgcctgttttccttcccgccagcacatccattagagttgttttaccagctccgctaacacccatcagtgctgtaaggactcctggcctgaaagctccgcttacacctttcagcagcagtagccgatcttcagtaacacctttatctttcatttcctgtcaaaaattgtgcatcgggattagcataatagcatttggtggtatatttgttacacacagggaggcttccaatgcttgcttacctgaggcatatccacagagtatctgatattgtcgaaggtgatcgacagaggagtaaatggaagtaccattcctctcttcctggtgtcagctcctgtaatctctcctcttcctgcatttgctatacttgttaaaaggacacaacaaaatggcatatcttgttcaatgccataatacagaggaatgtactaaaaagactgaccatcagaaggtgaattctgggaatctgttccaagagtcagcagctcaacattttctccggtacggtttacatgtttttccctcaattcctcttcagaaacaacagcctgaccttttccaagtgctgcagtcataatatggtgtcaatgccaaataaatgatgtttgaatatgctaatctatgtgtttcagagctgagatgatactcacggtcaagccattcaaggaacagaatgaagaggatgttgaagagcatgatgtatccaagtaatgcgccaacgccaatccagtaccagtttgcatcgacaaatatgccacgtaccttaaggacttggacaccaagcgtgtcgttgctttgtgtcggatcaacaacctgcgcaaagattaggttgcttctgagttatctaaatccaaacttagattgtcaggtttgagttggtgcaggagacactgcattaccttgttccagctgtggccaaggaactcattaactgctatggcattctgtgcatacatcagaggagaggaccagtagccccaaatccaccatttcttgatgttttctgcaaaaggagaactcagtacaatgctcttgttactactggaacaatatatgagttacttggcatacctctagatatcaagaaaccaccgagaaccagaagaataagctgagcaaatgacccaaacgtgtctgcaacaaccatctctcttcctagtgcagcgagaagccggaagagaccggacgccatctggctgatcagtaccagcagcacataatggcggaagaatctctctatgtttggatcgaagcccatgacatagtatgtcatgcaaatccacacagcacattctaagaatgatattgggattttgagcacccatgtaggtaatgcatacgcccatgatggatagaaaagcaggtccctctgcttatagaatatcggcagctttgcaatgctcatggcgagctccgcaaatccattgaacaaatgtgtgactaatccaaggaacatagcacccaggaagatcgcaccatcttctacactgcgtcgatgcatctttgtacgcaggaagaccgtcattccgatgcttccaaggattatgagctggtacagatgtacctttcgtcagattttatttatggtcccgaagtagagagaaaaaattcaagatgcgagatacatacctggagaattttgaagatgtaaacaaatgaattcctcttcatcagcagccactccctcgagaagcatgccttggtaagctccatcttgctgatgccatacctggaagttgtgagagcagcaggatggttcctggttcggtcaaagggcaccctgagctctgagcccagattacgcccaacatggaattccttgaaggcctccgaaaagtcgttcaccgagatgtaccggtatggttcatctctgcggcaccagtactgatgctgatccttcctcgatgtaacctgtgcattcagaatgaacactgtcaaatttgagttcctagtccaacatgcagggaagattactctgctggatcactcacttcttgcaagaagtctgcaacacctttcctctccggacatttgaagcccattgcctcaaagaactcgaggatgttttctcgaggtccctggtatacgatttggccctcggagaggagaacaatgtcatcaaagaggtcatacgtctcaggtgcaggctgaagcaacgcgatgagcgcggttcctcctaagatgtggacagattgcctgagggagttgacgatctggtatgttgtggagctgtccaaaccggtggagatctcatccatgaacagagcctttgctggaccgacaagcatctcacctacgtaaattcagtggattgagaggtcagatttttttcactatgatcgaagaacactgtcatgcctagttctttgttgactgcagattgcacataccagttgtgacacgtttcttttgtcctcctgagatacctctgatcatagcgtctccaaccattgtatcagcgcagatttccagacccagaatctgcaatagcaacttaattagttctagtcatgtatatttcttctttttttctctattttcctgtagtgtgttgtactcactttgagaatgtaatctgtgaccacgctttcctgaccttccacggagatggcctgtttgcacaagggaacaacaatttgagcacttcttgtatacttttccaaaaaaaaaaagaaaaaaaaggaaggcttgtgctttgaataaactagcattttaccttcatgtaaacatcaatatcaggatctggtttaatgctggcttctttctcccttcttgacagttcagtaagcatgtctgcgtgataacaaaaccaccataagaataacttcaccaaaagcgaaacaaattgctctgcactttcagtgcagcatgctgcgtaccgtaacgagttccaactccttgacatcttgcagagaaggccagtgtctccctcacagtcatctcgccgatgtgaagatcatgctgcccgatgtaagccgatgtcctctgagggacaaattcgtccatgtcatgcccattgtaagtcactcttcctgatacctgagcatttcaaaattcaaattcagccatgttacaacttttgcgactaatctttcccatgtgataatttttgtccgaaaacacgggaatactcggaaattaacaagaaacatgtgaagatgtggttaccttcagtgttgagtccagtttccctgccagagctaggagcaggctggttttcccagaaccaggagggccaagcaacagagacatcctgaacaaatttcacattattaagctccaacctttcatcaaaatatgataatccgacacatgaacagttcttgattttcctcacctgccgggtctgatgattccactgatgtcatgaaggatggagataggcctcttcccgctcgaaacgatccgcatcgcgctcagcacatcctgatgatccaaacagttcaacaagaatcagaagctgcaggacgagcttaacaacatctgaacttggaaactctttcagctcctccatgatgatcatggatgatccaaatgcgtaccatgattttgttggagaagaagttggtgaacgttgggattccccggttgccgacgtatgcctccgcgtcgatgctaaggttctcaaacctcacttcaatcgtcgggttgtcaatcccaactctgcaaatcaaatcatcacaagttcaaatttcaaaaccacccagaattaactctcaaaaacaaagacaaacaaagaaggaaaagaagccatgactgatcacttttcccccactatctttcagttgctactgatgatgaacaccttttgtgtctgaaatttgaatttgatcgagaagaagaggaagtgaatggaattgagcctcaccgctccatccggtcgcggagcttgaggaggaagcgctcgttgtcctcctcggcggtgcggacgaggcgctcgatgaggttcctcctctcctgcagcccgagccccccgatgtccacctcctccacgccgccggcggtgaggatgcccttccgcatccggtcgtacgtcgggagcttctcgatcgccgcccacttgagcgcctcctcgtcgtcctcctccctcaccgacctcccgaacgcgtcgctcctccccgacgtccccctccacgacgacgccgtccgccgcacgctcccgccgccgctcgccacgctccccatcctcactatatccatcttctccgatcacctcctctcaactccgatcacctcctctcaactccgatctctccttcgatcgatccgcccttgcttgcagctgcagctttttgctgctgctcgagtggagaagatgacgagaaagaagcgagggtttgtgttggttggaggagacggtgatgggggtggtatatatacctcgccacccacgcgcgcctcttaattacatattaatcggagattagcgaggtgattgatgattagtatagctaattactagatttagtcgaaatggcgggctcgctggtcatgacgcagccgcttgtttcgaattttttttaatttttttaatgcggtctcgagcgtggatagtttgaccggccggtcggttcgcgccgaaacgtcttgaccggttcggggtcaggtccgcctcgtctgacccgggcactagggggcatcggggtcatcgtggccgttggtgggaggatctgcgggtgggattgttccacgtgtcgccgggattcgcggtgttggggtacctcccgcgtacggcaagggggtgcgtttagtattagtggtgcgagtgaagtcagctatgcaggtaaacgtcaattagtggctgcatgctgtagtgtttattactactagcttggtatgtagattatcacgtccatgaacagcgacaatgttgccagatatcgtgatgatcaaaacaaaaggaaaaagtgtgggcctgagaactacagcatgcaatttggatgtgttggaattaatactcttatgtgccgaatggttgaatggatgaatagttgaataatttttagcaattattcgagagtacaaataaatgaaataaattaacaatggatttaatatgtttcttggaaatttatatataggaaaattcatgcatgtttcttgcgaagcgtgcacatctctcctatcatttcattaagtacaaaagaatacgcaggttacaaatctcagcatctatatttggagggggttcattgatttttattaaatagaaaaaagagaactgtacatggcgaaaagaaagagaaaaggtacaggctaaggacccttggtccaagctaactaagggtgtgtttagttccacgccaaaattgaaagtttgattaaaattgaaaattcgaagaaaaaagttgaatgtttatatgtgtagaaaagttttaatgtgatgaaaaagttgaaagtttgaaggaaaagttggaaactaaacaagggctaatgtgtaagccggcgaactgatttttcactctcttgtactctcccctagctgctgttcctgctagcgaacacctgtgatcaaaaggcaaactgaacaccaaaataactgatcggcgatcggtttgtacggcaaaaacaaaaggagaaacagggtagaccatctacgaagggggagtagacagtagactacttcatctgcaggcaacaagaaatcaacggcggcgtgcgcgaggtctggtcagtcgccaccccagatcggacggccacggttcgtcttctagacgaccagctgtatgacatagccgatcttcaagccttcgttgaaaaggataacgtttcttatatttaatttcttaacgattccgttaataatactatatcgcttgccaaagttaacaaagtcagaatccagtggcaatcgagagcatcacgaactctggactctgaagtctgaaccagtcagcagtggcttgcggccagttaataataacaacacttttcctcgcaaacaaaatataatgataataatgctaatcctttctgtctggtcaggtcaggtcaaagatggccagctcttgcgttgtactcgaccattgttttttcaaggatttgtgggagaatttctctggagaaaacaatgtgatagtagtagctttagatgagatttaactgttttggtcgtggaagtcgtgcttcgacggggacggtgacggacggccacgggattcacgggcggccggcgagccgccgccgttcgttcgttcgcactgccggcctcttaattcgcttccattagtttctggtcgccgaaccggtgtcgtgcacgttgcaccaacattgcgaagtctgcttccagctgcattggagattcggagtcgtcttccaaaatagttttcatcacgataggagcatacggttttagcttttgctgatgtagttttgcttggagaaaacatagtacaagaactgtgctgctcctagaaacgtgaaaagggaatagcactacggcacacattcgtggacgtgcaatagttgaaaaatatgtgttggtgtactagcccagttgaactatgcagggagctagtggcacacagactgttcaagtggttcacaacattattcttaagaaaaaaaagagagctttagaccgcacgtgatgatacgaaacccattccaaaaccagtggcctatgcagagacacctctagaaaacaaagaggttctggacaaatttcaaagtcagataactgctcgagttggcatggtacggacagcatacacattatcacttgtcaaagtcaggcaagaattcctcgggctaataatctacaccgacaaaagttcacactaaacaatctgcagactaatacatggtttcctagccttcacttacatgaatcacttgttacagttcttcatggtatattgtacttctaggaaagttagcaccatgataaactaataataccggttttgtgatgtgcagattttcatgctacgccattctcatacattgaaccatctttggttgtggcttcttcaccaatgtcaacctcacccattgcatcgtcaataagagactgtaatacagaaagagacagcagttcaattatatagcaggtcaaacaactcccaagaaatacaaactaagctaacgcattacttcatgaaatcatgagtatctccacagactctgggcacgactacaagagcatgcaggtactgcacccaggattactgaaattcaataaagggtactctagggaatcaaaagaaatcatatgttgagcaaataacctggagctccttttcagacatcttcaccctgtcattgtagtcttgaagttgcagaaaacatttgtacagctgcatttaatattttcaaagtacagaatgtgatttgtcttggttatccgttgcttattttcataaagcagcagctagcatgtgagcaaaataccacatgtacctttgtaacaaccaattgtcgttctgaagaaactttccgtgcagcagacaattcatcctctaacttctgtatttttgtatttaaaaatagtttgtcagaaaaaaataaacccgagtattggacaaggataagcacttgcaaatttaaaaaataacagtgcgaaagatgctaaaaaggattccagtatcaggatacacagatcacctgggatctcttttgcaaatctgcaatgtgttgttcctttgctgcaactttatctttgatctgactaacctgtaataggacagcgttcaaactattttttcataatatgagaagcaaacagaacaaagaacactatataacaattgtaaatgctaaagttagtagccagataaatatgtggtctaatgcactagcaccatgagtagtgacaaaatcctagcatgctcctagttgactatctgttggtgttcaagcaatttaggcatgttgcatcaaatgtatcttatgagacaatgttagctttgctgactcagattttatgaactagctttgattatccaaataatgactaataaaatagagcatagctgaaaaagaaaaagagtacctcattttcaaggtcctcgcgcatttgaattgctttgttcaactgtcgttttgcctgataaatgcatgaaaagaaagaaaggagaaatgagaaacccaacaaaaattagaagcaatagaataaatggttagaaaagctcatagacaaatttccatttgaagtaacagaacaaagagagatgtatttacatcactgtgaagatcatcactggaaactgatagatccctgctatcatgatcttttggacggctgtacagaagaagtcaggaaagtaaagagatgactcaatcctaacttctctactacttggtagcaagcaaaaatattaatcatatacaaattttgtttcaaagcagacacagcagaaggtaatagactgtagacattacatgaagactcgaaactcaccagtgctctttgtaaattttgcaccagccaacataagtacataacagatgtcataccagtaaatgagatttggctggcaaatttcaagtatgacatacgaaagtacactctattttattgcgcagataacagaaagacaaccctggatccaggctcgctatttatggtttcatatctcagttcagatccagcagaacacttgtttaaagtgctaatcacggcgacaaggcacatacgataatttcagttttaaatcctcagcatactcaatatgtgaaacccattcagttggtatgtgtgctgttagtcttgatcactgtggggtaaacttaattgcaatgtgccaatgtctatccccatcaccccctaggagatagcaaaggtgtcaacccaatttaatctacaatcagccacttgcagttgaaatcaagactgacagatgacatatgcaggtaaaagcaacttacaagactcaatatatctgcaagtcactactcactacaaaggtgcattcagcatttcagctgcacaaattctaacaaatttggacaagactgaccatcaactttaaattcagggagtagtcaattagtaaattaacaattgcaaatttacattattgataaaaatgaatatacagtataaattattgggtaagttggcaaaataataataataataagaagaagaagaatagaacaattggttttcgtggttgaaactttactaaggacaccaggatcctatccagatttatcaaaaaatatgccacatcaatagtcctaaaaactaaataacaccactaaagaaattacaaccttctgacacaattacatgcatcaaccagaaatatattttttgtggaaattcaactcagatgccttgcaacttcaattaagcttcatgccttcatcacaatacaaatatcttccctagaatatatatatacatgatctatttccacccaagtgcatgattagcaatattaacagagctaaaatacaatgagaagataatacctgaacctttttcttgatcgctgctccttttctttctctctttcactatcatagtctttagagttttctttttctctgtcattatccgaatcaacattatgcatttctgctgcacggtcgtagtctctacgcctttcatccccatgatcttgatccatgggatagtcaatttcttgatcaaagcctctaggttcgtaaaatctgtctctatcacggtcacgagatctatcactatccctgtcatggtagggatctctgtcacggtcatagctcctttctctatcccttctgtcccaataagcatcccttgcgcttccaggttctcgccgaaaaccttcacgcccgaattctcgggcacctctagtacgcacttcattcactctaacaacacgtctatttattctctgttgcaaacaaaaatgtaattaatacaagagataataaaaggtgttaagttccagataggagcataccttgccgtccatgcctgagatagcatgctgtgcagcatcagcatgagtgaaagtaacaaaaccgtaacacttgcctctgactctctgatcatttatcacctgcaaaggtcagaaagagattcctctgtactctcacataatttgaatcttatctgacaggtaactactttaagagggaaaaaatagtgcattgactgcttcaaagcaaaaatccttttctgttattgtatcggcaaactcgggaactaaaactttaaacccatctttggcattgcagtaatgccatgcctcctccacttgaaccagaaacaatataaccacatctatcacttgcattattgaacctctcattctactaggtattaaatcaagtaccaataacacaaaaaaaggaacgcatccaaactaatatccaaagggaaccctgaatccttctagtgtaaatttaccctaaaaactaatttgaaatatgagctacttgcctccctattcatcttagcagcaaaataagtgactgtgtgactgaaccaagtagcatgtcactacatattcaccttcatttcccccctcccgctttagataatacaactatctccccaccaaatcccgagccctcactccagagtcccaattacccagccactccatgtctcgcattaggacgtagatccaaataaaaaccctaaaacaaacaacgcccttgttgaacccagctatctcgaccaccaaaacgagtctcgcgacatctcgcgtgcttttacatcacagcgggcagcagcaaaacaaaccctagaaaaaaaaataaacaagccgattgacctcggagctcggaccaaacaaccgtcaacagctaaaactcctcaacgccgcaaacccctgcgacgggagagcgggacgggatagcggtggggggcgcgcggcgtgggaagtagggaagggaaccttgacggagacgatggtgccgaatcggccgaaggcgtcgcggagcatgtcctcgttggcctcgtacggcaggccgccgacgtagaccgaggtctcctcgttcaccgccgccgacatctcgccgccggcgacgacgacgacgacgacgcgggctagggttttgggtttacctccgctccctcccctctctctctttctctctctcgcggagacgaggagtcgacgagcgagcggaatgggtggggaggctgtcggatctgacgccgcgcgtggtgatggtggtggtgggctggcggcatccacaatccagatccgtgtgtcccctcgtgaccaatccccgtcgtccccgttccgatcgtgggttttttctacgtgggccggatcaaagatcaggcccatctcgtttggaaggatcgcggctttcaatacaggttggagtaggtctattttccatacttcaactattgccccttagttgaatcacattactctaccacaaaaccgggtacatcacatactacaactaccaaaactgaatccctcagcggtttggccgatggttttctcctacatgatgccaaataattaataaaaaacttaatgagacccacatgtcaatcagataaaagttagtaaacgcatagtgggcccacatgtaagtattctctccctttacccctccatcttcatctctcatattttccacgccggtgccaagagtgacgacgtccttgatctcgaccccagaaccagcgcgggtcgccgtcgatgagtcccgccgagctggcatgcctatccaccatcatccccgatgagcccctctgagacagcacaccatcccctttcctgaattgttgtctccttaagctgcgcaacacttagtggcaccttggctaccagggttcgcagcaatggaggtgaaggcagagctcattggaaggaggcaccaacaaaccttggtggcgagaatagaagcttggaaaggccacgtcagcggcactccagcttcatctatgtgcttagtgacgaggggtggccgcagatgcccaaacctagcccaagctcctctacttcgttggccacgcccaaacttccacgtctctctatcgctatccgacgtcctcttcctaagatgctcaatgcggccgatggcccgtgcttcctctgcctcttcctcgacttttgcactccgccaccagcccaccgaccgccgctaacatgcactgcctgccatgtcattgggcgcctcgtgcgtccttgctctcgtgaagagataaggggtgagaagaagtgatgagagatagagagaatgacacgtgggtcttaatgggtctttttttacattttttcaagagcgatttacttgtgggcccttttttttattttgggttgactgtgatgctatttaaacgccgtatagacgtcacgccagataaagaccagtttaacatgccatgtaatcgccacatcatccaaaaccaccttgcaaaccaccaaagtagttaatttacaccggttttaaatagttgaggtagactttatacccggttgtgtggttgagggatgccatttgaaggagaacgatagtccaaggagactttattccatactagcttgactcatgtgcgggccatctaaattgggctcgagaacgggatcgcagctttcgtgcgggcccatattagttggactggaatggaacttcggctcacgtttggcccatgctgtttgggccagaacgggatcggatctgacgtgaggccgtaacggaactgtcgctaacgaatgtacgggcccaaatgagaggcatatcatgcggttgtgggacgacggcggccgacggcaggggagcgagcgccggcgacggcgtcgaccgagaggtggaaccgccggtgaccattggactgcgctgacctcaccggctccggcagttcttcgctggctggcagcccgagtcttctgaagttctgataccaacactttgtcttgtagtaaacatcagcatagatgtcacaactctagtatagctaaatttaaaggttgcaaggccggaaaaaaaacatggatagctactattgtaaagattcaaaaacttctccaacgtttacttccagatcagacaacgtcctagtctggaaaatccgacgaaaagttttggtcctttcctgaaggttgcaggttgcagcacgaaataaacatttgcaaattgcaagcatcggccactagtagatgcaaaatgagttgaggaaccggaatttccacaaaattgtaattaccaaaaaggcagtttcatatctatgggatggaacaacagacagctacagatattctcaagcaaagaactaaagacaattctcaaggtgaagtcaaaatatacatgctacaacaacacaaaaaaaatggcctgcttatttttcttaccactctgctgctttcctcagcaacaacccagggcaggccaaactaagcagcttttgattccacggaagacttatactaactaaatttgcaaggcaaagaacttattgagattgttgaccagacttctccgaggtcgtactctcaggttcctgagacactttgatggccgaaccattcgcagagttctcactggctagagtttcttggagagaaccatttcctgacccaacaacttgagcagttgtttcgaccgtctttgctttcagcattttctccttctcaagctcttgctttgccagtggggagaactgtgagtcaagggaccttacagcacccaaccaggcaagaacaattaccaatagaattcctcccaggtagggtgtagaatttgcgagagatccaaatgataagatcatgaactgctggatcaaggcgcctccagacttccccaatgggttgcagaccacatcaattgctgccttacctttgacctgaaatcatgaatagaaggcacacatgagaagaaaatttcagaaccgcgtgaaaattttgaatcttatatcagccttaaaatttgacaggccatacgttcttaatggtgagataatgtgtgaataatattggactgcaactatagtggatttgtacatcacaaatgttacggttagcacttagaaaaaaaaagcacaataaatttgatagacaaatgcattccagtcacaatcaacaaattaatcagattattgtagaactagcaattttgatatgtatgcattctactatcagcctatcaggtgtcagggactatcctcatagtaacccaacccatcttgtaatagcaagtgcatcaaccatctggtgaggtactatcaaacatgcctagcacagttttctgaattccaacagaactagtgggtagcagggtttatctgtttaatactaccatatgttttctgacattagagcaactggcctgattaattatatcaagataggaattttggagactaaccttcatgtcctcgtccaaaggaatgtatgccatttccttacaagggtcaaacaaactgtacttcgcactcttactgaaaatgttctgcattgccccaacatagaccgcagcaagcaaaggtgtcattccaagtgtggccataagaggagtcaatggctcaccgaataaaatcagtgagaagaatccaactccagtgagaagcaacactgcaggggtgattgtagctgcgactccccacccaaacttcctaagaattactctccctaacaacatcattgtaaatgtggctatgccagtagcagtcgagaaatcccccatgaatgaagaatattcattagggcttgggtactgcaacagaaaatagagttaataaccactcatattatcaccaaacaattgcacatctggcaatgtggatgaacttacttgtgccttcagttttgacttccatgtcacctccacaaggttaatgcttataccataagcaacgaccagggtggcaagatccctcacataccgagatgacacaagcaccttcaaactctctcccatactcagctttggcttatcctgcagggtcatgtttgaagcaccataaatgaaagctcaataaacagaagttgcaaaccatagaacccataagaaaaccgaccttcttcttccgctcgacgactggcgcagctgatttatcaattacaaacttgtttactccccagtagatgccggcaatcacaaggcccagcaaaaccactatgctcatcatgcccctcaatgaaatcgcccatccgtccacccctggacccaaattctgcctcatgtttgagaagtatttcactgtgcgacccgagaagatgagtgccacattggccccaagcccgaacagtgggtaaaactctttggcctcttcaaccgtagtaatctgcaatcgttaaatgcactgagaatttgtgtacgtagccaattgttttgaagtgagaatctacacaaatttaaacatgacccgttcagctattcacaaatgtttagaacaacaatgtcctacaaccaactgacaattttgtaatttcgtagaccaacatcactgtcagttattgccgatatttcaggagaatagtttgcaaacttcaattgctgctactaaatccgagaggaaagatttgattgtacctgattggcgaatccccagaagagcacggagatgacgacgctgccccagagctcggccatgacatagaagaggcagaagctccagacgcggaggatggcgacggggcccaggaagctgggccccagcgcggcgaggaggcggtcggcgagcgcggtggggtggatggcgtcgcgcatggggtagagcaggtagccgaaggcgccgaagaaggcgatgaaggggaagatgacggtgtagaagagggcctccttggagagcacgtcggcgagcttggtgtagagcagcatgaacccgatggccatggggaggttgacccacgtcttgaggaacgggatgatctccgcgctgctgcccttggcggtgacgacgagcacgtccttggtgtcccgcaggatggtgtagttgaagaggatgcagaagaacatgagccccagcggcacgatcttcttcagcgtcttcgtctccacgcccaggaacttgggcgaggccgaccccaccggctccggtgccgccgccgacgcggcggcggcgcggagaggcgggagggaagggcggagcgggagcgcggcggggaggcggagcggggtcggcgtggggaggtggagcccgagccggagtggggtggcggcgacgctgccccgccgctggcggaggaggtgcggcggcgcggccgggtggtggcggtggtgggcgacggcgaaggggacgcggaggcggtggcttgcgacgaggccggactccatggcggcggcggcggcggaggtggggaaatatcttggaggtggtggggggaaaggagataaggtcggggcgctcggcaaagcgggggtttggggaaggggaggggtgtgtcttatactactactccggtgagattaggaggtggggaggaagacgacagcagtggggagagtgggaggggccgtgtggctggcttagtgctgagattagcctaacgaaccttcttcgctaatctgaggaggggagacgcggacttgggagtgtatattcagtgtactgaattttttttcctctagaaaagttatactaccaggctgtagtaaaaagacaaccaatttattttagaaaaaaacgaaactgatttgaattctagtagaatttaattttagttgtttatttaaggcccagtattgggtgcttaagattctaaaaatctgctggtcggtatccagcttatgagaatatggaaaagctgggttttcttgcttctgggttgtagtttattttttggattttataactacagattctcagaatctgggtgataatctggactgtttgagagaactggagattctggtaaaatctgcaacaactagaaaatcccctcaaacaggcgcttagccgtttctgtttaagctctcttctcatcatggttaagaaaacaaataaaataattttttttgtaaaactacagatagtttagtaaaattattatgagactatagatagatttattaatttatagtatcacaaaactaaatgaacaaatttattagaaagctataaatttaagcaattgtatatagaaactatatattcagtgtcatttttttcctcgcaacacggagcatcgattttctcggagaattacacattttaaaattttactatgttaataggtatagggatagcacatctaaaatttattgttttatgaagataatactaaatgtatgctttcgagtaacaatagttttatgttaccatggtttaaatatgttgttttatgataattttgttaaagtatatgtagtttttgaaaattattttaaaacatatgtttaaattatccctaaaaatatatgagggtttgtactatgtatttcacaaaatattcttaaaaaccaaaatttttaaattcaagtcaaaatgatgctgatcaatatcttaaagcaaagcgtaataaacgcaacacacaatatacaggtatcacataatttactgggtgtggttgttgaatcacgcttggccttattgtaagtagaatgatgcatagaaacaacagttgacacgacaatgatctccagtaaactccacgttgattatgaacaacacttgaaaaacaaataaaataacggtttcgtatgatcgggatattaatttgagttacattcggactaaagagagattcagccatataaaaagataaatataattcctcatttggattaccataataaatataatggatgcactcaatatgattagggatgttgagggtagatggtttttctataataaaaaaaagatgaatctagagaaattggatgtattagttaattgtatacatgcatgtctttttattatgaaaaaaaagatggttacatcctatattttgaagtaaagaaagtaatagattgttatattttaggacaaaataagtatttttttaaaaagaaaagggcgaataaaaaatatcagtaaagtaaaatggcctcctgaggtagatactacaagtcttgacaagaggttaattggtactactactacttgctacagtaggggccagtagcagtggatcattttgcatgatttgctacagcctacaggatgagtagcagtagtagtagtacgttccatgccaaaccgatcgatccgtgcgtgcctacaccccagaagggtctgaggagagtgagaggacgggaaacgcatgggaatgggatgcgcccgccccgcccccggtccctggtcgcaggcgatcaacgttccatcctcacgtcgcgacgagcgagcagcacactgtacacacactgatactgatacaaaacgctccgatgctcgcacctgcaggatcgaaaagtttgttgggcgccaccaccgctgtcgcgtgaccctccctccgctccgattgacggccaggaaatgcccggcgcgacgcgatgccccctttgctctcgtctcgtccgccaccgcgacgtcgtcgtgtccgtccttcccacgtgactccgcccccgcccggtggcccctcgcctcctcacggccgtccattcgctcgcagcgccctcgtgctagctgccggggggccttggacaaatactgggacggagtacgggaaaacgcactgattctgccgtcgaatcgcgtgcgtatctgcatctgcatatatcgggccgctctttctgggactgggtgattaatctcgtgtcgtgtcagcttaactagtggcctggtctagtgcatgggatgatgataattccgaggtacgccctgtttagttctaatttttttttcaaactttcaacttttcattacatcaaacctttcatatacatataacttttttaccacatcatatcaatttcaatcaaacttttaaattttagtgtgaactaaacataaacatagtcgtagatggcgtgtggggtggggtttattagtgataaaaaccccttttggctttacgcgcgtgagtgccacgggactctcgggctcggctcgtgtaagctgtacgtagcgtgcaaaatatctctctccctctctcgatcgatcgcctcgtgtcattttcagtttgctccctttttccggcgacgcacgcacacgctcctcatttcgtacggggaaagctcgtggcttatagctattttgcatgcactggccggttgctggcacagtggcgctccacacgtatccgaagttctaaaccaactagaaaggtagcccgcgcacatgcgtgggcaccttctcgtataatatgagtaaaattttattatgaatatttatatgtaggtggctttttattaaaatatcttgtattatattctaaactaaaattaaatttattttgtgtgctttgaaaagctttttatatttttataattatccttgcaacatataaattctaaaataaaattacttgaaatcatgtggttttgaattgatgagaaactattgtgtcgaaacaatggaggtggttcctatgataaaatttagggtattttaactcgccaaaaggatagtttacaacctcaaaacaaattcaataatatcatttttttgtttgattgtattttaaaattatatatatatatatatatatatatatatatatattcattctaaccgtccttgtaaaatgtttcaatttttctatcaagtattggttttaaatccagcaacatttgttcaattttcaatttatttcatgcctatttttattttttttcttttggatagtttcattctatgaatcatccttgaaatgatttgatctttgcaatttgggacgaaaatataagaacacataacctagtatggggtaaaggtatacgttctaaattttctctcctgaaatatcaaagtaatggtcataatgtatttagtgaatcatcactaaagtgtattgtcttataaaaaaaggaactgacttgatttattgctaaagccactgcaaggttgttccatagttaaaatccttagatacaacctacatgcttatcgatatgatgttcaaccaaccacacctttattttcaccctattgtctatattgctagatgaatacctgctatgattagtgacttcgtagatcatatgtgtaattcgaacgctatgatcatctttcttaaaaatatttatctatgtactaaaaactttattttgaaagtaccaaggtcaatttgtataggcatgtcaagagaaattaattaagttggcagaaagtctttagatgcctaacatgatataagtaataaatggaggtccatttgtaattttttcccatatagataattttaattttaattatcaaggagataaaaaatagagagaagaatggcgcacgctgtacatgggcaggaagggagggaggtttgggatgtttttctaaatgattaatctaacagactaaaataatgtgtcagatgtttatgtcgaaaccgatggtcggatgttttgttttcttgtcagaattttattaggattttctttgatttaagagaataacataatatcttaagagcatttataagatgtgtaatcgactttttaacaccgtatgccgcaaaggagggagggaagaaggtttagggtgttctttttttttaaaaaaaaatagatctaatgacctaatataatgtgtcaattaatccattgaaaaaatgtgtccatcgatttatgtcatatctaatggttggggttttttttcccaaaatttctaagatttttctctaatttaagaatgccatatagcagcttagaggcattaataatatatttaatggattttaacaccgcacggggatggggagggaggcaggaagagaggtttgggttttttcttattaaaaacctaacaaatcgatagccaaatgttttgttgtttttttaatattttctagtattttatttaatttaatagcaccacgtggcattttagaggcatttgtaggatatttagagtcacagagcgagagctgctagacctaataggtggaggtctctttgtgatttttttaatgtaaaaataattttgattataatttcttatgaacatagctcgttggtaagtacgtgacgggaggttcggaatgcgtgctttttttttaaaaaaaaatctaaccttctaagataaaaataatagatcaccgatttaaataaaaatcgatggttggattagagtgccacttggcgacctaggagcgttcgtaaggtaccacttggcgaattaaaagtatttttaagatatttaatgaaattttattatataattgtctttttttttgaaatttaagattttattttatttaagtatgtgatatagtagcttagaggtgtttataaaatgtttaatggattttaacactgcacaggggtggggagggagggacagaggtttgggatttttttattaaaaaatctaacaacttaaatccatcaatttaagtagaaatcgatggtccgtcgctttgtattttttaagattttttaatactttctctaatttaatagtaccacgtagcgatttagaaatagggagagctgctagtcctattagttggtctatttatgtttttttacctgtaaaagtatttttgtttttattttctcattaagtagaaaataacacatgaatgaaaatatggaaagacaacagggaagtacgtacagtacatacgcacgtacgttcggcattacgtacgttggttccgtatatgatgttccggatgttcttttttctttataaaatagatctaactaaatccaaccattcaaaataatgggtccaccaacataagtaaaaatagatggtcagatttttcttatttattatggtgccacttggcgatttgagagtgtttatagggtgccacttggcggtttgagagtgtttataggaaaatataaatattggcaccatccggcctaactgcctaacgacctaggagcgtttaatggacttttagtatataatagatagatagataaatattggcaccatccggcctaactgcctaaacaagtgcgaacttgtctaactgtcatgaccacgggctttaatacttcgtttgggg

SEQ ID NO: 73651 - DNA, 3509 bp, Oryza sativa
atactctagtcacagtcacaccaaactccattcacagatcaccaaaatgaatccaacagcctgcaaagaacattgtgtcaggaattaacactagtaagaaatgaacacaagctcaacactctagtagtccctagggcagcaaccttttggaaattatattcaccagtggttttatttattcagtctcatgagtcctggcactataggaagtcattgtagtagagatattgattccaaacagtacctatgttcatttgattccagtatctaactatatcatacaatactactaatagtataaaaaaatgagaggtccaagaacaagaaacagaaactgcattatgtaagaagaggcatatcataagatgaagatgtgtacctaagcgcaaccaagtcaaggaggagtggtctgatgagtgacctgagtctgtccaaatgctatcatctgtcgaatgaggttctgagtatctgctgctgacttctgagtatctgttattgccttctttaggttctcaatctcctcagcttgtttctgagcttttgcctcagattcttctgcctgggcttccaacctctggaccttttggcgaagtcctgcagattcttccttctcagcctccaattgtgcttgtagctcctgcatctgcggtgaaatagattttggagcggcaacaggctgttgaagtcccacattacgaaggaatgtgcttgactttgtcaacacttgggcaacaatatctgtgcaagtcatttcctgctccccttcatgtactggtcttctcaaaatggcttccatatcatcctagcaagacaatgatttgtcaggtttccttcacaatttattttatcagtagtttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagagagtatacttcaattagatggagaagtccaagttagtatttgtttatgatattgtagctgaaattgtatattttttttcctgaagttcaccttttcatgtaagatgtaaattaccattcagtgaatgaaatgtgtgatttttcgacaagtccctccctgattttttttatttataatgctaaagtgtgatgcagtctgatgttctccaaataaaattgtggatgccagaattgaggaggtcttctcttgccacgcagtcctacgacctctccgtccaccgctgcggcaccacatataccccttcgcaccctccctcgccgcatcccgcttccacgtcgacgccgggggcctccttttccaccacaacttcactgcttcgtctcccatcgtcaaggagttcatcctctcggtggacgctggtggcaacacttccgactgtctcatcaacgcaacggcagcaacatgtgctctgtccgcgattttggtcgttaccgagcctggctgcccttccccacccccagcgtggcgccatcccccaccctcgatagaggtgaggcgcaacggtggacggcacggcgcccttcccccactccggcgtcctccttcaccgggaacactcaacccgccgagacgctctcccctagcccgagaattgcaaagtgtagttaacaactttttcattaatttaaattcatttagggcctcagtcagttcgaagcactaatatatatatatatatatatatatatatatatatatatatatatatggcaacatatcctatgcacacaagccctcacgtgtacacacgtgtacaccaactaaaaaatgtcaccaaaaaatctaaaaaaaatcatacccatactttcaattgtattacacctagggttaaaatcttaacgtcaaattcattatattttagccgtaacaaaaaaaaacaaaaaatctgacagttttaaggttgtaattttgtcagaattttatcttttttgttattctctatgtagaatgaatttgaagatgcgactttgcacgtagatgtaatactattgaaagtacatgtatgaattttcctaaaattttttgtgaaaatttttagttggtgtacacggtgtgtacacgcgagggcctgtgtgcataggatacgctccctatatatatatatatatatatatatatatatatatatatatatatatatatatatatatatatatatatataaacgtatatgaaattaatagccatcgtagtaaggattaatagccatcgcattaatgacctttaggcactgctgctaataatcctagtacaagaaaatgccatgtcatggatcatccaagaaactagagtaatgatgcctagagtagaaacaaggcaaaagatggcacagatattccagcaactatgctgtcctctcacaatccagaaataaaatgagagcaacaaatgtcagtacaattccaggcaccaagaacagctggaattcgcatatctcaattaaggagtttacacaattgagttcacaattcataattatttcacggctaacacattaggagctgtttaaaaacaacaatttcatcacaactcagattcacatatctcaattactcgacatcactatactcaccatcatcattagggatcataattgtacattcattttcactatcatactgccctaaggtatcatcatcgtcatcatcattgtacaggtcatcttcttcaacttccagatcccgttgcctgcgaatctgatcaactagggactttggtacacttataccatcttcgttgactggttgtttgtcgaccagagatccttccatggtttcaactcgagatatttcctgctcatcatcttggtatgtcagatcaacccctccctcttgcctgtcatcattttcctcctcattcacattccacaagtgccgatgcgaaaatttttgaacaactttccagggttcaccatgcttgttatcatccaagtagaaaacctttgttgcctgtgtggcaagaatgaaagcatcatccttgtaccaacaacttccatggctgatgcttttgaaatatccatcattcttcatcctaaactttttgctacaggtatcaaaccaatcacacttgaataacaccactgtcctttgactgtcagcgtcagagttgtactgcaactgtattacttcttttagctgaccataaagtctatatcttctccattatgtgtgccctcaaccataactccactgttttgtgttcttctactgctctcacgttccacggtgtgatatcggacaccatcaacaatacatcctgaaaatatacgaactctaagaagtggtagacttgccaatgcatatagtcttcatcgatttgttctccattcacaaacctccgagtagcaagctgcagtatatatatatatatatatatatatatatatatatatatatatatatatatatatatatatatatatatatatatatatat

SEQ ID NO: 73652 - DNA, 6941 bp, Oryza sativa
gtttttgaactttttaaataaaataatttgtgaaatgttgtttcaattattaaaaaaatacttcccttgctcaaataattcccagaaaattctagaaaatagaagagcaagcatagtatttaataaattttatctagctcacttttatgttgaaaattttcctagataattaggttttagcttgtaggcttttaaaatattttctaaaaatcatttaaacaatgcatttttaatttaggcgatttttagggcgtgacagcccagtttcaaaggtacaggaacaggtgtcttctctttaacctgccatacctcctttgtttttggtgcggtcaatggcttcttcgaaactgggaacgcaggttgaccgacctgtgttcctggcttcttgggtgccagcctaaggtatcgacggatcctcatttcttcttgatctttaggaaattcatcatgaaattgctgaaactgtccgtctttcggggtagaccttgacctccttgtgggtttggtccgtacttgatcttccccatggagcaatgctccatccttgatctccttatggacgatacccgttgttgctctcgtgagcatgagtccttacgggttttcggatgatccatcccagtgtgactggcattgccacggacctcacatgtcatgtgagtccagggccttaacagcaccctgcttggcgtccttctcattgttgtccagtctcttaataagaagatccaactgagtggccagcatttccgtcctcttgacggtgtgcataccgtattgacggattcggagtcgttcctcgctccaacccatatttgagaccatcttctcaatcagctcggtggtacctctgaccgtctttaagaagaatgtctttccaatagcagtgtctaggtgatcccaagatgagggggttaatccattgaaaaaactctacaggatgagccactcgtccatcccatgatgaggatgggcggtgacatattcctgcagcctttcccaagcttcaggagttgtttcatccttcggctgctgaaagctggatattcttccacgaagagcgttggtctttacccatcgggaagaattttgagaggaatgccgttgagcaattattccggatattcacaattgcatagttggcgtagaaccactgtttcgctttcccgaggagggagaacaggaacagtcggagcctgatagtatctggagtgactccgtgctacagattttcagcaattcctgcatatgagcacttgcatcctcgttaggattgccacagaaccggtaaacctgcgccatcgtgattaggctggtcttcaaagttaccatctcccatgctgacttagggtccaacgggcacattgtcggcggagggagctgcgaacttgcggaggatcttcccagccatatcgttaaactctagtggcacgaaaatggatggtctggttgctgatagagtaacttgaggagggacaacacggggtcgaggctcgctccacaagtgactcaagattgaaattagttggcagatcagaactagtcttgtactaccctgttttcacataaaagagaaaacatacaaggtttgcctacataggatagtgattatacagaggtaaatataaaattattagcaagtagtaaactctgaatgatttatcttccccgacaacagcgctagaaatgcttgttggtatttcttagcgacagtactggaaatataattctcagcaatagcactagaaataatcccggtatactatggttacagatatgatccgcaagcgcacgaatgtaccattgtagcatttcacccggaagtattctaaggtatcgtatttaatcccaatggaagatatgataagagagaattatactaataatttatatattagttgtgtacattaaaataatccaagagtagagtaacacacagcaaaagacctagcattcttaataatcatcaagtatcacattattcacattagtgagtagtgtgggactaatcacgaaaaacattgctcaacccgcccataaccgcgggcacggctattcgaataattttactctggacagagatgtaccaccgtacccaccatgtgcgtcaataccatcatggtacctaggaaaggagctgtgacaatacaccccatacaacacaactcaccacagcgcaccgttcctggatcgtagtcacccctttataaaacaaggcatggactcctcagtgacccccgtgggcttatctccaccacttctcagtctcttgccccgtaataaactatgctatacaaaaggtaaagctgttgcccacgctggcttgtggttggcatggttaatgtttcacaacagtagctcgcgaaccggtccttaattgtcatgagcacgaccaccaaaaccatgtgctcacaacccaccattaatcaagttttaattggcaattaattaattaaccaaacacgattgaccaccgtgtgcaaacattaaatagcaatcattaagtaataatgaagcattagttatccccaatagttaactaatacttctaagcatggctaagcaattatatctaatatctagctgaaccaatatataaggcccaagctagtcaaattataacacataggaaaataaatcttcggccataatatagggaaaaggctcaccacccaatgacattcgaaaataaatgcatatttgaaataaaaagagaatttaattatatgttcaacatgctcaaaggattgtgtttagtatctgtgtgacttgccttgcaataatttcaattagtcttctggatcacttccgatgcactcatgatccttccaaacgacgaaaacgacaaactaatacgcaaaacgaggaaaaaaactaaggaactccaaataaacagtacgtaaaaagtaaataaacatgtagaccatgattttagatgaattatgagacttgaacggcctcattctgacttccaatggattaattatgaattttacaagatttaatacaattaaaacctatttaaaaggattaaacagattaacaacacaatttataagtaattttaatatagatctctattttatacaaatttagcgacttgaaacacattaatccgagttataatgaattagatatgatttttctaagtttaatatgatttttgcctaatacagaaaagactttactaatttattaatgtattaaataaaaggaaaaagaggatgaaggacggtggctcgggaaacgaagttcgccagcgatctagggcataagggcccgaacggagggcactaatgcgaaaagtacaacgcggcgaactcaccggtggctagaacggccgagattgacgacgaacggcgacggcggcgaggttttggcggcggcggccttcgggtagtcggcggcgatggtgctccggcgggttgcggcacaaacggagggcgggacgatgtcggcgacggtcacgcgaacccgtggacgtgaaccccgtgcgactgcggcgaccgaggctacggcggcgctcagctgaagcagctccggcggcggcggcgcaaaagacgacgcgggaacggcgctagagggggcggcgggcgaaggtggaggtgatgaggggtagaggagtcccagggggtccttttatatgggtcaagaggcaccggggagggctatggcaagccggcggcgacatggaaggattagcgtttgattaggaaagagaaattcgaatccgatttgatttgattaatccatgcaaaattggactccaaatcttggggaatgaaggaggaggatatgggaaatatttcccctcaaccaattttggaaacaaagcacgggagagatcggatttggcgagggggcggcggctgctcgagctcggctgggcggctggaggttgaagaaggcactgtagcgatagggagtcacactagactttttctgcggtttccttcactaggcccgattgaagaagggacacgaatcagactacgacagagagagggagagggctgctggatcggcagggctgaaggagagagatcggccagattcagcccaaggcatagaagaggattttgattttttttttcaatttaaataaatgctgaaatgatctttcatttattaactatacttccaacgctcacataattccaagaaaaatcctgaaaataattggacactcaaagtattcaacaaaattataatcagaccatttaatgattaaaattaggatttagtatttatataattgctaaaatgctctttgtattattaaaattaggatttgagctccgaaaaatacgagaaaattccagagagtataattaatcgtagagaatttaataaaaattaaatctagccattcttaacatttaggaaattttatttcccacatttaactttacttgtaaattaatgaatatttaatataaattgtagaaataatttattaaataatttataaatcctgaaacgaaaatcagggtgtgtgttgatgcgaaaaacacacactggcctgagatatgcttaactctagtgcaggtccaaatcttggtttcgagttcgagggtatgccagttggtttgatcctgcaaccaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaactaagtgattgggatagatcggacagcttgccgagatagtataaatcacttatgtttaaaagtaacttgaatcagatattatatatgttcatagcatagccggtgttttagatctaacatgtatcggctaatactccgataccactttatactaagataacaatataaacaaaatatattaaacagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacagcattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttttactataataaccggaatgccgagtagtgactgtgagagataaccataagatagcttgccagtccaatccgtcatatgctggtcaatccacatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcgagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagcaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatataatcccatccataataatccatatttggtgctaacataactgactaacacatcaagcattgtccataaccgaggacgcggctattcaaatagattatactctgattagaggtgtacaactggacccacatgaaatgaacaaagatcaaatgctacacaccccgtcgagtgtggtacacaagtgattcaagctcattacatgcccattcttagccccaccccaaccacctataacatgctggggttcccgacgacttagtcacgtgcgtgcatgatgtgaccagtggcagtagggtataaggacagcaatatcacaagaactaaatgcataaataggttctacccatacaccataaaccgataatattaatatctaggcaatgcatgcatatatatacgtatagattgcaaccaaatcatttttagagaaagtataggttctatatgcttaggtgcttgccttgctgctgagggtagtcactatcatcctctggatatggctcgttactctccagaatctccgaatctatcgaaaagaagcaatat

SEQ ID NO: 73653 - DNA, 5836 bp, Oryza sativa
ggggaagtgaataacatgcatgtctcgctcatctgctgtgcctggctctatgtgttgattaagtagggtgatttgtacttttgtagtatctggagttgacaatgtgcttgttggtataatacccgggtgtggttgaatatctcctttgagctgtgatgaagctgtgcagtttggaatcatagcataagtgaataatgttgagacaccagtgtatactttgcccggatttgttcagtaatctccgtgaccgtagcccactgttacttttgttgcagccatttttcagattaggagcagtggggacatgcttccatgttggtgtttcttggttgcagcgaaatgtggttttgtatgtagttgtttctgagccagaagtagtatggccccctgtttctcctgaaaacattttacatgtgaagaaaagccaatgttgtgcatgcttagatctcttatacttagtcttacttgttctctttgcatggcaacaatatgctccatgcctctagacattggccttccctaatgtctttacttcagttccataaaagaatgtcttaagttatctataacttctatgcttttctctggccagttagtacatgcatatgttctgaccattctggtcatgtagcacaccactttatatgctttccttctacaaattgcctgtaggggttaagaacaagatagattcatttacgaaaatattttgcggcctactatttttttttgcccaaggacaaacaaactggtgtttttttatcttctggaccttgatagatgaattgtgtcttgtgaagtaaatgatcactttgcaacttaatgaatggggaagaattgtggcaatgcctgattgataatagatacttagcagaacacattgttgccgtttttttaatggagttatcagttttggaggttaagtaagaatggtgacaatgtcttatagttacttaatagatacttaccagaaaaccttgaagccgtttatttacggagttatggaggttgattcaaacttctttttaattactgtaagttgtgagttcctaagagcacaagattttgggaggacttgtggctgggcccagaaactttacaatttgaccttcatcaagcagactttggttgctgaagttttttaattgcatgttacgtagaatcaaatttagaagatatctagcacataaaactttgcagatgtggaaacagatccgagatatatgtggcagtgtgggtcagtaaatttgaatattgtcagataggctggtcttaggttgaactccagaaagaattttacagtaaagttcctctatggaatcagaaaggtgaaatctatggggttttttttcaataaactttgtggacatggaaatcccccttaaaattgagctttttctttagttggtgatgatttgttccattgtaactaaaaatattcttttgtggatatgtgagaaggagagagcatagatcaattagatgttttcttttactcttgtgttttacctagactattgtgatataagtttgttactttttaatagtaatgacagatcatcttcagttcaacatctgtttgaagtttgagtgaccaaaattgaaggaaaaactagaaaaaacgatgattgacgtgccccaggggaggggggttagctactgtgatttgatccatttagataactgcagtaatggttcatgtttccaggagaaagaagaagataatttctggatgggccaaagctaattgagatggtgacgaccgaggtgtttctaccatgaaagttccaaccatgaagagggtagaaacctcaagtgccatgaatggaagttcgagctgaaatgggaagtgatatgtctaactgacaataggactgccctaggcactaaagggcaaggaacaagggagtagtacatggaatgtttgtgttgaataaggaggtgtttgggtgagagggactaaataagtccctccctaggcactactccaaggaagttggaactagtaactatatccacagctgtatatggaaagtctttggtctctgcagaggaccaaaatctgtacaaggattgtgtgggtgggggttcagtttagtctctctccctctctcttttttgtttttcagtttttgaacaggagttttaagccctgtttggcaaatgctctctgttttaactgctatgcaagccattttcatgcctgttgtgcagcttcaggttttcactgttttattgttcaggatttatgtagacaacctcctgagaaagtgtaaaatgttgtcacttaaccttgtaccctgttcttagagctaatatatcctagtatattttttttattttctaaaaatagtaaattcacagaactacaaatactttaagtaaactatcccaagactagatattttatatgttttattataaaaaaatatataaatttagcattgaatttatcataaaactacatattttaacttttgtgaaaaatatatttattattaaatttatcacaaaactactgattaatcattgacttcatcacaaagctacatatttacaagttccatcatgataaaaatactaggatggaacctctaactatgttgtttcgtgataaattaggtgtcaaaaatctgtagtttgcaatagtatggcttgataacctgtcggtgttaaacgtttagttttctgtgacaacgctagaatttgtactagtaactatagatatttttgtaaaactatcataaagctacaaattaaaggagcatttttttcatggaaatatatgtgccattcaattataaattatattggaaaaacgtgtataaatccaggctatgaaagagccccattgattggcttgataagccaaaacaaaagccaaaatttgaacttttaaacttgaatttaaagttgattttaagacattttcaacgtcatttatttttagcattggcttttagatcattatgaacaaatatataaaaaattatctataatttagtttttatttcttaataaaccgttttgatttattagtagtaggatatatgggtaaccaattaggctctcaagattactataagtaataagtctactttgcctccctcaactcatgctcctagttgaattgcatccctcaaccgcaaaaccggatataacccgtcctccaacggtcaaaaccattgcaaatcgacttctcggacggtttcggaggcagttttgtttgacatggcaattaacttgctgagtcatcaagtgggacccacttgtcaacagcctatatctcatcccatcttctcccacacctccccccctctctctctcttaactcttcctcttcttgtcaccttccatcagcagagaggaggggaggagctcgtccgccggccgcggcgcgcgtggggaggagattcgtcggtcggcagcacgcgaggaaggagctcgacggccagccgtgcgcggggaggagctcctagccattgacggacgccgaggcccacgggcggagctacagtaataaggctggtgtcaggtgacaccaataactttcggcaaaacctaaggcaaaactgtttatccatatgttattacactatgatctaagtataattagtgtactatgacaccgatagacacgctatgacaccaacgaatcgattttcattcgtccctgccgaggccgtggaggttctcgaagccgtcgtcaaaggcaacgcgtgggcgccgccgccgctgccagccgtcgcgctgtcgacgagagcttcaaggcgatgcgcatgcaggacatcgtcagggatgcgatcaagctaggattccagcgtgcggacttcgacgacgtgatccgctcattctgctggtactactcgtcgttcttctccaagcaggccgccgccacggcagtggcgccgcccaaggacgacgaacagggcaagaaaaccggcgccaccatctcctacgagctcacgctcctggattgcctgcatgccaaccttgtgccgccgtcggagggagccgccactgggggcggaggggtgaaaggcggcaagacgtcgaggatccggacggcgaacgagctccgccgctctggcattcgtctcatggccatggaggaaggctgcgcgtggtccagttcagcgaggacaccatgacgctgcgaggtgaggaggagcaaggcgagcaggacgaggccaattaccatgcccatggccaccgccgcgcaccaccaccaagccaagctgactcagcaccttccctacaagacactgacatgtggggcccacgcgctgactcagccagtcaacgggtccaaaatgacacgccggacgaaaccacctcccaacccaaaccacccgaggagtcggtttgcaatggttttggaagttggagaacggtttatatccggttatgtggttgagggatgagatttagacaggggtatatgagtcgagggaggcaaggtagacttattccttactactactatagtacaatacaactatagggccatcaggttaagtcttttccaaagaaaaaggcccatcaccatcaggtaacttactcctcgtccgtccgtgtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacggtacactcttcgatcgcctcgattctttcttccgattcttcgacgaaatcgcattgtatggccacctaatcttacctgtgtccctttctttctgtgttcttcttcttcatgggcgtcaagatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatgtgagtgtatatataatccacaactaatcgatcgatcattcatcattcatgtacatctgttctgctttgttcactcgtttgcgtcagtcagtatatccctcttaattggtttttttttcttgtttgttggatgggaaacatcaaaaccaaaactttgcttgttttgcagctatggccggctgccaggccggagaacacgctagtatatttggcattgacaagaatggggatgattctgatgaaccgtgtgctaaggatgatgccaagcaaagtgatgtggctcctctgaaggaggaggagaattgggagctggacagtgaaccagagctcacatgggatgagaaggtggttgaagttctaaacatagttcgacgccgagagatcaccgaatataaccccaagcagttttgctcaattcctactcgattttgtgcctacaacatagccttctttgacctggacaaagagtgtgagtacatccatccatttgtttgttataatatcatccttgttccttgttcattctttgattattgtacatgtcttaaaaaaatttactttcctggtttgatttatgtctctggcttgattttgcagcaaagcttgcacgtggaccacctataagtactagctttcccgactactgggggagatggactctgtcaatgtgaatgcaatcaaggtggccgagtctgatgtgggttaccctatcagggttttggcactgtgctggccaggatgagtacgatttcaggtgtgtctatttgttcaggcgtgacagga

SEQ ID NO: 73654 - DNA, 7795 bp, Oryza sativa
ccccacaggctgttgaagtcccacattacgaaggaatgtgcttgactttgtcaacacttgggcaacaagatctgtgcaagtcatttcctgctccccttcatgtactggtcttctcaaaatggcttccatatcatcctagcaagacaatgatttgtcaggtttccttcacaatttattttcagtagtttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagagagtatacttcaattagatggagaagtccaagttatgtatttgtttatgatattgtagctaaaattgtacattttttttcctgaagttcaccttttcatgtaagatgtaaattaccattcagtgaatgaaatgtgtgatttttcgacaagtccctccctgattttttttatttataatgctaaagtgtgatgcagtctgatgttctccaaataaaattgtggatgccagaattgaggaggtcttctcttgccacgcgtcctacgacctctccgtccaccgctgcggcaccacatctaccccttcgcaccctccctcgccgcatcccgcttccacgtcgacgccgggggcctccttttccaccacaacttcactgcctcgtcttccatcgtcaaggagttcatcctctcggtggacgctgctggcaacacttccgactgtctcatcaacgcaacggcagcaacatgtgcactgtccgcgattttggtcgttaccgagcctggctgcccttccccacccccagcgtggcgccatcccccaccctcgatgaggtgaggcgcaacggtggacggcacggcgcccttcccccactccggcgtcctccttcaccgggaacactcaacccgccgcgacgctctcccctagcccgagaattgcaaagtgtagttaacaactttttcattaatttaaattcatttagggcctcagtcagttcgaagcactaatatatatatatatatatatatatatatatatatatatatatatatatatatatggcaacatatcctatgcacacaagccctcacgtgtacacacgtgtacaccaactaaaaaatgtcaccaaaaaatctagaaaaaatcatacccatactttcaattgtattacacctagggttaaaatcttaacgtcaaattcattatattttagccgtaacaaaaaaaacaaaaaatctgacagttttaaggttgtaattttgtcagaattttatcttttttgttattctctatgtagaatgaatttgaagatgcgactttgcacgtagatgtaacactcatcgaaagcacacgtatgagattttccctagaattttctgtgatagatttttagttggtgtacacggtgtgtacacgcgagggcctgtgtgcatagaatacgctccacatatatatatatatatatatatatatatatatatatatatatatatatatatatatatatatatatatatatatatataaacgtatatgaaattaatagccatcgtagtaaggattaatagccatcgcattaatgacctttaggcactgctgctaataatcctagtacaagaaaatgccatgtcatggatcatccaagaaactagagtaatgatgcctagagtagaaacaaggcaaaagatggcacagatattccagcagctatgctgtcctctcacaatccagaaataaagtgagagcaacgaatgtcagtacaattccaggcaccaagaacagctggaattcgcatatctcaattaaggagtttacacaattgagttcacaattcataattatttcacggctaacacattaggagctgtttaaaaacaacaatttcatcacaactcagattcacatatctcaattactcgacatcactatactcaccatcatcattagggatcataattgtacattcattttcactatcatactgccctaaggtatcatcatcgtcatcatcattgtacaggtcatcttcttcaacttccagatcccgttgcctgcgaatctgatcaactagggactttggtacacttataccatcttcgttgactggttgtttgtcgaccagagatccttccatggtttcaactcgagatatttcctgctcatcatcttggtatgtcagatcaacccctccctcttgcctgtcatcattttcctcctcattcacattccacaagtgccgatgcgaaaatttttgaacaacttccagggttcaccatgcttgttatcatccaagtagaaaacctttgttgcctgtgtggcaagaatgaaagcatcatccttgtaccaacaacttccatggctgatgcttttgaaatatccatcattcttcatcctagactttttgctacaggtatcaaaccaatcacacttgaataacaccactgtcctttgactgtcagcgtcagagttgtactgcaactgtattacttcttttagctgaccataaaagtctatatcttctccattatgtgtgccctcaaccataactccactgttttgtgttcttctactgctctcacgttccacggtgtgatatcggacaccatcaacaatacatcctgaaaatatacgaactctaagaagtggtagacttgccaatgcatataggtcttcatcgatttgttctccattcacaaacctccgagtagcaagctgcagtatatatatatatatatatatatatatatatatatatatatatatatatatattagcaaggtacaccagaaataatgcaagtactagcagactacttaactctaaaaatttgtaaatagatttttccttaggtccattttttatgcacaggttcttccatattggtctacttgttttttagggagaaaaagacattttctcaaaatgattcaggtaacactagcatgaacctgatatttcttacaattagagaaaaaaaatggtgtgacttctctacttaatataccgtatttcctcgtgtgatggtcatcactgaaaactgcagcttcctccaactattgcactagcatgtgcatgaaactccacacagcaccatagccctaccagctcttttgacaggaacaaaatgctatgtggatgtagccacacagcctgacaacaccccacagatgaacaaggacgctggactgggaatctccatcaccaatacgcaacaacaatcatcctatcagacttatatacagggagctatcaggaatgtcatcatggcagaagaggcagctgcacttaatttagtcatctaatctcaaaactaaacatgctgctaataaaatcatttgttgtaaaaaaacaaaaaatgcacacgatgctctattcctctcatgtgcttcattctgccaagcaaggttttcaacagtagaagcaatgatgcatgatagcacagctgcattttattcatgtacatatgtaaatttcatttgcattctcacttcagtaaatgagatatgtatgagatatattcatttgcaatatactggaaatacttaaataatgatatattatcacagagtcaaaactgaaaatacttaaataatgactcacatgtttcctaaaccatcctggaaattccttagcaaggttcccctcaacatcatgactgccagcagtttgtaaatccttcatgtaaatcctacaaacaggtgcacaactcccatgtaagagctaaaattttatatgatacacaaataaaaacaggtgcgctattcaaggacatactctataaatggctcgacctccttagtattgttgaggacataccaaaccatcctatcatactccttctactcatatgtaagccttggtgcccccaacagatttgctccatgctggaaaatagataaaccacatctactcataggaacacgctctttgttcctaccctcacgattgtgcctagtgtcaacatcagcaaaataccttgagcaagcagtcaagcactcatttgcgacatatgcctctgcaatggagccctcaggccttgccatgttccttacaaagcgtttcaaggtcagcaacctacgctctacagggtacatccatccatattgaacaggacctcttaggattgcatcatcaattaaatgaatgcataagtgcaccatcacatcaaaaaaggcaggcgggaaaatcttctcaagcttgcacaatattattgggatttcacctctcatcttgttcaaagcatctaacttcaatttcttagcacaaatttgctggaaaaagttacctaattcagcaattgtttcatatatttccttatgcatgattcctcggagaccggctggtaatatcctttgcagaaggatatgacagtcgtgagttttcaatgcctgtactttgcattcatcaacactaacacaccttgctaagttggaggcatatccatctgggaatttgacattttttatgaaagcacagaaagcttttctctgggctttagtcatcacatatggagcatgtggagcagtgcatgttgaattcccatcatccttcaagtgtaaatttttccttatgcccatatcttctaaatcgagcctcgcagtaacagagtcctttgacttgcctgcgatgtcgagaaatgtaccaagaagggcctcacatatatttttctcgatatgcataacatcaagattgtgtcgtagctttaaattagaccaatatggcaaatcccacagagtcgacctgcgcttccagcattgaccttcttctaccctctttctctttttgttattaggatggttcccaggtcttacatgttccaccctcgccaattgctgcatcaactcatcctgagtaaattcttccggttgcgcacgttcttcagtctgaccattaaaatctttctttctcctccaaatatggtccactggaagaaaacggcgatggccaatgtagcaaatcttgttcctaagtcttttgtagcaaggatttttatcacaacaaacgcaagcatagtagcctctagttactctacctgaaagtgtgctcaatgctggataatcatgaatgcaccatatgattgcagcgtgaagatcaaattctttgccggtcaatgcatccaaagtagggacaccactccaaagatttaacaattcttcaaccagtggctgcaggaagagatccatatcctttccagggcatgtcggaccaagaataagtaggcacatcatgaagttggattgctccatacattgccacggaggaaagttgtaagggataagaaatactggccacatgctatatgaggagctcatcttcccaaatggattaaacccatcagtagcgaggccaagtcggacattccgtgcatcatttgcaaaccattcatactttctatcaaaatctttccatgcctcaccatcagcaggatggctaagctcattgtccactggtttcctcttcaacttgtgccattgtgcctcagctgaaagttctttcgatccaaacatcctcttcaaccttggaatcaaaggaaaatgccttagaaccttttctggaatcttccttcggctatctgcatccttccatcttgaagcaccacatattgggcatgcatcctttttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtcaaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgactttgttcttggtccatgattttgatctgggtacagatcctgtaccatacggtacatttgatcatcttctgggtcatccggaggctcattcgtctcaaattcaacattgcagctaacatcttcattcaaatgctcaacattgcagccaatatcttcattcaaatgctcaacatttccagtgacaatgaccaatggttctccatgatgtatccaccgagtgtatgtgttagacatcccgtacataagtaagtcatcctccacacgtcctttatattgatgtaaccgattcaaacacttacgacatgggcataatatcttctgactgccactcaaatttttacaaacaaagtccatgaactcagtgaccccctcccgatgctccttgctaaacaacttacaattcatccaagttctttccatctgttacatattgaaataagacaagcattgaatcaatgactgatcattgcccagactgctattttcctatttctatcacttcaaatctatggtttcagttcaaaatttaaaaccaaaacataagttcttctcatatgtacctttccttcctaattgaaggggatggggcagtctctggtcgacctcacccgccgtcggcagtgatcccaggctagagctcttgggggcttcctagcggttgagcccgtgaagcccagcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggatggggtggggcttgggatccagccggcggtgccgggctccagaagccgcgttgggcgaagggcgacggcgtcgagctccaacagccgggcgctacgttggggacagggtggggctacagcctgcggcgttgggctccagcgggagcaatgggaaagggcggcggcgtcgggtccagcaggcgcgatggggaaagggcagtggcggcggcgtcgggtccagcagccgcgatggggaaagggcagcggcgttggtctttgctagatgtgcgttgggattcttatgtctcccagcaatagtctacaagatgaaaagaatcaaagattagctcagtggtttgtctgttacctgggatgccagaggtcgtgtgttcgatccctcctcattgcaagaagcgctacatttttagtcttttcaagttaatattctaacttacacatgggtcccacatgtccacctagacatgctcacgtggctgtgccaaggtgttcttttttaaaaaacaaatgatttttaaattatgacaatcatatttattcacttttgtcatgaactattgtcacaaagaatgggaaaggcacatggtgacattttcttatgactaaattacaacttagtcacaaacgcttgtcatccaaagaaaaattgtcataaaggcatcactactgtgactaaaatgtgttttgtcatatgaattttgtcatagaaggccaaatttcttgtagtggcagggggcggcgactccgggttggcgaggctcgcgacgaggccgactttgccaggcgcggcatcgaggtagggcatcgggcagaggcggcctcggctttgtgcagccttgcagcgggatttgcgggcagggtggcgttgtcggcttggaagcgacgacctcggtctcgcatgctaggtacttgttgaaaagtccagaagggagagagaggaagaggagagaaaactgagattttgagggaaaattttggaataattacattgctcca

SEQ ID NO: 73655 - DNA, 2095 bp, Oryza sativa
aacgtacatgatcccagagcactaccgatgcactggattaacaaaatagtataacaggtaaaagtaccaggatcttgggatatggaaactaaataagtaaatcaaatctcacaaaaaaaaggggaagtcatggattgattgatgttccaacagtaactgtcctgaccctcttagacagcaggaatggactaccaggcaatcagattcagtggatatatgatattgacagcaaggtttaagatctggcagtagggattttaatggccaggaaacaggatttctatcgtatcaggcatttcaccagccattatggaactatgcaaccgtccacatttcacttaacaatgtgagcctaattaacaggtcatttatagtgtagaatatcagacagcggattgaaaaggcaatggcatatggatttgaacaataaatagtattaatctagcaaggaggaggaacgaatcagtaacataccggcgaggtgatgatctgtggattgttcctgtcacgcctgaacaaatagacacacctgaaatcgtactcatccctggccagcacagtgccaaataccctgatagggtaacccacatcagactcggccaccttgattgcaatcacattgacagagtccatctcccaccagtagtcggggaaagctagtgacttgataggtggtccacgtgcaagctttgctgcaaaatcaagccagagacataaatcaaaccaggaaagtaaatttttttaagacatgtacaataatcaaagaatgaacaaggaacaaggatgatattataacaaacaaatggatggatgtactcacactctttgtccaggtcaaagaaggctatgttgtaggcacaaaatcgagtaggaattgagcaaaactgcttggggttatattcggtgatctctcggcgtcgaactatgtttagaacttcaaccaccttctcatcccatgtgagctctggttcactgtccagctcccaattctcctcctccttcagaggagccacatcactttgcttggcatcatccttagcacacggttcatcagaatcatccccattcttgtcaatgccaaatatactagcgtgttctccggcctggcagccggccatagctgcaaaacaagcaaagttttggttttgatgtttcccatccaacaaacaaaaaaaaaatactgcctccgtctcatattataagactttctagcattacccatattcatatagatattaatgaatctaaacacatacatatatttagattcattaacatatatatgaatgaatgaatacaatgctagaaagtcttataatataaaacggaggaagtaccaattaagagggatatactgactgatgcaaacgagtgaacaaagcagaacagatgtacatgaatgatgaatgatcgatcgattagttgtggattatatatacactcacatgagtaatctttctccgagtctatgaggctgcaatcacgctcggcaggaatatcaagaactgtcaacgccgccttctcttcccatgtgatctcccgcttacgcttgcctgcaacaattgcaagattcagtccgccgccgccgacgtcgtcgattaccataccgcccctctcgctttcgtccgccatcttgacgctcatgcagaagaagaacacggaaagaaagggacacaggtgagattaggtgcccatacaatgcgatttcgtcgaatcggaagagagaatcgaggcgatcgaggagtgtaccgtagacgtgttcgctggcagccctgatcgccccgtcgccgccggaggggagagagccttagggttttctctttctgtttccccgattatgaagaggctagggtttgtttggtgaggacgaacggcttgtttggcaacttgagggaagggaattgggagtttacaccaaggaattaatggtgagattaagatgggaatttgatttttcatcccagtctcttgtttggtagaggtggtggaaattgatagggagtttagttggtgattagatcattaatgaaaatggatggctgagatttgtttagacgaagtaaaggaggaattccctcctaattacctgccccta

SEQ ID NO: 73656 - DNA, 2001 bp, Oryza sativa
caatcaatacaattcggcgcatcgccacacatttatacttttctactttatttaccatctggcggaacttggcacctgacacagggctgcatcggttttcgatctccggcgaaggggcaagtccaatgtttcgccggcccaagcaattgtctagtctacgtcggcgtcgttcaagactgcatcagtacgttcgacctcttggattgctccggtttggatgatatatttgtctgcctatttatcatatgtcttagttaatctagtcttagtatctcaatttagctctatcagttgtttctcgctttagggttcctgtcggtaccggctaaattgttttactagattagattagctaagacatctaccacccaaaaattagtcaaaggcttgattgtctagatattatgtttctattcatacttagtgctgcataagttaagtttgatctactaagtcgtgtttaaaaccataatccctagcctgctttttgactgccaataagtgtttcatcggggtttcagccaatgagttatctagacgttgcatcagcttacaaggattgcatacatattggatttagccgatggcaacaaagattttactgattatctaatcttgtggatttaatgctatcggacctccagccgatgtatgctttaaccttcggatcgatgcttatttaccatatcattattagccgaatggtttctactggactatattattgctatattatattatcatcaaccgattgcctttatattgttgtttacatcaagtgtcagattctacattggatatatagtcgatagctcaaaaccctatcgctatcggctgacataggcatgggctagaattactccatcggcttgtcagccgatcggctcattgatatgctatttgtatattttgtcagttgcagagtcaaactgactggcagacccgcatctcatcgtcctttggatatgcactggaactaagcagatctcccaggccagtgtgtgttttttgcgtcaacagcggcacgggcaagggataaggcggcggaggatgacgacaacaacgccggccctgtggacaacgctgagtctaggttcttcgacctggacagtgtggaggaggtgacctagccaccaccgccgccgcgtcgaggccgtgctggacgtgccaggtgaggccgtcctcccttgttgtggatattatgggtaccccatacccatacggcatggttatccgactagtcataggggataacttatatctatggaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcatatgagacaacctgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaaatcatgtttcgacagttgtattcctctcgtgcctccactgctgctcgatggagtggaggagtggtggcagcatgaagggcgcgacgccagcgcggtggatgatcctggcaggtggggcgtggtcgccggcacatatccctaccgaccgccgccgctcctctctgcgcacctcccatctcctcgcgcagcctcctgttaacagcggatttgaaggagttaatttggtttccaaggccaatgcagcgcatcggctgagagccgtatcgatcgatacaaaattagactcggttagccgatatggaaaagatagcagatacagacagtttccgactataagtcgagctcggatcaaggatttaaagatattgccaaacaaggagtt

SEQ ID NO: 73657 - DNA, 2089 bp, Oryza sativa
ctccttgcccttgtttgctattggaatcaaccagcagatcttggattgccttcagatgcttggtaacctcctccttgtgagcttgagccaaaatcgcttgactctggatttcctcatgaattagcttgttgtctccttctacctctttctgaaactcctcaaagtttaaccgcagttcttctaccgcagcctcccacgccggcatcaagacttcttcctccaatccagcagcatgtcccctccccatggtgagaaatacagatctggagatttcacaggaaagaaccttggcctctcccaaccctctctgcacttctcaattctgcatcttctccaccaaattccaaagcctggctacggaattttacagaggaacttgtcctcaaaccctcaccagcttaggactcttcgaattggagaaaacttggccaattttcgactgatgctctgatacctttgtcagatcccggggtcaaatgtcaccaaaaatctgcagattcgagctaatttgggctaagtagctacctaataggattcctaaggcagaaattaagctaagaaaattaaaggatgccgcaagacaagcaagtaggaactagggtttatatttctcgatccctttttcatccacccagatcgccttatatggagtacgggatctgagtgaggaggctggatagctcagcaggctgtgattacattaagtttcagagttttaggacaaagaagtacagacacagtaattactgaaatgaaccagctccctcggatttacatcattgaaccggtatcttagcatctgcgccgcccattcccgcaactcctgtttctctttctgataaacaacttcttcagataagcaaggcctgacacgagcttgcggacagcatgaatggcgacggtggtggacgagctcgggtacggtcgtacggcgaattggatggtaaatcctgatagggctgcgaattgggtggcatatactgaaaattctgcggacgcgtagtgggctcccagcggacacgcggacgcgggttcatccaatccatctagctatgcggccttctcgtggggcggccttgcgagactttttgcggggcggccttgcgggcaagcgggctggcccgcttgccacctgcacccctaagcgagaggcggatgcggaggccatcgtgacgcgttcaacgtctcgtgcaagcgcaggtggggtcggcggaagacacggtgttagcggggcagagggaaagctggtgcagcgttggctttacaagctttgcagagggaggtgcaagggtaggcaaagggatccagggccggtcagtatcgccttgttgcgtcgagcatcggctttagcacactacaagagcttaggccttctatgactaattaattgtgacaattacagcctttttcttgtcattgtaccccttctatgacatactagtgacaaaatagctatagtcattgaatccctgtcattatcctccttctgtgactaatagacccaattgtcattaatcgtagtgacaattgcacgcttgtcaccggtctatgacaatggttatttgtcactatatttgtcataatacattagatgggatgctgacaagtgtctagccatctgacgtggcatatgacgtggcgtgtgacatggcatgtggagtatgacaaaaataattgtcacaaaaatgaagttggcccatttataacatggtctggttttgcaattataattcaaataagcctaactagcccatgggccagccaaccaattttggcccatttctcaacagcctttttatttttttcatgtaagcccagtagtatttcagcccattttacagttgatattgcagcccaagctcatttaaagaatcatcataaataataaacaacttacaattttataacaaaaataattagacatccaaacagatcatttcctccaaaattaatggttcatacagcctacatacaatagttctaaacattcaccatccatacaaatgaatcacaacaaaatacgtccaccaaagtcttacaagtccaacagatcaccaggtcaccaatcagtaataccaaacatacatcc

SEQ ID NO: 73658 - DNA, 28505 bp, Oryza sativa
acggtgccaaacatttcgaaacggagggagtacattacaattaacatgcatttcaaaccaagatttcataataatgattatttttagagtaaagtacatcactcacaggtcctaagaaaaattatttcacaaccataagtgttgtcattatttatttatggattttacaagttaaatcataggaatgctaaataaacttctaagcatgatttaagaggtagttttgtcaagatcttttccacagaagtgaagagtaccattttacaagttcaacaaaattattttatatttttatcatattccaatatttacttatgcattgtccaagatctagactactaaaaggatacctagatctattcacaattttagaggaaaaaccagtacataagttagccatttttattttacaacattgtagatcacgtttttattaatccatagaaatttggttcagctcaaacggagttcagatgaattttctacacatttttgaagttagtacaatttcagcacatgttgaaaacagttttccattaagagtcctcgaacttcctgaatattacagagtggtcaaggctacagtgttatgtgtcttggtctgttttttgggaaaaaaccctcaagtttatctaattcaccgatgaggtccctggctcgagctcacggggaggcagccatggctgggctcagtctagagcttgccgacggcgaacggaggctcggatggggtcgagttcaacagagaaactgtagaggaggaccatgcgaacacgtaggtgtccgcgctgatgaacaagctacagctacagcggtggtctgtagctcgcgaaaaacaagctacagcggcggtggttcttggtatgtgcatgcgtgtcgagctacagctctgaatgggctatatgggtgcatgcatggggtgttcaggggtatgcagtgtctcaccgtgcagctgaaaggggtcggagaggtccaggaagcatcgacggcgttggagatgcccggcaacacaatgaacacgatgaggacccgagaacgactagatctggccataaaaaccccaaataaacgcttgaatgagctagaacattgcatgcagagtctttttggccaaggtaaaggatctggagctcaccggacagggaggaacaaagccaacgtgtctagatcggggctgaggaaagaaggcgagcgttctccacgcctggagctcggcttgggctgattcttgacggtgttacatctgggaggaagatgaattagaatgagcagcaccaccctgtatctcggcctggaacgtcgggaacactggaagcttgggtgacgcgacgacaccggccgcgctccggggctccaaaaagagatgtgcgttcccagagattcactgcatgaaaatcgatgaaattttgaggggagttagggcatgcataggagagcagggaacgagggttggacggcgaagaagacgaccagaaacacggcggcgacgacgaagttctctcggccagcaaggaggaagaaggaagatgggggcgaaatgaggtgctctcaccttgcgtttatttctctggaagggagtgggaggagtggagaaagtggccagaagcttagaggagaagggagagtaaagagagaggtgtcacacttgtctctctcccttgcatggccaaaacgtggcatggctattcttctgcttgtcccctgagtatgagagggttgggccactgccatgtgggccagggactgctggtgggatccacatgtcaaagagagaggggttggagaggaagagacaagaagaaaagacaaaactaagatttattccctcttctcactcatgacctgctaattcgaattgcttaggaggggattcaaattttggcctctggtccagagatgggtcttggaacatgctttctaatccaattggtttcactaaaaaatgttgagttaaataattctagtgaaaaagtgaattcagttaatctgaaagttagtttgaatttttaggaggtctaaaaagagaggaaaaattccacaaaatttatatttgttggtgataaataaactagtatttgaataaattattaaacatgtacacttctgttcaagttattgttcaaatagaagtggtttcaattttaccgattagagttaattttgttatcgcatatgatcaaattgcaatatagtaaatatgcaatctaaaagacaacaaatgcacttctaaatacctggttatgagctagggctattacaagattagagtatcatgaagatagaaccactaatcccgagaacacaaaccgccataacaagttttaccttgtcgtcggagatcaaactgatgcagcccaactcgaaagcaagaactcatcgaaagtaaacgaaagtgaaaggttggcgatgcgtcgaaagtgttattgaactgattgttactttgttacactggttttgggctacttttatacccaaaatacatgatatgcccttgtcggacacgactcctaactctattacaacttaggaaacaaacaagtccttaaggtggactcttaccgactcaaagtacaagaaaattatataaaatatcctaattaatagatacaaattaccttcttaggactcaatccgtgcgtggcaattgatatgaagcatatcaacccaatccgacaatgtttctatcgccatattgtcggaatcgacttcatcggctaccctgtccgacttaaactctaccaatgtagattgtagccgattcggaccccagccgatgtgtactctatttccgaaactgttaattccctttgattctgcttcggttttatctccaattccgatacttgatttaccaaatttggtcgttaacagtgtgacatgagttgccttgggagagtggatatgctccaagcatccaaggagcatattctccttagcttcatctctttgtgacatgtgtccagtgacggtttcttcagtttaaccggtcataaccgccttgggacaaggataactaccagctgatgaagaattgggctaattgggctagctactggttcggccgaaccaggccgaaccctggccaagcccaatcagcccacaactttgtaggtggacttcttgttgattcctcaatccactgatgtgaattattaggcttgtttactcgtgtgaattctgtattattagcccatctgtccacaagtttgcttctcgatggcttccgattgatcgttcgtttgctttccgtcgattctcctccatttatatgtgcttctcctgcatacatgttagtagcatagtacatagtggaaatagacattttaattggaatttatgcattgcaagcatagctagtcttcattaattgggtaatatggacggtcgaaattgttcgataacgactgtcaacagtgcctagtcctcactgtagccgatatgaatagagatgagcctgtgctatcggctgcagcttatttctagtccaatactttgaatgcttttttattcaaccaaggaccaataacatcaactctcctggatatagtcatgatcatggacttagacatcacatcatcggctaacccagttagtatgaataccaagggcaaattctcttacaaaactaggagcatcggaggttggactggcttcatcacccagaacatgggaactggttctgtaacccctaaggaacacacagcctttctaatgatgtggttggaaaagttcttgttctgtggtccaagttgtggccctactaccaactggcagcacatagccaaagcccttgtagacaagaagcaattccccttgggcaaatatctgctaggctcattgtatcaaactctgaattctgcatcggctaagattgctgtagattctgtcattggcactggtggcccttggtggcttttgcaagtatggctcaaccttcataccatcaaggtggctaaatgtcacaccccgaagttctcctcccaagcctaaatttaatttataaatgaccctaagaaaataccggtgcaaagcaagagtaaaccccttttaaatcaatgcaaataataatcggaattggcatgtggaatttttcttgagttctaaatgtcgaaattcactaacaggatttttagtggaattttcagagctcttgaaataattttaaccaattaaaatggagcaagcaatattttaattccagggaaaatccttttctccttttttatttttctttttccctccctttttcgaatgggccgctggcccatcctctcctttcctccccctcctccctgctgggccggccgcaggccgaggcccagccaagccgcccctccctcctctcccggggtcgcgacaggtggggcccacctgtcgggtccttccccaacctcccgccgctcccgccgcgccaccgcgcccacgtctccgcctcctccgggccacgtcgaccacgcccgcgcgtgcgccgcgttccccgcgcccactcccctctctctcccgttcgcgcccgcgcccgagatggccgggattcgattttcgaatcctgcctctctctcctcccccacttcccccacgttggccggcgaaatcccgcctctcccggccacgtccggccccctctctccctatttaagctctgccgtcgccccctctcgctttttccccatttcgccgaactctcccgagcctcccatcgctcccgcgccgtgcaacctcttgccgccgctgtttccgctactccggccgccgctagccgccgctaggctcgccgccgcaccgcgccgtcgccgccgtcgggttcgcgtggccgagatccaccccgtccacccctccttcgtcgaggtccgccgccggagcgccattcccatcgtgcgacggtgagggttgccatgtccgccgccttcggccgacattcccgtctcctatggcccctctcttcctctcttatctctttcctttcgttctttaggtcgtcccggtcgccgtccgccgcgtgtcgacttccctccatcgctcctcgtcgccggtcgccgccgtcccctccggtgaggactccctcccctttcctttccttccccgattccccgtgcgtcgccgccgctcgcgctcgccgtcgccttcggtcgttgccgccgtccgctgccgccgctttcgcatcgcttttgcgccgtcgcctccgccgccggatgccgtcgccggcaacgcgttcgcgcgcgtgtgctgtcgccgctagccctggccggccggtcggctttgatgccgagccgagcccggcggccgcctttatcgccgcccgtccaatcggcctgagggcgatctgggccgtcggtcccgtggaccggcggtggaccacctgcgtggtcccggtccacggtgaaccgcccccctgagccgctgaccagtgggccccgcttgccggcaccacacccccctccgtgctgacgtcagccctgggaattattgcgcaataaatgatttaaggtttttcttttatagtaataaacacagtgattcttctaaaattcataactaattcatccgagctccgtttaagcccattcaagtctcagtaaatcaagaaaaatgtgtagaatccattaaaaatggttttgttccctgtttcagtagtcttatagtctgtttgcaatgtttgccttgtatgtcgctagattccggttcccccgacgcttcggtgtacttcgaaatagtcgccgaggttcctccagcagcagagcaaggcaagtcatgcttgtcacttgaacatgttgatcctatattgcaaatgctctattgttttctttcaaatattgcattgttttataatgttactatgggatgtttacctattgtcatagccatgctattgttgtaccatgtccctttgtcagcttggggttataacatgactagagattggactagggattgcttagccatgcttagttcaactagttcacaaatggggaagatcctattaatgtttagactgtcggttctaatggtattgttggattagtgccaccgctttggtgttggttaattaaaataaatcacatggtgggctgtgggtgcatggttttgctggtcgcacccatggcagctaaggaccggttcgcgggatgccctggaagaacttatcgtacttactacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgctaatggtcctgtcacgacctctttccggtatgtcatggtggcatgtcagcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagtgtaatcttttgaatttggatagcttaggtggatggttgggcctgttgcaacatgggatagcgttggacagtggatagttaatattaattaattattacaactgtttaatctttcaacttctgtttataaatgctcactttatgcaaataaaccactttagctcttctttgatgattccctgcatcatgcctctattccagtatgacttgctgagtacagtgggtagtactcagtcttgctctaatttttcccaaccccagagcacgagtatgtgtcagatgaaggtttctccgaggagtaggcttcgtccgtgccgtcgaggatgcctgtggagtggtgttcccgctgcagttctagtcaaggcttagctcctgttgtctttctttctttccgctgcatttatgtaagactttcatgatgtttgtaagacgtggatctgaatgtcaacattgtcgtttgtgtaccccggccggtcctggacggggattttaatgcacattctgcttggaattctattcgcgaatttctgggcgtgacactaaaagaccaactttatctgaagccgatttcccatctatcaatgagccaactgtagttggcgagggtaatgagatcacaagccgtcgatgcatgtcttttggagaagcaacatctacctacaatggatcagagctgtcggctgaactcttcttaaattggtatggcaacttttatgatggatttccaaaggattccaaaatttggtttgcttatgaacatgctgaaaattttgaactcccagccaatttcagatttgatgagatcagccatgaaagatttgaaaaatccagagaagtatttacagctgccatatccccttgcatacttcctgtcggcatccaccaagacagaaatattcaagtttcatatgagttttaccatccgatgagcacggctagacaacttgaaataggtcagctatcaatcggcttatatttcgtggacaagatccagaccaggggagaaatcacatcagccctcatgatggatagactcctgaacatcccagggcccccactaggcagtatggataatattgtgctagccttgatgaggagttcaacttttaaccgatggtgggcagagtggaaaaaacatctttttcaccaatcagcttccatatacctgactaacatgttctgagagatggttccgcaagtaagtattcttccttttgtcaaattctttattgctaaccgatatctcttgatatttggccacttcaattgtttgcagaccacggaatcttcacctcctcatactagccaaagtggagaaaccatctgctatgtcgttattccaattttaagctcattcaacctaagtcattttgtgatttagaagtatcttctttaaaattcaatgaagaatacaattcttagtaattaaatccgattatttaccgcgaattaattacttatagagattacccaaaataatctataattatataaaattttgcaattctacaactaaaagaaatctacaactaaccccaattattttaattttctaaacctccttaatctctccctaatttcaatttacctttcctttttcttttttctctcttcatttctttctttttctctctttttctctctctcccggcttcttcttccctctcggccctctgcctacccgggcggcgacgacgaccgaacaaggggagggggcggcggcttaccgacgacggcggcggcgacggcggcggcgacggcggcgcaaggcggggtgacacatggcgcggcggcacgaagggcggcggcgcggtggagaggaagagaggagaaaagaggggaaaaggggctggggtggtgtgggatggaagggcgaccgggggggagggttatagcgcgcggggaggggcggccggcttaatggcgacgcgacggcgcggcacgtggggctcgagacgacggcgacgggcgagcggcgcgtgacgtgacaggcggggcgactcgacgcgcgcggcggcaaggggctcggcgcgatgggacgggcggcgcggcagtggcgcagggcgacagcgacgagacggccgcgcggcggggcgcaggcgcgaaggcgacgggcggcgatgcgacggcgcgcggcgcgcgggacgcgaggtggcgggcgcgcggcgcgaggcgtgacggcgacgggcgcgcggcgatgggacgtcgacggcgatggacagcgaaggcggctcggggcgcgaggccggctagggcggcgcagcaacgatggcgacggcgcgcggcgcggcagcggcgatgggacacgacggcgatggcgcgcggcgtagcagcggcgacgggacgcgacggcgacgggggcgtggcgctcggggcggctaggcgcacacggcagaggagggggcagggctagggaacctcatcgagcacctactgcacaatgaacagtgctagtcctatttatccctaatttagcctatttcctatataaatttcattctataaatcctaatttttgcacaaatggagtttactcaatatttgtgctattttaaccaaaagattcaccctagattaattttacccatattttatttttatataatttatttgaatttttaattagggccaattcttattccatcgcacttaaatttaattgttaccaatatggttgcgataatattttatttatttctatcctcacctaatctttatttaaaattatatttcaattatttattttgacaatttatttttagggtttattcctaattaattattccttactcacgattaatgaactccgaaatcaaatccaaataaaataggcgaataaaaccggcatgatgcaatttatttaaaaagtttttgaaggtccgtatttttagggttttgattttgttagtcgaattttcagcgtgttaaaataccggggatatataaagaagaatatttcattaattcagaaagtactacagaagagattacaaaagctgctagagccataccgaaactcttccgaagactccgagggactccaaatactattctatttctactccacttagcactaaactattaatactaaagtatgaagaggaaattgcttgcttgagtgtgtgttgaagtgaaatgagctcctctatttatagggccggtatgacggttattgaaaggtgagttgtcggttttgcccctgtaaccgtcattggggatgcatcctggacgtccttgtggagggccgagctgcgccgctgcagccagagttcggttcggccgaaccttggccggcccagcaggcctccaaccttggccagggcactgacaggtgggaccttatgacggttaagcagttaaaaccgtttcccgacggttacacctgacaagtgggccaccatcttatccatggcttgcttgggagtgagttttcctcatttcttttattgtatttggcaattcctgcaaaatgttattttccaagtacaagtggaaatacatattatttagaaataaaatgcattgtaagcatagctaattctccattattttagttaaattgatggtcgaactttgtcggtaacgaccatcaacagagaggattaggtgctaacatttccttggatcaaggcaagttctctcctcccaacctttgaacacattgaatcccatgatttgaggaatgaaaatatttgtttgcaaaagttgcatgtgaacctagactatatcggtatttaaaaatttgaatatggtagctatggccaagttgatgcattccctcctttgaataattgtgttccatgctgtttgtacccttagaaatggttagagtacatcccttgtgctcaaatgagtttatatatgctctatatgcaactacttgcttagccatgcttagaaataagcaaatgcttattccatctacacttcaaatgtgattttaaatatgtggatacttgctggaataaaatgaatgtgatgagtatttgtgaactaaaatgtgtaaaaatgtgattttgacttgggtagcaagtgttgttcatattgtgttagttgcataccgatagggggagtgtttgcccaagtccataaggaccgaacttgtatcaccaacttaaagtaacccgtacgtccacatgtgctagtatgggatggcctaagctaattaatctacttagcatcaagccttgcattctggtaggctagtgtgtatgggttcgaataactcagaggagcttcctatttgccccgacgtggtagtttaggtgactaagcctgttcaatacaacggtattgtgccacgtggtgggttcccatcgtgtccgccaccacggtgttaagtttaaggtgtgggcccaccatttaacggttctaagtattatttccagtatgcctaggatggaggaacacgtatcgtgctggtgcaaagctagatattaagtagtgtaaaggcttcattgtgtcctctagactgtactcaatgtgtagagtatagtggtgtcgacgggtaccggacaaactagagtgattcacatcatgtggataaagctgtacaaactttgcagagtctaaaattaatcgattagccgtgctcacggtcaagagcgatttggtgaagtgtcatgagtatagactctatgttttaaattgtgaacatgtgacatggtttggaaatgatgaaatgtgttgagtagtgtgagtgtggtgatataatgtgacttgttgtcatggatgacaagaagacttcgattatgatggaatttcgatgaactaaatgatgaaaattaaaacttgtttttgttagttgaactgtcaactcttttacaaaagatttgtgaaacaaaacttgctttatgctgaaaatgaactacaaattgccctcctttgaatatatgccttacatgtagtatgttaggattgatttgtgcttgtcagtacattaacttgtttaatgtactgactcttgctgcagatataatctttgcttgcaggtttagacttagcctttaagtgatgcgggttccgattgattcttctaggagttgaacttaatagggtatacccctagtcggtgtgcttgtggattggatagacaagcttccgctattcttatatttatttggccggtcagccattgtttctaatcatagatgtagatgtaattgctttcatctcttatttgtgtttgctatgtatatctatgcttgagatgaaagtgtgaatctagtgcacatcctggggattcacatgagtatgagttaagattatttaagttgttgtagatctttagtcatattgtcaagtctcctgaatgtgtaacacatctggtcgccgccttcgagtggtttgacgagaatatctcaggctgaagttgactggcaggctaaaggcccagcaatgtttcgaataatgttctctcgaggttttaagacgtttcattatgttcattgatgatttgaaatataatcacttcatctttcgaatataatggaaggtcaggacagcctacgacagcattggtatcagagcaagtaccgaccataggaaacccttaagttggtcgtttagaatggattcttaaaattattttgtgggctttgctctcagttacaaattatttgcgaaaaccatattcaaccttatatctcacccttctccagagattactttcccttatgtttctactttgaaattttgaaaattcttatcttgtctttaggatcgaaaccttttaaaagtttgcatctctataaaattgagtttgaaatcacctgttaatctcaactaatcagtcaaaatgtttcgaaaagctttgaaatctatttgcaaactactcctatgtactagcgcggatttgcaaaaaaaattctggaatttgtcaacagttgcattcaacattttgtgtagcccaaaccttaattgataaaatgtgcatcttttcacagtagattgcatatcatggcataaaaattcatatagtaatgcgcagtcccaatatgaaaacagtcggtaacccggttgaaaaatttgtgtagcccaaattataagtgataaaatcttggtttctttaaggtaacttacaatcttgcatacccatcaccccgatttttacccaaagttttgagccttcagaaccttactcaaatattagacgaagacagtaggccgacacattacagcactgcatcattcatccaaaacactgcccgtaagataaaccacctcaccaaaaatcaccatttcttcttgaaccatagacaaatttgttaggatgtcaaaggtaaaatttttcatagcttgtcaaccctaaaacgtagcctttagcttcagcttgcaacactaatctatgaaggactgcatctagcacaaaagttggtttacctcccatctatatgttttgttaataagacctagaacaaacctttattctattttaagggggatagtgtaccttgttcatgtaaacctagaaattaacatgaaaccatttaaaagtaataataggccaggagataaaatcttgaaattggtaaaatgggaatttaattctgactagctagccttaaagaaatggcaaagtatgtaaacacctaggttctttcactaatcctcgttctttatttgttcttgtagatgcctaccatgtatacgccattctactactgcagcgggttcacctggaaactcaacttagcacatgctctggcttatgctgcaatatgcccgtttcacctatccacttgagtaccacatagtactcaacaagtccattggtacctcccaaactgcagtcatggctcgcgtaagcattcggggtagaacacctttagaaagggatcgccaatacactggttatggttgggatagtaagtctgctatgcaaaactgtgcttatgttgctattacccaccttcgctgtgaattatctgagtgggaggaatgaagtcttgtgattttttctctggaagcttcactttctctattgccattctcacttacatatacatgggatgggccctcttcaatagatgggccagcacacaagccacacacacataactagtatatttacgagcccaacactccccctcaagatgggtgatagatatctatcatacccatcttgtcacatgaacaattacactctttaacacttaagccctttgttaaacaatcagcaacttgtccaccagacgttacaaatcctaattccaacactccctagtctagtttttccttgataaagaaacgatctatctccacatgctttgttctatcatattggactggattattagcaatgttaatagctgacttattatcacacaatagcttcatgggagtgttctccaaaattttcagctcaactagaagatttcttaaccacaacaactcacttaaactcactaccattgccctgtattctgcttcagcagttgagcgagacactacggattgtttcttgcttctccaagataccaagttgccaccaacataaacacaatagcctgaagttgaccttctatcatcaagacagctagcccaatctgcatcacaatacccttctatcttaagatgtccatttttcttaaaccataagcctttgcctggacttcccttcagatatctcaagattctatacaccgcctccatatgaccacttcttggatcatgcatatatcgactcaccatactgacagcatatgctatgtcaggtcgtgtatgacatagatatatcagtcttcccaccaatctttggtatcttttcctattcactggatctccagactccgcacataacttatgattttgatcaattggtgtagagactgggcgacatccaagcatacctgtttcactaagcaagtccaatacatattttcgctgtgaaataactatccctctaggagatcttgcaatttcaatacccagaaaatatctcaactggcctaggtccttgacctcaaattctttgcttagattccgtttcaacctagttatctccaagcaatcatttccagtgataaccatatcatcaacatagacagcaagaatggttatatgatctccactatgatgatagaaaactatatgatctccattacattgcttatagtccatagcacacattgcatgcctaaaccgatcaaaccatgctcttggtgactgtttaacaccatacaaagatttcttcaatctcaacacctttcctttagtttgtgaagtggcaaatccaggtgggacatccatatacacctcttcttgaagatctccatgtaagaatgcattcttgacatctaactgatgcaatggccaatcaaaattagctgcacaagatataagagttcttaccatgctcatctttgctactggtgcaaaagtttcatcataatcaattccatatgtttgactatatctcttagccaccaaccttactttgtatctttccacctttccatcaggattttgctttactgtataaacccacttacagttgacaattttcttcccttcaggaaatggtacaagatcccatgttttgttcttttcaggagcctctagttcatctagcatagcttgatgccacctgggatcttgctttgcttctctccaatcctttgggatttgcactgaatctagtgatgctacaaaggccttatatgtggatgacaaggagtcataggaaacatagtggatatattattttcatatcaccctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccaagggacatggaattcaaccaaccacaagcttttccttctttggttgttcatctccctttggacccaatatttcatctttcatttagtgaccatcatgaccactagttgaatcatcaagatcaatgaataaagaacttaaatctgtcttctcaccatagaatgggacagattctctaaaagtaacatccatacttacaaaggttcgtcgttctaatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccacaagaatttaggtacattcatagtatacatcaatgagcgggctgtctctaagagatgacggtttttcctctcagccaccccattttgtggaggagtatcaggacaagaagtttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtagaagccatcaatgcaagacatacatcttcacttgtcgcctttcgatccaaataccaaagtccatcacgcctgacgtcaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgcacccgagtcaagtatccaatttgaatgagaactattgatagacataaatgtttggtttgagttacctgaggaagaatgaacaagattggcaacatcaacatttgtagatccagaacaaccctcttcaagagtgaccacattagctctgtgatcacttctatactcatagcctctacctctattacctctacctgcataacctcttccacctcttgctccacccctatcaccaaatcttcctctcccataactaggcttgcgaggagcgcggcaatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaaggtaggaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaatagaacgctccccctgtctcaaaacacttatcttctcctgtgcctccaccattaacatcacatttccttctcctgagtagagattagtaagagttttccacatctcacttgcactagagatggtctcaacagttgtagcaatagcagggataagtgaggttaacaaccatgctactactaacgagttggtagtcctccaagtcttccattcaacacttgatatgttctcaggctcctttacctccccagtaacatatgcttctaacccctttgtcttcaaaatcaataaagctcttcttgaccaactcaaataattttttacaccctccaacttaatgtcattttgcatcaactcaattttttgcaccgattcagtatgaggaaccactgcactactcgtagttggagcctcattaaacttctttgtaagcatctctaccaatttacccattacttgttccagtccctgattttcccccattttaatcaagcaatacttgcagtagaaagttccttattctcaccttctataagttgtagcaactccagcaagcagcagctacacaggcaccaaatcctcccttttcctttcaacagcaacagcacaagcacctcacctcctctctgtctcctccctttttttcctttcaacagcacaagcacctccgtcgcacagctcttctctgtctcctctcacagcacaagtaccaaatccaagcagcagcaacagcgccaagcacactaccaacgcacagctcttctctgtctcctctcacagaacaagtaccaaatccaaacagcagcaacagcacaagtacactaccaaatccaagcagcagcaacagcacaagcacacttactcactccttccttcacaagcacaagcacacctagcactgcagccctgctccctccttcacaccggccgcgctgcagcagccgtcgccgtctccggcgtcgacgtggcctctccgcctcaaccgtcgacgctgccgctccacctcagcagtcgacgggtgcagcactcctccgctcacagcgccgccgctacacgtcctccccaacaccagcgtctccctcctcgacgagctccggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacagataactagtctatttacagcccaacaaggaattctatacctaccttccatctttagttgagggggctgaacacactacctacccagggctgaatgagataggcataggtctgcacaccccacacctccagctagcaggctttgttcgtgcgctagatatgctttatcgctccacctttgctgagctgcaacgcgtccgcacaagggtagcaactttagaaaggagtatcttgcctaggttttgccagggataccatactccggagttcatgtatggagaagatgctatgcttgctccagcgaggacatacctccacccgtcgggaattacttcgagagaactctacccccccccctccacgttgacgttgttgttatttcttacgatcacagataaatccgcaaacgcacggaatataccgatgtagcacttcacccgggagtattctcatgtatcgatttccacagggaacatgtgtgctatctccggttcaggttcaaccaaggacacgaagctataaataggcaaaggatagagaggtttctccaatgaagaacaatgtccaaggaaatgttagctttaatcataatgcggtacttcgggcactggccagctcgctgctcccagatatcgctctactgcgcacccggacagggaggacttcagtgatcttgaaatgttagctttaatcataatgcggtacttcgggcactagccagctcgctgctcccagatatcgctctactgcgcatccggacagggaggactttagtgatcttgagggctatcatcacctctacacacacctcacacctactgtgggatgcggagaaaacactctgcgtctaagcagattaattacttactttaacgctagctacacactaaagcaaatcactatattttaattgagtataatgaatgatgatcccgtactctaattaggaaataacaagaaataattctcaccgaacaaaactatattactcaaaagatatttctattatagccagagtaataagcagagcagaaagtaaagggacaggattaccgacaactccggaagtcctccaacttcttctactttattctcttcctattctaagtatacaatatagtacaatagagtctcttataattcagctcaagcttagagtatgtgagtgaagtgaagagcagtttacaatttcacatactaaatcgaagagcagtttagtttcgtcacaaccagttttgggcttatgtacatcaccaaactgacaacagcgcatcatagccaacttgaaaatctacgtaagcttgtagcatatattacaaataaaacatgaaatgggttttaaaacttcacatgaaccacacgttttgttctttttatttacgggaaagtgttgcctgaaattctgaaatcacaagcgatgccagcatagcacggtaaaaaaccctaaccactaagtattgcacaagctttaaaatgtaacatcaccttctgcaagcagaaaacctgaaaaggctgaatcttgcttagagattcatgagaaacaatcaattgttttgctttttgcaaggcttgtatctgaacaattcatatcaacactgcaaaatacaaccaaaaattgatgtccttctcacagtgaggatttcaaccagcagcagcactagcccagcagcaggaggccagaacggtagcagcagcagcaaaacggcagaacaaaaagtccagaaatcccaggctcaactgaatttccaatacatcatactattttcagcaggctctggacatgcacaaaaatgacaacggctagtgcatctaaacgaactaagttactgaaataaaaactacagggaacaaaactagtggtagcagcattcgcagctgctgaaggccatctcatccctacagaagaaaatcaggcgatcaataattcaaaatcggttagttgatcaattcgtttgtatataatcatcacttgaacctagccctcatagttttaatgaagcaaataagtaatttaataattaattcacttgccttgcagttagaatataacattccagaaaggaaaatttcattgagttttgcccccaccaccagagcacgctcctgcattacttcctgtgtattaagaagcaaatgttgaataaattgtaaattattattagatcatcatagtacccatattcaattagacatccagaaatataaaatcaagtaatttgaatacctaatagttgcatattaacatcatcgtcctcaaccgtatcagttagaattgaatagggatcaccaaaacctaaaacatcagaattccaaagttcaacataaataagtttatggcccataatataagtagcaatgaacaaggtaggctccataccatctgctcgcatctaatcttgaaggcaaaccaatgcctccacagttccattagccagcctactcctatagtcactaatgattctagatccagtagaaaatgcagaatctgatgcaactgaagatgcagggacagcaagcaaatcaagcgccatgcgtgataatattggatatttgcatgagtttaccctccaccactggagtatgtcaaaatcatcatcagggaaatcattttcttgaggaatatcttcgagatagctagttaactcagtctttctttactcttgctttgatcatgaagatattgcctccagtcagcaaattggctgccaccaacattcactccactagttgatgcttcttgagaattgattgcgcttggaccaccaatttgtgaagaatattcaacaaaccaactgcggactatcctcttaattctagacagatatccatttggaccagttgccttatctccaaaacctgctttcagcctaaactcaaggaatttcaacttaaatctgggataaaaaataacaggaacacaaatctgcaggaactgcagatcccaatatttctgaaattttgtatccattttaaaaaccatgctagcgacaagaacatcctcactgttggactcatttagaagcatcaccttcactttccaaaattcatgaaagtagcgagaaacagtgggatatgatgtcccggaaaccacaacagttgcatcatagaagatcttgagatgtttgcaaagaacttctgcattgtcccaatcaaaaaatagtggagcatcttgaaagtttggatcaaaccgatccaatgaatcaaaagccctcctgaataataaggatgaggaaagcatcaaataggtggaattccaacgagtggacacatcaagtgaaggacgcttctcttcaacaattccgacttgtgcaatgatttcttcaaatttttgctcacatgcttctgatgcttttatatactttacactttcccttatcctagatatggcaccactgacagtactcaatccatcttgaacaataagattaaggatgtgagctgcgcaccggaaatgaaatagctcccctttgcaagacatggcaagcttacccaagagatttcctttcaattccacaaccatagaatcattaacagatgcattgtctactgtaatactgaacaacttactttctatctgccaatcctgaatacactttagaatttcattgaagagagctatactatcatgtgggtacgcacttgagtgaatcttatgatcctcttttgaatattccattcattgtcaatgaagtgacaagttatacacatgtaacctaggttttgattagatgaccacatgtcagccgccagtgaaacccgagaatttgttttcctcagtacctcaaacaaagctaacttttgttcttgataggcagccaagcaatcaccctttatagtaattctggaaagcaccctaaagtacgggttcaagcttgcacaaaatcttctaaaaccagggtgttcaacaaaactgaaaggaagttcttgcaaaacaagcatccttaaaagttctgcacgtgctacatcaggatcaaatttccagtcctttagaacagatgcattaggagatagactggaatgcaaactttcaaccaattgttgcactctaattctcagtggacacttaagtaaatgtctatggcattgacttgtccccgaaccacggttagctttaattaccttactgcaatgaatgcatttcccatagagcacctttccagtagaagaataaaatggtttaaattctttccagattaaagatttgagtgttcttttccctgaatcattaaatcatatctaaaattaatctattgagcacaaacaagaacaggatttgtgctgggactgaactaaaagtttctgctaaaattatactaaaaatttgagctgaaactgaactaagagttgtactgaaactgaactagaaacttatgctgaaaccttaactgaactaaaatgtgttctgaaactgagataaaaatttctgctgaaactgagatgaaaattttcttatgaaactgaaccctaattttctgttgaaactgaactaaaaatctctacagaaactgaactaaacttctactagtaaagattcctgatgaaagtgaactaaaaacttctgctgaaactgaattatcttagctacatgaataaacaggggctaaatgaccaaatctccaaattcagaattagaattgcaggtgcacaaacctactaaaactaaccacagaatgtaagtttaatttgtttgggtggaagataaactacagaattatatatgcaatacatcaagagtaaagaactaaccagaacgatgagtcacaacatgaggtgttgattgagttgactcccttggctgagtttcaacatccagctcaattgggatagcagacggacttgatacgaaccttgccactggagacatagatctagctcttggagactctgcacttggggacatctgaccagcaacttgtgatctctccatgatgacttcattttgggaaataatttgtcgcactcctggagacctgactattggcaatgcaataggtgatcgtcttcgctttgctgttggaggattcgatgctgctaactttcgttttgtagccaataactgtgttgacgatgataggcctcccgaagagccctctgcaatgacctctttgatatgtcctccttgcggaacttcagctaatgatgtcgacatgggagaaaaccaaagtactgcatgtagaacaagatggacaaaattttaaataataaattaccaaaatacttgcataatatatgaacctcagcccatccactcggaaatcaaaaacttcatgacaaactagaatgtgccaaactgaagaccgattataaactaaaagatatgccaaactgtgcgctagtactccctccgtcccaaattataaggccaatatttttttacacggtcttcaatgacatactttgaccattaatttattttatgttatgttcccaacaaatatgaaattagcttcacataaaagtactttaaaagatgaatcttgtaatataacatgcataatacttaacatatatatggttagtacgattattagtcaaaagttaccgagtttgattttccttaaaaagatggcgccctataatttgggacggagggagtaatatttaggacttcacaaaactgaaccgtgcaagcatatatgactacaaaactgaattcattcttcacagactaatgcaatgagtaagaaccaaaaattaacataaccaatagtctcaactcctcaagataaaatcatgtaacatttgcagccaaaacactaatcaaaacacaagaaaaggcaaagactgatacgctctgttaaagctagcagcttgaaatgagatacagatacacgacagcttcagtagcaatcaacttggattgctcatatattctatatatgcctgcggtgtcaaaaaaccatgtagcagtgaaatccaagctttatttctcccagttgcaaatattgcaatcctaaactttagggtacgaagaacaggattaaggatcttttagtttgtaaactgtgtgctatatatctaccaatcatggggacagagatacacatctgtgcatgttcttgaccaggcaccaaaccaagcggatcggataatatccatgagaaatcaaaccaaaaacaaacaagtggattggattgttgccacgagagaatcacacctaaaagttggagatacaaatctcaactatacaaatcacacctaaaatgaagaggcaagaactcacctgagccgagagaggggatagacgaggcgtgccggcgccgcggcggcggaggacgacgagcaaggcagcggcggaggacggcgagcgagcgagcgaggcggcggcagagatggcgagccgctcgatctcgtgtgtggaaacggcgacctagggttggggacatgcagacgagaaatttcagaatattccatccgattcgtagcacgttcaggattaaccatccaattcgcatgtctttcagaatccaccatcacaagagctaatttcttcatttcacgccactccgtccatccgaagcagcaccgtctatccatcagttgccgcgtcctccgtccctcgccattcctcgtcgtcacctccagctccggtcagccaacctcgtcgcacacccgtggtcctgccacataagaggggacggttcctggtgcacatgtcggaggagctcagctatcgccgcgcaggatcgccgccaccgtgtggaccacgcgactagtgcgctatgtcggacgagctctcagtgaggctgagcttgtggatgaccaatagaattgcttcactaatagagcttgtggcagttggggatgacggccgagcatggggatgggcggacggcaccaatggcgatggcggtggacgaactcgggtacgatctagcgacgacggcggacgagctgtcagatcccggggtcaaatgtcaccaaaaatctgcagattcgagcaaatttgggctaagtagctacctaataggattcctaagacagaaattaagctaagaaaattaaaggatgccgcaagataagcaagtaggaactagagtttatatttcttgatccccttttcatccacccagatcgccttttatggagtacggcatctgagtgaggaggctggacaactcagtaggctgtgattacattaagttttggagttttaggacaaagcagtacagacacagtaattactgaaatgaaacagctccctcagatttacatcattgaactggtatcttagcatctgggctgcccattcccgcaactcctatttctctttctgataaacaacttcttcagataagcagggcctgacaatgcctcccccattaagacccaggtcctcatgggttaaaccagggaaaagtcttggatataaaggatgcatcctcccaggtagcagcttctattggtagattctcccaaagtatcttccactgcacaactggagcattgtgtcgagggatcagtcgccgctccaaaacagcaagaggggctgttaatatgttgccatcagaatcaatcagaggaagcccaggttctggaactgccttaggaccaatatggtgtttaagttgactgacatgaaacataggatgtatttgaaaatttggagggagcaataatttataagccacggagccaattttgttcagcactcgaaatggaccataatagcaagagtaaagcttgagagaactatgcaatccaagagcattgtggcgatagggttgcatctttaagtaagccatatcaccaacttgaaatgtcctttcagaacgtttagtatcagcatattgtttcatacgagattgagctttgtccaagcttgccttaacagagtccagcaaagctgcttttgcttgcttcctgtttctgcatccagttaacagtgacgcaggtaaaagagcttcaccaaccataggtggttgctgtccataaagtgcttgataaggagtcatattcagagatgtatggaaattagtattgtaccaccattcagcttgatctagcagagaatgccacttctttggtcgagagaaagtgagacagcgcaagtatgtttccaggcattggttcactcgctcagactgaccatctgactgagggtgatgggttgtgctcaagtgcaactttactccagcatcctcaaagagcttcttccaaacatgtgaagtgaagattctatcacgatcactaactatcacagagggtaatccatggagtcaataaaaatgagtcttaaacaggtcgaccatatgctcggaagtgaaggggtggctcaaagcaacaaagtgagcgtatttagtaatctgtcaacgatcacccatatgacgtccttgttgtcagatttagggagaccctcaatgaaatccatggtaatatgtgtccaggccgtttcaggcaatggaagtggttgcaacaaaccaggaggtaatttgttttcaaacttattcttttggcaggtagggcattctttaacaagggtggcaatgtctgatttcattccaggccagtaaaaaaggagcttgaggcactgataagtagctcgttctccagaatgtccacccaaaggagaagaatgaaatgactctttcaattgttgctgaagaagattggtatccttgcccacatatatcatgtccttataccgcaagattccactgtgcagtgtaaagggaggtcgtgcagtaggatgaatgcttaacttggttatcaatgatttacatttagggtcagctggataagtggccaaaacttgagtgatccattctggaacaatcactattatagcttggagagtctcttgctgtggggctcgagagagggcatcagctgccttgttttctttcccttttttgtactctatcttgtaatcaaaactcatcaatttgatcaataatttgtgttgggtgccatctgtaattttctgttcattaatgtatttgagactggcttgatcagttttgatcagtaaagaggaagccaagaagtaatgcttccacttcttgagtgcttctaatattgcaatggcctctttatcataagtggaaaatccagccgcttttgggcccaaagatttgcttaagtaagcgagaggacggccttgctgcataaggactgccccaatcccatagccactagcatccgtctccaaaatgaaatgaagggaaaagttaggtagtgccaacacaggtgcttgagacaatttatccttaattgtctgaaaggcaagttgctgatcagtctcccattggaactcatttttcttaagagcattgaaaaggggtctgcagataattccaaaatccttgataaatctcctataatatccagccaaaccaagaaagccacgtcgttgagtgacattaaggggtgaaggccactgctgaactgcaactatcttggcaggatcagttgctactccttgttcagaaattatataacccaaatattccacatgttgttggccaaatgtgcacttagagggcttagcaaagaggttgtattttctgagtaactgaaggacgagctggacatgatgagcatggtcctcaatggactgactgaaaatcaggatatcatcaaagaagaccaagacgaatttcctgagataaggactcaatatccggttcataagagcttggaatgtgggtggagcattggtcaaacc

SEQ ID NO: 73659 - DNA, 5724 bp, Oryza sativa
taagcagcagtttccagcccatttaggaatgggctgtgatcaactgcctgctaggactaatgtacttaggtgatcagtccattttacaacatgtggcaaaagctattgttttgtgaacttgggagcttttagtaatgaatacatgcttgacatatattcatcaattgtggttgctcaggatatacccttgtggtctaccacagtaagtgttcctatgtaattatttgtgtggtttgcttagtttgcatatgtctttgcatcatgtgctctctgatctatatgattattatttcctgaaaaatttaacaagtaccgtagcaccagaagttctctttatgaatgcatggagatgttattttggttatcgaagatttggttgggattattttatacttttattgtttatttggggttggtttagttctgaactaaatcgtacacaaatcttattttgtaggatattttgaaccacatgtcagatattcttttaagactatattttgatgaaaataaataaaaggaagcatgccaaaacagcatgagggtgtatagtaatctggtagtaataaactattattggattttcacaggaggaaatttggattgtcgtaaatgttcagatatgctattttatctgggaagaaataaagttctgcttgagttgtgctttaaccagaaggaatttgtagttgtaaatttaaaaaaccaaaatcaggggcgggctatccattcaggcttacctggatttctttgccctctgggacctactttcctcgatacagcttgagcccgcggtggctgacgcggcggtctggtggccggcgaagaacggaaccttctccgtcaagtcagcctactcgttgctatccgctggtcgtactcgatgtttgctgggcaagattatttggaagtcacgcgcaccggaatgctgcaaattctttatgttctgcgccatgaagaatgcctgccttacggctgataatttgcaacggcgtggatggcatctggctccaatctgccatctttgctccaaagatatcgaatcttgcacccacatcttccttaactgcgccttctcccatgaagtttgggggctagttaggggcaggattggcctccttcatgcagtgccagatgatgacttgcccacttggtggtgtgccgcgcgcaaggtggttaccaagaaggagaggaaaacctttgacgcgggcgtgattttggtgacttggctgatctggaaggaacggaacgctcgcgtgttcgatggccgagcctcgtcaccggcctgcctattcgcgacgatcaaggatgaatgggaaatgtggctggcggcgggtttgatccctcctccgtgagaaggcttgttgtagctctgttgggagaggttttttgtgtgtttgctccccatctcctttgagcgacggctttttctgcctctcttagggatgtggtcctgcttgtaacaaataatgtacattctttgctctatcttaatatacttcggccggcatctttgccggcccggtgaaaaaaaaccaacaaaagtttaatgtcttcaaattctgaaaaatactatccaacgactgtaaaatgcatattgttttgtggatggattgtcctacaatgggtaaaccaaactatttttgtgaatctgtggtctataactcccttctttcatgtttatatgttaaaaggagttgcatccagcttacaattttccttgttattgcttatgctattacattaccttttgcagcatctcatctatattattgcaggaattatatgcaaagttaaacgtcatgcgagcactgtggcatatatgttaatttgttagtaggggaaaggtttgctacattcctactgatgcggtttacagaaacagtcatactgtgtctgtcagaggaccagagattttgggaagagattgaagagggaccaagggctatgggtccccttggactttcagcaggtgagctcctctttttcttcttctgatcttatgacaccaactatcattcttattattttcaccttcctttacagttctacctggatatgcaatttgtgattcttttcgggcaaggccgtctcttatctccggtctccgcacatacatcaagtaatactgaaaatcgttgatagagtgatggcggcattttctgttactggaatgaaccctgataggttatattatactttcaaggttaataaaccttttcgacccaactgttttcagtacaaagtgctgtaatgtttatgcactttgtgctgcaatagcaagcaggagcatatgcatgtgttttgctccatttgttacacttctattatagatttttcacatgtcagaaattggatgatgtaggatatattaattatgaaattcctggttttgtctaaaaatgtcgctggcctttaaaccgaagacgatgatgaggaacacccgcttattcctggttttttgtctaaattggatgcgtccttccaagcaaacaattgccgaaaaaacacgttgtggtcgataatgttgccaagcaacatacaaccatctctgcacagggtaatcgcaaaagcaaacatgctgatgtggtaatgccagttatcaatgtatttgatgtagtaggtacatgtgttgggtttgaatgtttctcttacaaacaattaatacagtgatgcaatacttgttacaacagcctctaaactttcaatcttctacattacaacacagccttacacccttgtgttgcatattgcaatggcaggaaaaagaatagccagatatgagcttacaggcaaacagaaattaccaagtggagtacaatttcaacggcacaaaagttaacaccaataatatatatttcagtgtacgaacactagatcgatccatgttcattacacacaggactgccaacacattaagcaataaacaaacaagtttcgtgggaattcgggaaaacatgccccattttacagcctataacaaagatacttcgctagagatgtatgcgccacatataattcacccagagtttcacatactatcaccataaaatatttccaaatctcccaatacgctcccacattttccgattgtagtgttctatgattccaatccacctaaccttcacttgcagcacataagggcctttcttccgagtacattcttcattacgatgccctagaacaaacttaaaacatgcaacttcactgccaccctcaaacacacaaactttgagcaccagcttgtgtttacacacgacagctactatattacgagttaatgtaacacgtccatcattcctaacagttgtctctgtcccttccactctactgtcatataagatgatctcattttcaacattcccagtagtccaagcacttactgtaccggtgaaatttgacagcccctccaagaaattgacagcaagggtagcttgcacagcataaggaacaggtgtatagataaacgccactctactcatgaaactttctagttctaaagtcttgagtggcttttcataagcgacggcatcatgttctatgaaacctttgctgaaatctttgtcagtagccccatcccccttaatcttcaaattgaactcaaaatacatggatcctttggtagcaagccctctctttgggcctgtaagagttagtgtatcctcctgcacgtacatcgatttaatgaaaagcatgtcacttataattcagacgatgtcaagaatataatgtgttcgagaagaggaacgaatcggatacagaccggcgaggtgctgagttggggatggtcctatcacgcctgaacaaatagacacatctgtagtcctgcttatccctcgccagcacagttccaaagatgctgatggggtaacctgaatcagactcggtgaccttgattgcaatgacattaacagagccttccaacatcacaaacttggaggaagggatagtgcgaatcggagacccaggactaatttttgctgcaaaaatagggccagaaacagaaatcaaacaagaacattattattactacacatgacatcgatctagagactcaacagatagggaggaagaagtttttacaagtatatattgcttgaatttacatgtattcataggaataaacggatcgagaactaattagacaagtgaatgaaatgatacgtgcaaatttagaaatttagaataagtgaaaggatactcacactctttgtcgtggtcaaagaatgccatgttgcagaaacagaaactgacccgggtaggggtaaattcttttaacttggggtcgtattcagttaactgatagcggcgaacgatgtcaagaacgctcaccaccttctcctcccatgtcaactcctgtccaaaatccaggaacttcttcttcacctttcccacctgctgctgctttttcagagttggctgctgcttctcctccttcccagcagccataccacctccatgctcctcctccttctccatggtgaccttcttggttagttcacccatcttgccaatgctgtcatcgccacagctataaattcagaagagaagcaaaaattgcaatatttagatttgttcttttatgcatcgcataccaagaggaagaggggatcgatcgaggaggcgagcgtaccgtacgtggtgcgagtgcgatctcctcgaaccctagcacgccgcaaccgagaagtcgatcgatcgccgccgctgcggtgaaaggggttttctttatataggcccatcaggttaagtcttttccaaagaaaaaggcccatcaggtaacctactcttccggtctgtttggttggagagagtttttaggagggattaggagtttagagggatgagtctattaactgttttgtttggttgggggacatgggaattttggtgggatggggatggggatggggaattgaggaatgaattccctccttttcaatacctgggtaggggcaggtaattaggagggaattcctcctttacttcgtctaaacaaatctcagccatccattttcattaatgatctaatcaccaactaaactccctatcaatttccaccacctctaccaaacaagagactgggatgaaaaatcaaattcccatcttaatctcaccattaattccttggtgtaaactcccaattcccttccctcaagttgccaaacaagccgttcgtcctcaccaaacaaaccctagcctcttcataatcggggaaacagaaagagaaaaccctaaggctctctcccctccggcggcgacggggcgatcagggctgccagcgaacacgtctacggtacactcctcgatcgcctcgattctctcttccgattcgacgaaatcgcattgtatgggcacctaatctcacctgtgtccctttctttccgtgttcttcttctgcatgagcgtcaagatgcggacgaaagcgagaggggcggtatggtaatcgacgacgtcggcggcggcggactgaatcttgcaattgttgcaggcaagcgtaagcgggagatcacatgggaagagaaggcggcgttgacagttcttgatattcctgccgagcgtgattgcagcctcatagactcggagaaagattactcatgtgagtgtatatataatccacaactaatcgatcgatcattcatcattcatgtacatctgttctgctttgttcactcgtttgcatcagtcagtatatccctcttaattggtacttcctccgttttatat

SEQ ID NO: 73660 - DNA, 11098 bp, Oryza sativa
tggcaatccgacccccacctcaactggtcaacagggagcctccaataattccctatttatgttgagatattcctcgcttaaatcctgaggtggtattattatccttaacacttattatgggcctttgagatttaataggataagttgggcctaacccaattattctaacaatccccaccaaatttcaaggctcataagaaatgttctcaatgttgtgcctgtttgatataccagggttttggtggagactgttaagttgaacttccacctaagaaatgagctacatcagaccacaactgaacaatggactatgccttgaattgtcagttttgtgttatcaagtttcactcagaaccttgactggtactgggctgccgttcgcatcccctctgtttggagcatataagtcaaactccaggcctttcataaatatctagagattgtccaaacctcatagactgtgactagcagtcgaactcatataggtgtgttccttctaagatgttctgcaggtcaacatctctgcttggaaaagccactcggatcacattaaggcatgagccatcctaccatgcaggaaagaagagaagcacattatgaaaatgagcccttttcaagggtctcttctctcagtcacacaatagtttgtttcgctatccaaattcacgggatctccgatcacaatggacaggtttccactattatgcaaccttaggtgggtatcaagcccatttccctcgatgcactgtctatcacattatgtggtagccccttggtaaactgatctgctagatttctagccgtttggacatagtccaatgctatcactccggagtttttctgctttctgacagacttcagtcttcttttaacatgcctgaatgacttcatgttgtccttcgaactgttcactttaataatcactgtttgattatcacagttcatcaggattgctggtactggtttttcaaccaccggcaagtccatcaggagctcacgaagccattcggcctcaattgtcgcagtatctactgctgtaagttctgcttccattgttgacctcgttaagatggtctgcttgcaagacttctaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttctagagcctgccaatgatcatctcccggatttgagacaaaccggctcagcttgcttacagcaaatgagatgttaggcctcgttgcgctagccaagtacatcaatgaaccaatgatttgagagtatctcagttgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggctggtcccaaagatcaatatgtcatcgacatataagcataagatcaccccttctcccccaccatagcgatagtatacacatttgtcagcttcgttcacaacaaagcctgcagatgtaagcgtggtgtcaaacttctcatgccattgcttaggtgcgtgcttgaggccatacaaggatttcaatagtttacacaccattccctcctgaccttatagtacatacccgtctggttgatccatatagatctcctcctctagctctccgtttaggaaagctgtcttaacgtccatctgatggacgagaagaccaagagaggctgccagagcaagtagtactcgaatcgtgtcaagcgagcacctggtgagtatgtgtcgaagaagtcctcgcctccttttgggtatacacttgcctggagcccttgccttgtacttttcgattgtaccatcaggcctaagctttttcttgagaacccatttgcatcctacgggcttgcacccatatggacgctcaacgacttcccaagtaccattagacataatcgagtccatttcactgcgtactgcttccttccagtagtcagcgtcaggagatgaatatgtctcttctatggttcttggggtgtcatccacgaggtatacaatgtagtcatctccaaaggattttgcaaccctttgtctcttactcttgcgagtatctacaatgttgtcctcctcaggattttccttaggcgtttgatcattgtgttctatcggtgccaagtgctcatggggcatgacagtttctttactagaagtgctaggtgtatgtttcataggaaattcattctcaaagaatgtagcacctctggactcaagaattgtaccaacatgcatgtcaggtactccagagtttactattaagaatctataaaccacactgtggatagcataaccaaggaacacacaatcaacagtatttggtccaaatttccactttttggctataggtacatttaccttggccaaacagccccatgtttgtaggtatgagagatttaatttcttcctttcccattcctcgaatggtgttacttcctttcattggaattttattcaggacatgatacgcattcaaaactgcctcaccccaccattccttggaaagccctgcagtgtctaacatagcattcaccccatctcagttagagtacggttctttctttcggccaccccatttgattggggtgaatagggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatacaatgcctcatcctttgttttcaatagatacacatagcaaaatctagtgcaattatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacgcaagtatggcacttggaacctttgaccaaagtgaattttggaattaaactcaggttagctaagcgcgtcatacaaccgaaattcacatgacagagtcgcgaatgccacacattagactaatcattctcgctaatatggttcacagcattatgattattacacatgtcattcaaagaaaagcggaacaagcctccgctatcataacattttccaacaaaagtcccatatttaggtacgacacatttattggacttaaacacaagtctaaaaccttctctacacaatagagagccgctaactagattcttctttattgaagggacatgctgcacgttcttcagctgcacggtctttcccgaagtaaactttagatcgaccataccaacaccatgaacagccgcaagcgacccgtttcccatcaacaaggaggaacctctcccgacctggtaagaagaaaacagagaaatgtcagcacatacatgaatattagcaccagtgtccacccaccaatcaggtgaatgaaaaacagagagaactgtagataatattttaccgtaccccgatgttcctccgccctcgctaatgaccatgttggcagactttctgtctttgcgctcaggacagtccttggcccaatgcccagacttgtcacacacaaagcagtctacctttgcctttcccttgtctttcttcttaaaattggttgtagccttggatttgacatcaggcttaactttcttgttatcgtgggatgcatgagggttcttcttctgtaccatattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggtagtttggcaataatgccacccgccacaaacttgtccggcaactcacagttgttgttctcaagttccttaaccagcatctgaatctcatgagcttgttctactacagaacggtcatcgaccatcttgtagtcatagaactgctccatgacatatagctcactgtcggcgtcagaaactccgaacttggcctcaagagcatcccacatgtccttcccagaaggcatgtgcatgtatacgtccactatgttgtcagcgagtacactgatcaatgttccacggaacaggcaatctgaagcctcgaacttagcctcttcctcaggagaaagaggtggttcacttcgtttgccccgtgaaacatagaagcactgcatcgctgtcaaccacaatagtgcacgtgctttccatcttttatagtttgaaccatcaaaagcatgtggtttcagtgcagcagcaaagccaactaccgaaaatgacctatcaagtttttggattgttggaaatatagtcattaatcggcatattttaatccaaaatgttaaagcaataatcatggcataagcagtgtagggcgatcttaacataaccagtagcatactatgcgcatcatgaatgtcaggaacaggaacataacagtaacgcatagaggcatcatgaagaacaggaacaagaacatagcgcacatagtatagcgatagcgctaataatggaacaggaatagcgctaacaatgggaacaggaggagaagattataccccgagaatggccctctgctggatggtgaggcagaattgcctccgttgttgttgtcgttcacggcacctcctcctggcgcactagctccggctcctgttggcggcgcaccacctccgccatctcctccagcagcggcggcaactccagacatcgcgatgagcagtcgtgtgggaggcactccccaaaaacctgatcacccgcctacccggtgcagatctcaggcgaaggtgtggtttcggaggcactgctccttccaatctctcgtgcgcgcaagagatcagaagcgaggaagcgagagcaactcaggcggagaaggagaaaccaacaccggaaaagaagcgatgaaaacggatcgcactcgcggcctccttatctatcaggagaaagaacgtggatgcgctgttgcggagggaatcgtgggaacgtgggttagtggctgcaaaaggatagcgacgtgacgtgacgtgacgcatgcacgcagccagccacgccacgcctcgcctcgcccagcccacgcccacggcctcggcccggcgcgcgcgtgtggcaatccgacccccacctcaactggtcaacagggagcctccaataactccctatttaggttgagatattcctcgcttaaatcctgaggtggtattattatccttaacacttattatgggcctttgagatttaataggataagttgggcatagcccaattattctaacatcttcaacttccacataaccttatttttcactatataaccattgtttagcaaggctaaatacataaaatggacccaaaaaatactattgtgatgaagattttatctaaatgtctttatgatcatttagattagtatgcacaatcttaacatgccaaagaactagatagatttttatatatcattgacaatcttacccagttatcccagaagagaaacattattgaccgttattatatcaaaaagtttggggtctgactcaactgtagtaagggatgagaacggtataaaagcccccgaccgtatcgaccatcaattccgttttatacggactgtttaatttgtttctgcggactgtttaattttggattgcccggaagtgaaaaggtaacgatgtataggtgtttttctgaccgttttaacggtataccattttgtggaatttccggagaaattactgtataaaatcgataacccatcaagatatacaaagaattaactataaatcttgtgtgttctaattgtcgatgcattaaggatttagatcccatcctaaaattttatacaatgtcacatcgaatgtttaaacacctgtataaagtattaaaataactagttgcacaaattgtgactaatttgtgagacaaatattttaagcctaattgctacattgtcacggttatggataccacatacctaatagcagttgactagatcttggcaggacccaccacataccatgtcttgtatggacattgacctcagatatggatgaagttccggataagaaaagacaaccagagttctacatggaaacgataaggactacttagattgtatccatattggtctccctagttctacttggacaaggggacacatatgggtataaatacaagaccccctaggaggagaggggagacggacaatatagacgccacaaagccacaagccaatacaagccaacatacgccaagacaagtcgccggatatcgacatcagagatatgcctggattgaccctatccggtacctacagaggccggccatagggatctagtgctatctctgatctcgtcgggcactgattcgaggaggaagactaccctgttgtcgactacgtgatgatacttcagtcccgctatgtcgacaacagttagataggctaccccaaatattggactggtgtgattatggtgaataagaacaataccggcttcggtcaacgggatgtagggttattacttgccaatttaggggccagaacttgtataaaaatcactgtctccatctcttttacctcagtcttgcgtatatcctagtaccaacgatccctataccatgcaaataccggaatcgcgacatcaaacgtcgacatacataatttaataatgtggtgctacagtaaacatttgctaatggcgtgttaattaggcttaataaattggtatcgcggtttactgacggattatgtaattatttttttattagtgcccgaacatcccacgcgacaccctatataatatccgatgtgacacgccaaaactttacacccctaatatcgttaggattaggatgtattcaaatatcgttgtttccgaggctctattccgataattccgtttctggtattttaagatgttttgatagtattgatatcgttatggtctctgactctaccacacccatttcgttttgaagaaaaaaagagtaaataaatgttttgagcgtttttccggcatttttcgccgcaagttatactgcgatatgataaaattttgggaatggtttagctagatacgtggtgaagactgaagcgaagtgcccgggttgaattagactagacaagtagacagcctacgtcacgtactagcagtagtgtgcttatttattattactccccttgtttaaactaatgacgttagtctaactactgtacattaaataatcatcatgcataagacccaggttacgtattcgttcatgcattgcaaacttttgctcagtcgacataagtgaagattcttttttgaacaagcacattctccacggaggtaataaagattaactaccacgagttggctaaaagccccatggaagaatatagtagaatctcaattcccagaatatgtatattgctgatgatgttggtttgcaatgatcatcaggagatatatatagagggagaggggggaaagatccttacaaaaatgactgatatcaatgtacatgtcttgtcaaaagaacagagataccagcatatggctaactgaaacatattaattaagaccaacttagctactccaggactcctacacaaacagaatgtccaaaatggcatgtagggtttctccacgcgaaaagatcagctggtctccagctactccagttacacgtccttgacatgcttctgtgctggttgaggcacccatgccgctctgtacttgagtacccgcagtttttcagcaatctgagcaaaagttagttcacagccaactggaagctcctgtgtgaacaaagcacgagagtacttgccccattcgttgaactcacaggaaaatttcttaggaaccttcttctcagacttagctgtaggaggtgcagagaaagtgcctaaaacccatcgctgcaagagcgggaagcggatggattctgagatggtcacgaccggcagactcaatgggcctgacccaagttcttccttcaggcgcttctgtctgaccaactcttctgccatgagtagggattggtgacaattcttgaatgcccttctgcctacttcaatgttatggccacctacatcattataacttgtgctaatattgttcatattaaataccccttccttctccttcttggagtagtgcagttgagaacgcggaggcagactctcttcagcgtcgctcatcctataccattttcctgtcacagtaagaagacaacatagtacattataattggggaacacatgcatgctggtatctactagtagaagctaagataataaccaccgacttgtgagctagttaaactggtggtacaggatgcagaggaatattcacagtacacattgggcaggtatgtgcaccctcattgggcaggtatgtgcacccttctaactgatgctaatatgctaccaccaaccaattaaaagcaagtctggattttggaaaagaaaatacatgcatgtcagactgtttttatcctaatgcaataaaacaacagcagaaaaaggcaactactagaagtgcatgttttgtagtctagttaagcagttgttgataatataatcatcggtaatattgtgcgaaaaccaactgaagcaagtagctagtgattttgaaacatgctaatgtatacaaaagaagtacagaacgatatatactataaggggaaaaaaactgtagcaatatgtagaactatcagaatacatgctaatttgtagtgcagttaatgtgcatgaagggcaacaaaattccatggatggaaaaacccaaactgttggtctatttgagtagttgcattgcatggcattctgtattttacatttgtaaacatgttctcacactttcaaaaccatagaagcaaggcaaagttcatctctttagagttctcatcccccctcacaaaattttagctagttataacacataatagattaaaattttgatgtgaagttacaaaatagatttagtgtatgatgtgaaattacagattgtattcataataacaacatgcaacgatacgatggtgtattgattcttaacccacaggaaattgtgctacataagtgttaacatggtgatttttcttatcagaatacatcataaggcatactaggacaaggaaaaaaatgcgtgtgaacatgcgcatgttaatgatctagctaggcatgatctaagtctagctttggattacaaatgataattttaaatatcttccttatctaaaaaattactcttgataaaacttatcatgtcaaatattgcagatatcacagattcagttgccacagcaagagtttttcgtgttgtgaacagttggcacataaggtgctgcaaaccccaatgttcatattttctccctctctatcctatcattcccttccggcgtcccacaggccacaaacacaaccttctcctcctctgtaagcagctagcatcaatctctgatcctcccttaattatcaagaatggaaatgcatttgcatttagcaaagaatcttacctttagcatgaaaggcctcaaagtagaggtctttccatcggaacaggagtgttacgatttcctcatctggactgctcttggtcggcttcaacttcaccagaaaagtcccacctttgggcgtgtagagtctctcagcaaccttggagaagagctttttgcctttgctattggacggagcttcctgtatgattatctgttctaatcttgttggaatggcgtcctccatgagcttcttgtagctttcaggcaaatcattcagcacgagatcgaattcatctgatgcagggggcttgacaagaaacaacaagcaaggagaggaaaaaaaaaagatcatttttttcatttgaaatccccatgatctttgaagaaccaaagtcatggcgcacgacacacaaacaggaataaggagtgttgagattccgtacctccttcactggctgttctttctttggggccatggcgattcatagaagatgcttttcttgttcttggaagggggttttgaagcgagcaggtgggggttgaagggtttttgaagcagaggatcggagcagaaggccaatgtatcttgccggtggccaaggcttctcctacttggacatctccctcctcctcctcgcagtcatggcggacgtatgtatcactggagaggaggagtaggcggaggcgcgcggcgggggcggagctcttgagcaatggagacttgggagaagagaggcatttctgggtggtcaggtgatcaggtcgacaggtcttatatttctttaatatttttctattgttcctccctcgggttccactttttgttttcttttttgtcgtatagtactcctcctcctaagagagagagttagagagcgagagagacacacacacacatagagagttccaaagtaccaaaccctcgccgccggggatgtcgccgtcgacgccccacccgggccgcgcgccggctggccgttctccgggactcttgggcacttacctccatccagctccagcctctcgcgcagccgtccattcattcaacgccagtatgtgagtgagttcgagtacgccaaccatgactaaattatccatatctctagctagtgaatgctactctctgatctcgatctactccttgttactggttgtgtcttagttggaacgattgtgctaacacgaccacccgatttgatttgtatgcgtgtatttttttttttttgggggggggggttgtatttgcattaattctacgtaggagctgaggatcgcagattaatt

SEQ ID NO: 73661 - DNA, 28358 bp, Oryza sativa
ataaatgcatcgacattcagacagccaacttcagaaattgatacctcctaaaccacttgatataaaatcatgccatctggtcagaagatagatctacacgttatctacaacttttgtatagagacttttcacaggaaaacccattatgttggccggaaaagcagccaaaacagaactgcgcagggggcatatcagcaagaaaaacctggctgaggaataaatcggtggatcccaaacttactcacttccaacacttgatctaaaccctaaaagaaaaccaatacagtgggaaagatcatgtatttgatacctaggcctccttgggaagcggcaatcaaacccctcatttccttcttcacctcgattccctccgcttccttctctccctttcttctccttcccttcttcttcttcccaggtctgcagtagggcaggcatgggggaggtcgaccagagggggaggtgggcgccccagggtaccaaatgacggctagggggaggtgggggggacctcctagggtcttgggggtgtggagggggcagctgggccttgggctggccgaaagctagcccaactagcgtataactattgtttttcttctaattgcaaacaccaaaaaaaaatgtagggaattccaatatatactatacgctattctttttttttctagggcattacacagcatgtcagctctcttgctctcttcctcttctcccatcttttttttctttttttttcgtctctcttttctcctctttttatctttttttatctctttttttagtaaggtgggactaacaccaactttaaaccaagatggccttgattgatggaactcgtcatcacaagctcgtcggcctttccccccacacttggacttttgtgtcgcaagacatcaaaaaccaagtgtgtgatgtcggagtctcctatagagtgttcccataccgaggatcgccaaagtgtaaagttgatgtagctaaccgtgtacttaggcatcgtctgaccctcattcttaatctcaacctgaaatgcttagcgaccaagaatacccgaagatgtatacaatcctaaacataggttcttgcttttattagaaaagaaacttaccgtagtaatctggactatctcctggcagtgctttgattatggtctcaagctcgaccatagggacatcatgctgcaagattagtgccacaaacaaatacaagatttgtagtatttatgataaatataagcatccagaaccacacttctaaacatgttagaaatgaggaccgtaaggtggttgtggtcctcgcacagagaaacgtcactaatcagacaggactctaggaattccttatgtgagaatgaatcctggggaattttgaaagaaaaactttcatgttcatttgtggaatgttttctctcatcctctagagtcaatgtctcaagcttgtctgtggcctgaagatcctcctcctcaagagatgcatcatgcaagaacatagttgtttcttgatgataaacaagaacaatgttctgtaggctagaaggacaaggcttacgcttgatcgacgatgatgagagtcgttcagtttcatgaagatggacaatagattcggaagaaatgaatgaaaaaacaaacatcgcctgctcgaacggctcatacttgggatgaggcttctttttgttgaaataattcagggtgtttccattatcttcataacgattatccctgaattggaatggaatttctggaggatgaatttttttcttcctccggctccagcacctagaatgaggattcggcagttgagtcgggtttcgactccacgtgcagaggtttctcacagataatctagacctcccggatggcttcgcttcggcagaaagaatcgttctctaagatgagatctaagagttctctttgttctgcagttgtcttgtgtgcgaacgatcctccagcggaaatatcgagatttgcaacagactccttgtctaatccatactgaaaatgttgtaacaacaaatggtcaggcaaagacaagtctgggctagactaagttaacaatgacaacctggcccaggctgcactgagagattccttcttgttctatcggaaagaaatgatgtctaatcgaagattaattatacgagttaatggaaagaaagcaaggcaaaatttgcactttagctcctcccattgaccgtggaatttcttgacagacatagtgtaccattgcttcacttcatctctaagagaaaaaggaaacaattttcacttcaaagtttcatgtgccattcctacgatcgataggcatgaacacactagctcaaagtcccgaagatggaggtatgggctttcactaataccaccagagaaggtttgctcttgaatcatggctataaagccaggactgatttcgtagccttatgaaaggattggttttgaagaacgagatggctcacaaagatcagcctgaggagcagaaaggttttgaattgtgggttgctccatcaaggaaagggataaaagaagaagaaataaaaaaagatacgaggatgacctagactcggaaaaattagcaaccgttccccggcaacgacgccagaaatgcttgttggtattccttaagaccatagataaatctgcaagcacacggaataccgctgtagtacttcatcttcgggtgacccctaaaggatatcgaacacagggaacgtgtgtaatctacataaatctaagactatctaaggacaacaactaatggtaagcaagctaggctaggctagagaggactttctaagtgttttagttatctagactgagttgaaggtaatttccaatctattgcttcaggcaccgacccctgctggtctgccagcgtggttctggctatagctctatgatgtatctgaatgtggaagattactaggacgcgattcagggctgtcaccacctgtcgcctacctctgacaaatccatgggatacacaacaaacaaaggtaatatctaaactagacaccacgtctaagttataataaaataaagtccactattgcttggtttactaacctcttgcagagaatgagcaataaatggagaagaatcggcatcaaaaccatcgatcaatcaatcggacgatgccgagaaatagacttatagaaagatgggccatgaaaccataattgacacgatcaaattggaccaaaattcataagtctgggtgaaggagagcaagaggaggccactgaccgagtttgggctgggttcggcagaaccaaccgaagcaccattggatccaggttttggatagacggtgtggatggcttccctatggcggttggaggatattaccgacatttccaaccatcattgttcagctataaaaggccttcactccctccatttccaacacacctcaagcaagcaagcttctcatactctctcaagtttagtttagtgctctcaagctagtggagtaagaacagaatagtagtcggagtccggaagtcttcggaagagttcgggtatggctctagttactttcctttgttcttttgtaagactagtatttaatttagaatattcttctgtatacgactatggaattgtaatactttccgattatataaataccagctttacactatgtccgagatattatgattatactgctagcttatctgggagatgcattggtacgggtataatgtttgcatatgcaaatactctatgtcacgatggtgatattagagtaatatttggtagtttaggcgtggtgcttagattactgggtatcattatttggggttatatgctgcggatgagatgtgggccgctgatggtgacagctcagtgcgggtattcctccgcgcgtgtataaaatcctaagttcattccctggggagggtactcctccgtatttagccccggttgtatggtcatgaggggctgtccaaaggaactcggcagtcaggggtggcttctcgaactaccaggatggcatcggaaagggggtattagctagttaatcatatacttaggatgtatgtacactatgtatactagaagtataggaatagattcttttcaatactctttccacttagcttagagatttaatataagagtgagtagcttccggtcctcatggaaagctacactcgttgaggtagaaatcgaagagagcgccaaacttccaggcacacttgcagagcttccgctcattctctacctattctctaatgtacaaaagatataatagagcctcttgtatttcacctcaaagttgtgtgtgctggaatgaagtgagctcctccttttataggctccaaatgaaggttactgctatgggaaatacccaaactaccctccaaccatcattgggatgaaatcaggagcatcgacaaggaagatggcgatcaacggtgacagacatggattagccaaactggtggttcggttgaagcaaaaaaacccacctcctggactctcctttggccaataggttgcttaatgggctcccaacatcctgtactatgagtttgcccaattctaagtggttttgattgacttatggagcttccaatccatgtaaacgcatcctgattgtccgaaggtgtactttgtcgcatgacgggtatgttttctccttaaaatacctacatacacatatttcaccaacagtagtggaaatgattagtaataaaccctaccactaagttgaataccatattttatttcattatatgcaggtgttgatgatcaaatatgatgatttaaggaccgtcatcaatctgctatttgtatatcttgtcagttgcaggatcaaactgactgcgatgcccgcatatcaccaagatttggaactgcactagagctaagcagatctctcaggcagttgtgttcgtcgacttagttcgcgccaacacagacttggcaccattagcaatacgtaatttgttgtgttttgtggaatttttttaacagtagatatttttttatctgaaataaatattaaagtggttgctccggtcattttgatgtcaacaataaaaatattaataaaagaaaattgcaattaattcaagtgtcaagctatattttggatcgctatgcattatactctttggatttctgccaaaagctcattgctttctttctttttagttccaacccaacccgctacctccctctgcttggcctatctctctttgaacccacaagtgtagctgtagcccagctcgtatagccagctatcattttcaacccctggaaaactgtcccgtgttcgtacgataccagaaccgatcctccccatcaaattcggtcgaatctttctcaatctcctaaaattggttgagggttttgatgcactcgatctcctctttccgtttttatcaaaattggagcgaatctgcaaatctcgggataaaaatgatgacttttaaatggagattaaatctagtgattaaagggaaattgaaagggaaaatgatggagaatagtttgagggagtagtgcagaattgatttttgtaatcaattggagaagggaacgcatggagagacagatcgacatgctagcgatgctagggtttggcccgacgaccaaaaaaccggctagcaacgaaaataacttatggaaaaaacccggaaaaaagaagacaagaaaaaagtggatgggaaaaaaagggaaaacggagaaaaaagatggacggaaaaaaaagggaaaaacgaaaaaaagacggactaaaaaaggcaacgaataaaaagcgggtgaaaaaaaaggaaaataaggggaaaaaagactgacaaaaaacccgaaagccttacctaaatgccagtgcgtcacactgggtaaaattttccctacatgtgcgggatgtgaatgatgcctttgacatgttgtctggatggttgcagcgttggaagaacgttcggaagaacaatgcgattgtgtttgcacagaaggcgacggatggaaattttatgtgatgaacggaaatattgatatcttttaagtaggtaagtctaaaaaaaataaatggaattttgtggtaatttatccactttaactatgagaatatagtatgtgttgatacctgaagaaaatacgtggagttaaaccgacgacacacgtcagaattgtgaaaattggtgttattcgtttgcattttatttttcttttttgaaacctttataactttttttgttaaaatttatggtttttttctcattaaatattgaagttaagaattgatggtttttatgttaatattaaaaaagtaaaatagcaaggagatcataccaaattctgttgcacacagggtttcccaaaccgccggggacggggttaccgtgccccgacggtaagcacggttaccgcgcggtaaccgtggcaaaccatacgaaaccatgcaaaatttatcaaaatttcaaattattttttaaatttatttgaatttaaggagattaccgtggtttttctattaccactgtaaccatggtcactggtggttttgcaaacccttgttgcacactaccagcctgaccaggtgccagctctcattttcttgacagccactctctctttctccatgtcttcctctgtctctctctccctcatctatatctatagagcaaccaaatattcagttagcaatttatgttgagcaaccgaataatcagacattatacccgcaccaatgcaattcccagaagatttagctacacagattatactattcatgaatactataaagtcggtacgcatattctaagattggaataaagcacctgaattatataaagaagattattctattgaaagtagaagtcttacaaaagaagaggaaaagatacaagagactttaccgaactccttctgaaggctccgaggactagcagagctattccaattctactccactagcactatactaacactaaacttgtagagaagctttgatctttgctgggaatgaatgagaggaggagctatttataggccatgagttgcatttgggagagtggagatgctccaagcatccaaggagcatattctccttagcttcatctccttgtgacatgtgtccagcgatggtttcttcagtttaactggtcataaccgtcttgggacatggataactaccagctggtgaagaattaggctaattgggctagctactggttcagccgaactaggcccaatcagcccacaactttgcaggtggacttcttgttgattcatcaatccagtgatgtgaattattgggcttgtttactcgtgcgtattttgtgttattggcccatcttttcacaagtttgcttctcgatagctttcgagtgatcgttcgtttgctttctgtcgattctcctctatttatatgtgcttctcctgcgtatatgttagtagcatagtacatagtggaaatagacattttatttggaatttatgcattgcaagcatagctagtcttcagtaattgggaaatattgacggtcgaaattggttgataacgactgtcaacaaaccccccaagcttaaacctttgctcgtcccgagtaaaggacgaaaggaaacaaagacttggttgttgatcaggagttgctactatggtgtatatctagaatgtagaagtgcacagtttgagtactctctctcatgttaagtaaatatgcatagtggcttacccttatgcctaacatttgtggaacacatgcttctcaccaccttaggcaattgagagacagaacagatcatagagcaccattttctttttccttgctcagttttcatcccggatggttttcaaggatttttgcaaataaaaactatgttcctcaaatgattctcttgatcactcaaagtgtatagatattttattcctcacgaaagataatgccctatttgaatcctactctaaggttgaatatgtggagcttggtagggatcaaatgaggcatacttgtattctcataaattactaagtcaaaaatctagactaaagcagatagcaaatcatacttagatcaagatcatgcaaagtgtgtggaatgtgtggtggaaaataaaatttggataaagaaaatgcttctcctttgtgcttatacttctcctccaaattatcctttgtttttcatggagagggtatggctatatattttcatcacgctccatattttgatagagcaagactttattcatcatttttttatagccacacctttctctccctttttcttttctttttgcaaaagatttttctttggagaagaatgcatgaatggagagctttatttgtcgatgatgacatggatatgagtgagatgaatgctaacttccagtgtagaagcttagcatgtgtgcatatgtgggtgtatgatcttgttcataaagtatgaaagatatctacacaagtcacaaaatttgacaaagttcaatggaactacaagtaaccaaatattatataaggttttcaagtgcaaattatatttggctgtggtaggaataaatatatcaaatgaggaactttgaaatttatcattttgaaaaacaaatcatccaaaatttaaatcaagcttggatcaagatttaagcaactctatttcactatatcatatctcacaacagcttaggcttaaatcacgcagtgtgcaactcacatctcttaggttcccggataatggttggctaatcattatttaaaacttgagagagtacttaactatgtacagatacattagagatataaagcagagcaaatattcatcatttcaatgtggagaactaggttttcttacctagcatggtaaaatctatcctatatttttggtattttctattttgcaaatttttatgtttttgagttataaatgcaaatgcaagaattgaaacatgcaagaaaggaaatatgcaagataaatgcagatacaagtcacctttgcgggggagagacttctccccccaagcttgctccttgctcatggtccagagtaagcattgaatccttgatggcggaagtaggcttgcagatcagcttgttgttgttgcatcatattgttgatatttgagaactgtgcatcaacactttgctgctactcctgcgcctggatcacgtgtccttcgagggactgttgtcccagcgagaggaactcgagcaccaccagctggaggttggaggcacgccacttgagcctgctgagttggtgtgcccccagcgcacctcatgaggcatctgccactaggaactgccggcactcggctaggcagatcctccagtgctatgacgtagggcttgggcccagccggaggcatctctagctgatttccagccactctcataagcatgaccgggtggtgagtacgttgaatcctcctgttcatctgctgccattctgcggttactcctatgtgtcgcacctgcacgggattcctctatcgtctgcaggggaatggttagtgcataacagttatacaaatgataccccgggttaggtaacaggatttcatttctacaaccgggttggaagaatactaaggtcacatctgctccatgtttcaaagtatgaccttgcactagatatgattcatttatataaacacgagagactgagatataagcaatttgatcatttgtaataaccccaagccctcttgctatacaagtgatcaaagaagtgcattttataggagcggagacctctatgctctctacccactgcctaatcatgggttgcacaggagaaactctaatcttatgaaccatggcatatataataatcatctcattatcatgaacaggtctaggatctcctctaggaaacaaagtcatggcaatccatttatgtataagtctaagagttggattatggatgtcattggttctgggtttcaacccattgttttccagataacaccaaaatccacatccatacctgttttccggagtagctcaggatcgtatgctcgggtgtgagcgaacgatcggttcttcaacatctggtaggtttgcttctctcgtctgtcgacgaggtcgaggtcgtcatctgtcaggagctgtggaacatcgtccgtgtcctccatcgacatgtcggcggacgaacgatcactcgcattatcggatcgggagccagatcccttaagcaagcgagagagccgtctcctcatgactgcacaaaagcaaggatacaaagcgaactcgagcgggggttagtacgagataaaatacccgccggttagctttgtaccaacagcgacttgcaaatgtagcgaataaaggattttaaatataagacgagcttgcaccagcctggaatgaatttgagagcaaaatagaaattgagaaggagttaaaaattgagttggcaatgagatgaactccttctaccggccatcccctttttatagtgcacctccaacggctataattgtgacagggacccactaaccattggtgtgcaaaagaagggaggtgactattgcctgttgacggtcgtcatcgatcagttacatccgtcaatattaccggaataaatgaagaactagttatgcttgcaatgcatttagtgtcataataaaataaaaaccactagcacttggttcactaaccctttgcagagaatgagccataaatggagaagaatcggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaggtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgctcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccactgatggtgacagctcggtacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttccgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacatacactgtgaagggcgtcagtcctgatatcgtcaggctgaggctgttcccattttccctcctcgggaaagcgaagaagtggttctatgccaatcgtgctgtgataaactcttgggaaaaatgttcgacagcattcttgtcaaagttcttcccgatgggcaagattaatgcccttcgtgggtgaatttcgggcttctagcagatgcgggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacaacaataacaacaacaacgggtaccacccgcaaggaggtcaggggtggaaccagccccgtccgtatttccaagaaggcaataaccaagctaatttctctaaccagccttccttgaaggatcttgttttcgcgcaagccaaaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagagaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaagattcggggtgtcccacaatcacttgctcaatctagacacaaaaattcgaccaggcactctgcgaccttggggcaagtgtaagcgtcatgcccaaggacgtcttcgacaaactcaactttacggtgttggcaccaacaccgatgcgccttcagctggctgactcgtcggtccgctacctagccgggatagcagaagacgtgccggtaaagatacgggattgctttatcccggtcgatttcgtggtgctggacatggacaccggtaaggagactccgctcatcctgggcgtccattcctgagtaccgcagaggcaaacattgatgtcggaacaagaagcatccgtttccacatcaatggaaaggaggagaagttcgagttccagccgaggacgaaacaatgctccatggtccggttaaagtacgggccagccccgtagaatattcagacggtcaaagtggagccacccaaaatggacagcctcatcgctttcatgaagaaatctctggagatacaaccttccaggatgaggtcccgttattggaagacaccggcctagaaggaagagaaaccggctcaaaagaagccgccgcccataccaaggacaaataaggtatggtggctgaaacagaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaaccggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccgtttttataacaggaatcaatcgtgtaaacagtaccatttccctggatcaagtagtctggtacacacgaattcatagctgaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtactaaccgtactcagcaagccatcatagcaatgatgcacatgacagaggaattcaaaggatggctatggttctttttgcataaagcaagttttgtaattcttttcacaagcctaagacctagcatagactgttcaagttttaataccagtgttcatattaaataatgacggttctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgtatattaaattatggttcaagttaagttctctctctcacacactcatggcagtcctaccaatggcaacaccgatgtagggtacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactggggacggtactagccttttccagataccacccaaatcctccgtccgccccagtcgaaaatagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcgggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggcagaaatattttgttgtcataagtttttaatttactcttcccgagcattatatccatataataggttagaaatttctattaagagctaaatatcggaggaaatcctagaaatattatacaatttaatttattctatgactaaacgattaaatataatatgcggctaagattcttagtaattaaatccgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaggaatttccaaaaataatctatgattaaccccgaccatttttatttcctaaatcctcctaatttctcccccaatttcccttctattttctccttttcttcttttctattttcccaatttttctctcctctttttctttttctctcttttctctccctctctttctttttctctcttttctctccctctctttctttttctctgccagcctctcttttctttttcttttctttttttttccttctcttctctcctcccggctcctttctttcttcccttctcttcctctatcctctttcggctccttctcctcctctctctcgtcctgcctaccgcgaccggctgaggaaaggaaaaaggcggcggcggcatggcttaccggcggcaacggcaatggcgcggcgcacggtggctgcgacggcggcggcgcacggcgactgcgatggcggcggggaacgcggcacggccaaggcgcggcgcggcggctctatgcgacgacgcggcggcgtggaggcggcgtggtggggtgggtagaggagaggaggtgaggatggagggaaagagtgggagtagggggggattatataagggaaggggaaagagataatagggaagagggaagaggggccgcccctcatggctgccgcagcgtggcgctgcacgcggctcgacgcggcgatgggacgacgacgcggcgcggcagggcgcgggacgcgaggagcggcagcggcgacgcgacggccgaacggcgacggcgcgaggcgatggaacgggcggcgcggcgcggtagcagcggcggcacggggctcggggaagcagcgcggcacggggcgcgaggcggcgggctcgcggcgcgaggcgacgagacggcacgcagcgcggcaatggcacggctcgaggcggcgatggaacgcgcacgcggcgacgggatggcgacggcgacggcgcggcaaaggtggcgcgcggcacgaggcagcgatgggatgcacgcgcagcgcggggcgggacgcgacggcgacggcgcggccgcggccatgagatggcgatggcgacggtggcgcggcggcaggcgacgagggcgacggcgcgcggcggctagcgacgatggcgacggtgcgcggcggctcggggcgcgaggcggcaacgcgcggtgacggtggcgacagagacagggggaaaaaggaggagctgggttaggggaccccgtcgaacactttaggtgcaatgaacagtgccgttttctaattaacccgattttagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgagatcaaattcagataaaatagacgaataagatcggcatgatgtaattagtttaaaaagtttttgaaaatccgtatttttagagttttgattttgtcggtcgaattttcagggtgttacactttgtttcctagaggtgatctttgacccattcaaggagatgaattgattatcatgtttgccatggttagaaaaattaaaattgctcctgttaaatgtatgattaggcaatggttagtgtcgcgaccgagaaaattgcattttcccgaacgctagtgtattaatccccgtcccaggaaaagccggggtacaccatacaaacatgatataaaagacacatctgtattatatcgataatatttacattattacaaaggcacttaaggcctgacaatcaaaaataaacagcagcggactagcgggcctactgctccatcttcacaggcgctcaactggggtataagccaggactccacctaagacttcttctccaaagcttctcttactgaagaggggaaagattgagcaagaatgagtacaaccacagtactcaacaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattttagttgttaagcaaattttaggaattaaaacgctaacttgggtacattgctcggcttgcccataaccgagggcgcggctattcgaatagattatactctgatcagaggtgtacaactttacccacaagacacatcttcctcacgtgcaaccacgtgccacataccaccacggtatacaggcggaagacgtgacatagtttccaacccatcctagccatagagaagagtaccgacccaatcccacctacggccggaacctccgggacaggcaggcaggactgagcccccagcagcagggcaccaaccctgtaccatgacatctcgactaccgggccgcagctcgtgtagccttcatttgccctggagaatgtccatcgacccccgacttcatccacctccaatccgtgtacttttgtttataacttgactgagccacaaactaagccttacccactagacatgtggaagtacggtagtgctttgcaacagaggcccgaagaccggtctttatatggccgaggtgctactatcaaaaccatgcaccccgagcccagcctaaaaccattttggggattttgaatagagggggcggtgtgaatccaattccacaataaaccaacaattccaaagtgtccaagtgatatgagaattccccaagtctaaagttataaaaccacctaatgttgtctaattaaacagcgaagcatctacctaaaatcatactagtggtaccatgagtagagtatccactagttggggttttgtttaatctagggtggacaaggtaataataacaataacaacaataatacggtcataacaaaggtaaataggcatggctaagtaaaaccgtgataacgcgggaatttaaataaagcgataatgcaataatttaaatcaaaataattttataaactgggattcaatatgttcaaggatgatgtgacttgccttgctcactttcccaaacgccggcttcaacttccacgaagagcggatcttccgaagctgcagcgtctacacgaccaacggaaaagaaaaggcttttacgctaataaattccacataacagcagaaacaaagcacaaaaatgggttcttgacttcttaaggaaaaattagagacttgaacggtccaattccgagttcaaatggccaagttatggccatttgaagtttatatgttctttaaatggatatttgcgaatttcttcatttaaattttaatttaaaatcgaattattgcgtcagccgggagagagggcgcgcggaccgggtccacgggagtgggacccacgcggcagcctctcggtccacggtggaccgggtgcacgcggctggcgccgtgggtcccacgcgtcagccgcacccgcgggcgcgggcggctgacggccgggccccacctggcagccgcggggcgcgcccgaaggcggcctcgccggcacggccgacgggaggcggcgcgcccgtgccccgatggtcaccgccggcgaccaccggcgcggcggagcggcgcccgagagagaggagagaagagggaagcgaagcggcggtcttcggctcaccccgggtcgacggcggcgacggaaacggcgaccgaagcggaggaaggcggcggcgcggttcgggtcaacgaggacggcggtgctccggcggtcggcgggcgaaacggaggagcggacgaggtcgacgaggacgcggcgaagccaaaggaggtgacgccgagacgagaggaggtccggggcgacgacagcggcgaaccggagctcggcggcgacggcggagagagaggacgacggcgcgggctcgattccgaaggggagagtgagcggcgagcggcggaaacggaggagggaggcacggggaacgattaaatagcgtcgggagggggagagagcggccgggcgagggggaaacggccgcgaaaggtgcggccgccattgatgccggcgaggtttaggggaaagattccgagcgaatccgagggagagagagagggaaaagtgggggaaaagggagagggaatcacggggaatgattccccccactttattgcgcgcggggacggcgggatgcggcggaatccgcggcggcggcggcgctagggcacgggcgggcggcgggagcggcgcgaggatagggatgacaggcgggccccacctgtcagcgagggtggcgggcgggcccgcccgtcagcggcgcgcgcgcggggagaggccgagtgggccgcggggagaggagagggagggggagggagatgggccgagccggcccaagaggggaaggggggaaaaagaagactttttaggatttttctttttataaaatcattttaactttgtttatttcttaataattattatttgtgctctgagaattccactaaaatttgagggctccttttagaccaaggagaatttaacaaaaaatctccgggccacatttgaatttttcttatacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgtcgcgtcttctataacgaacttgcctagcaaaacttctccactctggactgcttggctcgatctcctgttgcggatggaatcttctcttctcctgacttgaaccagggtgcaccttttagctgactcagactaggttgcggtagtttaatgatgcttccgttccagaacttctcatgattcatatcttcggagtcaacctcatacaagttaccacttcatctcatgcgtcaacactagcttgtcattactaggataccatgcttgtcatcatgagaataccatgcttggcgtttccttccagcttaccaccatatgctttagactatgatatcccgcttactaaggataccatgattgacaacttgccattaactatctcatattagctttcctggtctccggtgctaggtacttctgctattcgatgcaagggtcaaccactttaactataagttatgcttcccaagagaaccaatttatcccccttgacatgctttgacgtcttcccgaatgactttgctgctggacttgttattgtctgatcgtgatcctgccaaatctgaagcttcgttgttagaggtgattttaatctgacctctgtagactatcttcgaacatatcacttggttcataactgggaatagctcccacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcactccgtgtagcatctgatactgagttgaagatttcactccttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgcggacgcttctggggacgatgaggtcctttggcttgctgcctttcagtgaaaccttgatgtggttcgtcaaaagctgcactgactaccttcagggaaatacattgcttgctatctgtatctatgccactagggtttaattgccgatgatcatctttagtgcttcctcgagatggggagaatccaaattgttcttctgccatatcacctttgacccttttctgatacctgatagactaattaccaaccatcgactactatgctctcaaatattgatgtctcctgggtcttcttaactgtttgcaggtatatccgaacttatcaatgtagaggcatggcgggtacccttatgggtttcatccaacaatccttatcttgatctgtaaaaggcgtatccaaactcctatccccaactactgtctcattggccttttaacccaacacagtttaattgattttcttttccatcaacaggttggttattaactcgaggttagaacatagttcctctgaaatgagaccctaggtctcctttgacagtaaacaattatacacataatcccatatcagcatcttctgaaagagtcctcatagaacttgtctttattacacatttctcccatattacaagaatacgaggcactgccttaaacaaaaagggaaggtgcttaacatcggtacattgtatcttcaacatgaatcatccataagcatagcaagctcactgtttatagacatgaatatatttatgtattacatgattgctgcaaactttcgattacacaatgataggtagcgaactgaaaaccacaaatatggctgctcattttgattctggagagatatagctggcattgttctagtgactgcatccttgattagttctgtgatgatgtgataggactgcatattgctatcattcacaggagaagcttccttctgattgtgggttgaagcggatgacggtcttctgcttggtatcgccctccggaggttgattgccctttgctcggcctggagtaggtcggggagagacacaacttcttccatcgacgacaattctttgctgaggctgtcggtgcagagaatggttggtgctaaaggtattattgctatgatttattgcagagctaggtggagcattggtgctgtggatgatatcgtcgatgttgctgttggagctgactagctgatgagacaatcgtagggttgttcgttggatttctgcggtcttggtcaacaacacactgagttggcaatccttgggcacatggtttgttccttcgcacagaaaacatgtcaccttgcgagtgggacactcccctggtggatggtcttcttcctagtgagtgcagagtgtgagacacatgctagcaacgtgtccaatttctccacaacgggtgcatgcctttgatccgaagaagacatatctgaaactcttagtccaaacaaatgtctctttggttgatcacttgattttcttcgccatcaatcgctaggttatttgattcataatagattatgagcttacggaaatgagaccctaggtccccctaatcaacaacaaaatgtacacaactcacagctcttgcaatcttaacatggatccttcataaacttatcaaactcattcattatctcatgtttctctgttattacatgattgacggggaacaactataaaacaaaagtatttgaacactgatataagagtattatggttgcttctgactagcgctaggcttaacaggtactgcatttgctccagtgaccacttggcgattggcatgtctgtttccttaacaggtactacagttgtaaccgacaataactttcttacgctcgggttcttcatcttgtacttgatttcttggctgctgtgctggaacatccaaaggtacaatgccgatactggcctctgtcttgtcaactggtggctgcggctgaaattgagcattgacaccttgtggtaatgcactagctggagttggagctgttgcaccgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggtgaggatttgtgtggccttgatgcttctctccgttggaactggcaggttggttggccatcttcttcgtcaacagaaaactgaattgacaatcttttggtacatgatcagttccttcacaaaagaaacaagtgatcctgctcgttggacacctgtcgggtggatggtcttcctcacaatgaatgcatgtagtggcacacgagctggcaacatgaccgatttctccacaacgagagcatgccttacgttccattttatcctggttgaaaccttggggagacttctcgtcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattggtgtttctcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgggtgcttggactgcctccaactgcacttgaggttgtatctgactcaggttcagaattggcgtctgatgctgctgcagtatctctataagcaatcggttctggttaatcaggtgttggaccagtgtcacacaactggtgtctggtgcttcgttcactcgggagcttgaggtaccaacgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcgctcctgcttcacagctggcttcactgcttccttcactttactagcggatcctgcagtcttccggagcttcggcagacaattgacaacatcttcttctccacaaagccgaccatctagtactagttgaaatttgaagaaggaagaaagagtaaacgttttgcaaatagcacaggggaaggagaaaaaaggaactttcgcaaataattttatttataaaatatgtccttaggttttatcctcttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctgtattatatcgataatatttacattattacaaaggcacttaaggcctgacaatcaaaaataaacagcagcggactagcgggcctactgctccatcttcacaggcgctcaactggggtataagccaggactccacctaagacttcttctccaaagcttctcttactgaagaggggaaagattgagcaagaatgagtacaaccacagtactcagcaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattt

SEQ ID NO: 73662 - DNA, 5796 bp, Oryza sativa
attcattcatatatatgttaatgaatctaaatatatgtatgtgtttagattcattaatatctatatgaatatgggtaatgctagaaagtcttataatatgagacggaggcagtattttttttttgtttgttggatgggaaacatcaaaaccaaaactttgcttgttttgcagctatggctggctgccaggccggagaacacgctagtatatttggcattgacaagaatggggatgattctgatgaaccgtgtgctaaggatgatgccaatcaaagtgatatggctgctctgaaggaggaggaggagaattgggagctggacagtgaaccagagctcacatgggatgagaaggtggttcaagttctaaacatggttcgacaccgagagatcaccgaatataaccccaagcagttttgctcaattcctactcgattttgtgcctacaacatagccttctttgacctggacaaagagtgtgagtacatccatccactgttagggttttctataggatcgtctagccttagatctagtcgggtagagctcttgggtggatgaacaaatatggatgaaacaacagagagggaagtgagagggtttagggatacgactggttgacgttgaggaggaggaagaggcgccggccatcgtcgttgttgtcgcgcttgacgtggacggcggcgacgatggtcatgacggcggcggtcgtaggcgaggacgacgaggcgtggcgcggcgtgatgcttcccgtcactggctgcgccccctcgatcagttagggttttgtgggtggagttggcggtggcagtgaacctcgtatcgtgtgccccctcggcctccacccctgtttatatggcgcagggtgacaggggcccaccagccaatgggctgggcgccccccgatcagggcacgggtcaaggtccctttgtgccgttgggctcaaggggagggagatctatctaacattctcccccttgatctcactatttcttttagcctttttctattccatcacagatttgcacatagagcatgtttcatcgtcacggttaatcgccgatggattcgacagccactatacacatctctattatactttaacttttgggccctgtagtccaggattcataaggcttcccttaaacccatgccggctacatgttccttgaacacattgggtggtaggtctttcgtgagcggatccgcgagcatcctttctgttctaatgtgctcgagactgattgtttgatcccggactttgttcttcacaacatagtactttatgtcaatgtgtttggcagcaccacttgactgattgttgtgagcgtacattactgtaggtttgttatcgcggtataactttagtactcttcctgtccatagctcatacggtgttttgggcaccgatttgcttgaaactctgttgaggatatgaatggcggtttttaacgcctccatccataaacccaatggtagggtggagtagctcatcatgctgcgcaccatatccataagggtacggttacgcctttcagctaccccattctgtttaggttcgcccggtgttgaatagtgggctactattccattctctagcaagaaccttgcaaaaggtccagggacttgcccataaggcgtatgccgaccatagtactccccccatggttagatcttactattttaaactttatatcatgctgattttcaacttcagctttgaatatcttaaatttatccaatgcttctgatctttctttaattggataaatataaccataatgggagtaatcgtctgtgaatgttatgaacgagtcatagccatccacacttttcacaggaaatggaccacaaatatctgtatgaatgatctccaaaattcccgcgcttcgttttgcaccctttttgatgctctttacaaattttcctttaatgcattctatgcattgttctaaatctgagaactccaatggaggaagaatatcactcttaactagtctctcaattctccccctcgaaatatggcctaaacgatagtgccataatttcgatgagacatcaggagttctctttcttttcttgttttcttttgtcaacgaggacacaacattcacattctcagaaagagataacaaataaagctcatcttgcaacacaacaaagaattgggctcaatcccagagtgtgacaccgtctctgagtacctcgaaagaataaagagccagtttactggttcttcaaagacttatgcgacacagctgataaagcagcttgtgacagagaggtaccatgggggtggtgtaagagaccacattcttaggatgagcaacatggcttccaagttgaagccaatggatttgggtatcacagatgactttctggtccatctggttatggcctcattgccaaagcattttgacaactttattgtcaacttcaacataagtctagagaaatggaattttgaaaagctcatcgctaattgtgtgcaagaggaggaaagaatcaaagagtccaatggtggctctattaactatgttaaagataacaagaaaaagagccacaaaccatcccctcaaaagggaaatagcctcagcatctgcctcagcaacaacatttcactgttgaaaaggatcagtgtctccactgcaagaagacatgacattacaagaaagattgtcctgacttcctgaaaatgatcatggcaaagaaaggtgagaacattattacatttgtaaatgaatctcattatgttggttattttagatccacatggtggattgattctggagtaactattcatgcgtgtaattgtttaaagggattccgttcgacgaggactacgcaaagaaacaaaagatccattagagttgccaatggagttgaagcaaaagtagaagctgttggagtctttgcctagagctcccgattggcttcacacttttacttcgagatgttttttatgtaatttaataagtgtatcgaaataggattttgatggatatgattgccattttggaaatggcaaatgtgaactatggtataataatgcatgtattggtcttgctgtgttgcaagatgagctttatttgttatcttttgctgagaatgttaatgttgtgtcctcattgacaaaaggaaacaagaaaagaaagagaactcctgatgtctcatcgaaattatggcactgtcgtttaggccatatttcgagggggagaattatgactagttaagaatgacattcttcctctattggagttctcagatttagaacaatgcatagaatgcattaaaggaaaatttgtgagtggaattggcggcggcagcgaacctcgtatcgtgtgccgccccggcctccacccctgtttatatggcacggggtgacgggggcctaccagccaatgggctgggcgccctcgatcagggcgcgggtcaaggtccccttgtgccgttgggctcaagggggagagagatctatcaaacatccatttgttataatatcatccttgtttcttgttcattctttgactattgtacatgtcttaaaaaaatttactttcctggtttgatttatgtctctggcttgattttgcagcaaagcttgcacgtggaccacctatcaagtcgctagctttccctgactactggtgggagatggactctgtcaatgtgattgcaatcaaggtgaccgagtctgatgtgggttaccctatcagggtatttggcactgtgctggccagggatgagtatgatttcaggtgtgtctatctgttcaggcgtgacaggaacaatccccagatcatcacctcgccggtatgttactgattcgttcctcctccttgctagattaatactatttactgttcaaatccaaatgccattgcctttacaatccgctgtctgatattctacactataaatgacctgttaattaggctcacattgttaagtgaaatgtagacggttgcatagttccataatggctggtgaaacgcctgatacgatagaaatcctgtttcctggacattaaaatccctactgccagatcttaaaccttgctgtcaatatcatatatccaccgaatctgattgcctggtagtccattcctgctgtctaagagggtcaggacagttactgttggaacatcaatcaatccatgacttccccttttttgtgagatttgatttacttaattagtttctatatcccaagatcctggtacttttacctgttatactattttgttaatccagtgcaacggtagtgctctgggatcatgtacgttttgtactggaaaaagtggaaacaaaagaatttatattggcatgttgctcatttgaacgtgggaatttgaaatgcaattcacaggctgtttcatatacctaaaattattatctgtatgtattatgtacccaaatttctcttaacatattgttggcactgtctgaactgtattcgacttatcgagcctggtgtttttggtggcatttttgacatgatttcccctaatctatttacaggaggacacactaactctgacaggacctaatcgagcgctgggtgcaacagacaaaatgtatttcgagttcaatttgaagattagagacgatggcgatgtcgacaaagatttctgcaaaggtgtgcgagaacacaatgccatctgctatacaaagcagccgatgactttatcgctagagagctgcctgagtacaattgattttgtgtatagtcctgttcaattagctgtggaagcttctgttgcagtcaaaattaagggggttgtatccacgtttttcactggcaaagtgactgcttggactactggagatgatcagaacaaaatcatcctgtatgacagtgaagtggaaggcagcaacagagttgttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccgtgagcaaggtccctatgaactgcaggtgaatgttgtttggacagctgcctttaagcatcgacagcgcagaaaattgtttgagcgtatcggtgacttccgcgtgttaaggtgatatgatgtagtatgaagatttatatgggggaagttgttacatctcaagcagttctatcttgttatatagatcatattttttgttcagctgagtttaactcgtgcttaactgaaaatctgcctgcaagacttatatgtactggtagactggtagtctattttgccgggtcggccaaaagttggctgaccaatttcattaagattgggaagaaaatacagtgtgaaaggttacaacgacattagtacaatgtcgtggcggctagagaacccggatcatctatcccaccatcttgtgcagttagccagaagatctctaggcgtttctccgtattaattaagctcacatatatcacactaaaaaattgtcaaaaaataaatcagtatatcttgtaaaaattgtaaagctatagatcaatatatgatatatatctttttcacaaatatacaagttaaaattcaatctatataagtagaaacaaaaatatcacatttgtgaactacacattctatttatagttaaatttgtcaattttttctacttgtataagttgaatttgaacatgtatgtttgtgaagtaacatatcacatattaatctatcttactccctccgtcctataatataaaaagttttagggttgtacacggttattaagaaa

SEQ ID NO: 73663 - DNA, 12037 bp, Oryza sativa
tctacacatgttcaagatttcatcacataatagcctaagattgtctggaaggcaaccatccatggggactaaaaaagtctttttggtgcaaagcagcttctctgaatccgagtcattgagaggcttcatctgatgcacaaccccattataattagacaaaacccacccagaaacctgctcatcgcgagctgtaaacaatattctgctactgcagttattattaggaaatgcacccttgatcatttccaaatctgatccgtcgaatatatcatcaatcaaagcaaagtatctggagggagaatacgaagagagaaaatattaagagaattcgagctctgatgctgctccgtaagagaagttctaaatgagtacagtactatatagcagctgaattaagcaagcagtacatgttgtttacctcttatccttgaggcattctgatatgttgcgagccaacagctctgggtcgtcctccaacatcgtgatttctgagctgttaggtgatgatggtgcctccagttgctccatgatctgcttgaggatggtttgaagaagaagctgcttgctcctgtgagctggcctgcgggataatttagccacaacgtggcactggaaatgagtttggcaccggagtcgacggtggagctccatggcaagagtggtcttgccaatgccggcgggtccagcaatggccatgacccggaggctcttgtcggcggccatgagccatccgagcagctcgtttgccgtgccgtcgatgccaacaagatgatcatggacggcagcagcctcgacttgggctgcttgatgcagtgatggcatgagctccgagcttgggagcttgaggcgtggatcattggagaacacacggtagagatagtacgccttacccggagtgtcatagttgaaagacattgggcggcggaagcaccgcatgggtggttttcgcagcagcgagcgaggtgcttcttctcggtgccgtttacacagaagtttcactatatctatggcgtccctcgtctcgagcttcagcatcataagccaactttcgtgtctatcgatgagatcgactacacaacgatctcatcataagttacacagaagtttcactacacaatgatggaagttcttcccatcgctccctccgacatgatccccggccgcacgcctgcaagactgtacggctatctgtatctggtaaggactcaagactgtacggccgtacgcctggtaagactgtacgcctgcacgactgcgcggcagaacaaaattactgcagcaaacatatgtattgcagatgcatgccgaaatgcatgctagacgataagacgagtactccctccgtcccaaaaaaaaatccaatcctgagtttgaatctggacataatgtatgtctatttcgctaatgtttgcgcgctactaaagcagggaacaccttatctcttccccatccttttgcacccatctccccaccaccagaaacgtcgctttcttcccatctcctcttccaagctggctgcacacgccgcctctgccataagctgcatgcgtcttctacctatcctcttcctcggcaattcgtgggcgagctatctgctcctcttgccgtttttttcctcctctctagcacgacaaacggagtgaaaccgctaataatggtatacgggttgttttcttcttccctttcggtttttcatttttttcagttttttaatatatacatatatcaaccttgtatacgtcttttttttctctcggtttctttgttgtttaaatatgtacgtatacaaacatacaaactttaatttgtatatgtatatatttttttcttatacatcaagattgtataaataaataaatatgtatgtatgtatgtatgtatgtatgcatgcatgcatatactttacatacatacgtatatatgtatatataaatatgtatgcatgcgtgtatgtcgtgcctaacacgcaccgaagcggatgcgtggggaagtgggcgtagtggccgcgagaaatgaggagccgggcacggaggagggaaggataaaaacgactaggaggggttctcttcccctcctttaatcacttcaatacgccgcgtttctgtgccctagctctctccgttctgtgcctcccttgcgccacacgctctcgctcttctcgcctttccttcgccaatgccatgacgtggagctccgtgccactggatggcagaatccagcctccctctcgcattaccaatgagaggtttgtgccagctgttggagggtgaactcctcaagcaggggactaaggagcccccttctagttcggtcggggggcagcgggtgataatcgaggtttggtcgaaggagcgatgcagaaggggtcgggcccttaaagaacgatgagacaaaaggggtttatacaggttcgggccactaagaagcgtaacatcctactcctgtatttggttgattctgtgaggaacacaatgtatcagtcggttgaaatctgagaaatcatcccccttctcactaggcctggatctccttatacctcaaggggttaccacaggggcccaaaaacccacctagagaagaaggaaaacattatttacatttattacatgtcttatccctctgacttggaagaccatgagcacagcgcctcggcatggcccccatcaaatcatgctgaacgatacgggggacgtctgtatcattctgcattaattactgaaaacttccgagcactcgttcccaccagggaacgggtaccctcctccatcggtacacgccatgtgtccattcgcgtggggggattaggatcctctgacgtgaagtcagagggatgtggtcactgacatatggaccccaccactcgcggaccaacatgtcagtgattacgccagggagtagttcacgtcagaggatccggttccgcgcgggagagggacgcgcagacatccgctctaaatagcttttccgatcacccctgggggttgtcctggccagtggccactggggttccacttgcaattcttcaccgctcgaataaaaaaaaaatctccatcggttcttccttactcaggtatctattccctcagtcacagccactggcgattgttttctcgccgaagtcatgccctacgaggaggttacgactagagagagaattgtggcgtgggggagtcactgaaaccgtgaaacgaaagctgattatggatctggtcgtcggcgcgtcgagcggcgccgtgaagtcgctcgtcaacaagctgggcaccctcctggcgcaggagtacaccctcatctccggcgtccgcgacgacatccagtacatcaacgacgagctcgccagcatgcaggccttcctcagcaggctcaagcgggacgtcgcccacgacgagcagcgtcaggactggatgaagcaggtgcgcgaggtcgcctacgacatcgaggactgcgtcgacgacgtccgccaccgcctcggcggcgagccccgcgggaccggcacagttgtctccctcaagaggacgtggtacctgctcaccacgctgtaccagcgctgctgcatcgccaccgacatcggcaacctcaaggtcagggcgcagcatgtcagcgagcggcgcaccaggtacggggtggagaacctcccagcaaacagaaatggtggcggcaacaacaactccggcgctcccggagaccatccagctcctctcccccggctgattggcaccactgaacctgtaggcatggacgacgccatgaacgaccttcaaagatggttcatggtctcaaagcagaacagccaaatcagttaccttgctatcgtcggatccggtgggcttggcaaaaccacactcgcaatgtcattttaccgcaagtttggagatgagtttgattccagagcgttcatgctcgcgtcgcagaagtttcatctcccaacagttttgagaagccttgtcagccagttccatcagaagcaggtcagcgcttctgaggatgctcttcacggaattgaggaatggggagttgaagccctcaagaagaagctcgctgatcaactgcaaggcaagaggtagaggaatggctactatatattacggagtatttattttcattccttcatagtttttcttgacatttctggtttagcacttgagctaatctttggatcagtctcacacaagtttttagtaattaaatagtaacaccgaatttgaattatgatactacctccgtttcaggttataagactttctagcattgcccacatttatatagatattaatgaatctaggcacacatatatatctagattcattaacatatactgtatatgaatatgggcaatgctagaaagagttataatatgaaacggaggaagtagttattactgatttggataaggggtactttctccgttcacaggtaacagtcgttttggatacaaatagtctacaaaatgcaacagcatttttattgtatatatttataaaatccaataactttatgcagaatagaaaaacaaatattgataccaaagttgaaaaggtttaacaacatgttttgtgcctgggaggagtactacttcttcattcttttaagttcaaatattaaacgaagaagctaggtagtataaaatgttatttaaagagcaacttttacagtactttctcaagtactgtaaaatcacactctatttacaactacaagtaccatcaaagcacactctatttacaactacttacttctaaacaattcctgaacaggtaccatatcttgattgatgacatatggtctgtatcagcatgggaaagtattagggattcattacctaagaataataagggtagttgcgtaattgtgactaccaggtttaactctgtagctgaagcctgccgccgtcaaaatggtcatgtgcacaagctcaaacagctcgatccagtgaactccagcaaattgtttcttcaaataatatatgctaatgatccgtgtcccactccaaccattaatgatgagattgtcgtgaaaatgtgtggtggtctgcctttggccataatagtagtgtcagggctcattgctagtgaactgaaatcaaagattggaaagacgttggatcagaaattgattgaagtggagaaggctttaagtgcagagttgggaaacaatctcaccactgaagtagtgcggataattaaccactgctacaaaaatctgccacctgaccttaagacatgtttgctctacttgagtacgtttccgaagggccgcaatattagcaggaaatgtttgataagaagatggattgctgaagggttcgttactgacaaacatgggcagacggcagaagaagttgcagaagacaacttcaatgaactcattggcaggaacttgattcggcctatcaacaacagcagcaatgggaaggtgaagagctgtcaaattcatgacatggtccttgagtacattgtctccaaatctggtgatgagaatttcatcactgtaattggtagccactggcagacaccgtttccaagctacaaggtgcggcggttgtctgtccataaaagtgataggcaagaaactgatctagtagagaggatgaagttgtcgcatgtccgatctttgactgtgttggagagtttcaaagctcttcattctactatgctcaaattccagatactgcaggtgttggatcttgaaggatgcaaggacttgtcgtcaaaccagctcaagaaaatatgtaatatgcatcagatgaagtacctaagcttgcgtgggacggacatatacaagataccgaagaaaataggcaggctggagtatttggaggtacttgacataagggacacggatgtcacaaacttgcctgcatcagtggagaggcttcaacgaatggtccatctattggctggcaataaaaccaagcggagagcattgagattaactgaaggaatcacaaagatgaaaactatacagacactgtctgggattgagatctctggaaggtcaaccaggacagcagctggggagcaggcaccagttcttgaagtcatcagaaatgctacaaccaccgatgccaaggatggagatatcgcgggcttgcaaggtacccgtaaggaaggcagcaaggtggatatgccaaaacaattgcgtccgctagcagccttggagaagctcaccaaccttaagaaacttgccatttacaggcttgttaatttccaagcgaaagatgatgaattgttgctctctgctattgagcatttgagcagttgttctctcaagtttcttgcaattgatgacagtttcacaggctttcttgacagatcactgagttcttcacaagcacaaccagaacacctttacacccttgagctttctggcagcttgtttaaagtgccagaatggattgaccgcttgcacaaccttgagaagcttactctgtccatgacttcacttacgacagatactttggtgactcttagtaggcttcctgagcttttctctctcattttttcacttgatgcagcaaatggtatttcaaatatcctcaaaactgtgcagaagaatacattggagtcaggtggtaaaatctttgtgccggatggggggtttacaaagttgaggttgctccgttttacggcaccagtgctaccacctctgagcttcctagaaggggcaatgccagagcttcagaggcttgagctgaggttcagaatcattgagtttgtatacggcctggaaaacctttcaagtctccaacaggtatttctgacctttagcagccaggcacctgaagatgcgaaagagaaggtctctcagatcaaaggactggcaagcaagattcgaaaggctgattcctccaacattagtgtggtgatagatgagtacaacgaattatcaaaagaacaatagattacctagtcatgatctccacagttggagggaaccagtgtgttatcgatgtgttgtacctactccatctacagtctgtttttgttttatgattttcagatctatttacaattttttgtactgtttttttgttgagctgtggcatctttgttttgtctgctgtactcccaaaactctgctagtgaaaaaaaatatatcttctgttttcctaagaaaactaatcaatataaaggtgtttcaccaattctaataccattggcctacttaaagatgctatttatttgcctcgcaaatttcaacttaaaacaaatatctgttttcagtctctaatggggttcactgatccctgacaattaattattgcctgtagaaggattcactaatccaagttactgccaaaatttttttaaaccaaatttaatttctagtaattccagaattctaattagttcctgtcaagaaaatgaattctagttaaccatgtacttgtgtttattctagtcaacaatgcgtgtaacatgcatttgtttctacatccaaatattccgtaagaaaacaatgtatttacaaatactctaccttactggaatcaacttgtatagtgtcttgattttattttcaacgctaggagttctgcagttttttatttcattggagtgtaacattttttagtttatctattcctacacacaatctgttttacatcctcacagacgtgactaaatcaaccgtcttaactaaatatcaattttagtttttctctgcaattttaatcaggtggttgtggtcttgtggaactgccaacatcaccaattcatttcagttattttttttatgttgctcattttgcaatttcagttcatgtggtgtgtagtttcctagcttgctctgtatcaacctagtcgattaaattactcccttattattctttcgataatgacctctacatccagcatgtatcagaccataaattacccccttgtgttcctagccaccacttagagtagacaagcaaaataagagaactgaatcaatcatgtgtctgcatcgagatgaaaaacctagtaagccgtggtcctcctgatgagccatggtgctcgacctgccgatggttgggtggaggccgacgaaggaagacgtgaaaaggggatccgacctcggaggaggaggaggtgcatgcgcggagatgtagcggcgacgccggcgtggacggcacagggatgccgcgcccgcgcgtgggcaggaggtggagaaggggggcgccggcggggaggacgtgcgccgtgtccctccggtggccggagcggaggaggaaggagaggcggagcagatctgacggcccagattgatcttgcgatattgggccttcaagtgtctcctggcatgatggcagcacccttaaacgggcctccttcatgggcttttgttttggttgtctatgtgggctgtaatttctgtgggccttcacatttgtgggcctctaatggccatggccgtcatgtaatccgtgtggtgagagatgctcgctctcgccgttgccatggcctccaccgccgccgctctccccttatttttcacgaccccacctcctccagtccggtgaccggagaaggggaagaaagaaagcctagaagatccgacggcggcacagattggttggcgctctctcacgcgagtcatacatggtcgccccgctttgcaatgcgtcgagtgggcgaacaggggtgtccggatcgggctggagacgtggagatttgactacgcgcacaaggtgtttgacggaatgacgcacagcttcctagcagtcgaactaccttctgttctggaccttctggtcagtgttgttctacttcgattttactctcagttttgagttgactttatactgcaatgcattccacaagtttgaactgtgtaggtagattttggaacttcaggtttggtttggactttcatgtagaaaattacgactcaatgacagtgtaacacactctagggaatgtaaatcaaatcatagtttacaacagttaacatgatattgaagataaaaaaaatggcacaacagcgacacgcatgactgaacatttacgatatatatcttttttttaagggaaaacagcatatgtgccttttcattaaatatatatcacaatgacataatttataactatagttacatgacacaatttaaagtttatagatgcaagtggctaacagtaatacagaagcgaacgcgagtggcaagttgtgtttcttggctgttcttgtctgcaggctgctattattgtcccggacgtccaatgtatagcaaatcacaataacacaggaatctgttacagattattgacttattacacacgcaatctgcagcatacagctccgaaacaatagtattactcgcagaatcaactttgaacgaacacagcgacacacaaataaaaattacatatacacagtttgctcctgatcatatgtaattacatatatacacagcgaccaacaacaatacagaagcgaccatgagatgtaagagttattatctcaccgctctgtgagatgcattgccatttgccaacaacagtacagaagcttgttcctgctgtctgctcctgaacgagctgaagcaacgcaggctgtcctattgtcttttgacatctctctcacctcaggagtcaggagaggaggacgtcattccctgtggcaacaagtaattaagaagaagttcatcaactaaatttggagttagtttgcaggtagcaatgctagacaggttagcgtgaacagtgattaccttttcaataggagctaggcatggcactctgtttcaccttcatcttctatctcgctctgaaactctgtttctctcctcggtgccgcttcatctgctgcctgaacaacatcctccggcgaattgacttggttgaatcttgttgcaccctctgcctcctcctcaccagcttgattaacttctatttgcatgcctctgatgaaaaggtcaatagggttgcgatgcttggcgacctccttgctcactgcctctactttcctcttaatattggggctgttcatgtaccgtacgttgtagcaaagagctacctctgaaagcattttaaggtttccgatacctgaaggaacactcatctcgctcataggggatgtgtgcaaattcagtcgcagatatgtgagcttcggcatagcctcttcttcgaaggtcagccgtgggacagggcaatcaagggagaatttctctagttctttgaaccctttgctctcaatcactatagcttcttcaggaatgaactccaagcctagtatcaggcgctgtaatttgaccaagcccgcgaggatcttcacatcacctgccacttgtttacagaccgtgatctgcaagaaagtaagatgctcgagcccttcaatccattggggaacattggcgaattttccggctgttactttaaattcatcaagaaatttaggtggatcacttagagaacgcaggaactccatggaacaaccgagcccacaatgaatggttaaggacttaagttgcctccattttcctaaggatgacaatagggcttgttggtaggctttgtcattgcactggtgaaaggcccatgttattgcgaggatcttcaagtcgtgtagatcaccgagatactttactgacctttcggagaattcacttaaatcaatgagaaaatgtttcaacatttttagccgcacaatttgctctggcatgtgctttatttgtgtgcctcttaggtccagcatccgcaaagatcctggctcgcacacttctgatgggatctcacttatgtgggtgtggctgatgtccaatgcattcagggtgcgcagctctttgatttgtggtgggagcttgctgacctttgtgttactgacgctcagataactcagcacaagcattttgcatatctgcagtaggtcctcatccttcaaattctcccagccttgaagatccaacgacaccagatatccaaacttgtctagagggactgttgttctgttgactgcaccagatatgagtagtgaacgagtatgagacaaatccatttcttgcagcatttctgggagctgtggatcgggatggtggagagctagacgacgtgctatccgagtgttcttgccaccacctcttggtgctgagttgagagttgcgctggtaatgacataacccttctctgctgctctgtaagcaagaaacctcagtatgaaaggattgacctgccacaggcacaagtcatcttcatcaagattgtgtccacagttccttgctgctggggtgattatattcctgtcaaccatctcagagaaatgcaactcagacaacagcccttcgtctagccatttcatgacaagacgatccttctcaaacacatatccctgtggcaacatgcttaggtagagtaacgattgtctcaactcatcactgtaatcaaatgatagccagtgttcaaactgtttcagcagcaggcgtacttcttccaccctaggaattgctgagctgccgtgttgctgttgatgttgtttcaaccaatcagccataccagttatgaacgatggtattcctctacatttcatcaatatttcatcacataatagcttcagattttctggagggcaatcgtccatggaaccaaaagcttttatgtggagcagcttctctgaatctgagtgactcagaggcttcatcttatgcacaatcccattataatttgacaaacaccaccctgctatccgctcatcgccagccgtaaacaatattctgctaccacagttattattaggaaatgcacccttgatcaattccaaatctgattcgttgaatatattatcgatcaaagcgaagtatctggagggacaatacgaagagaaaatattaacagaattcgagctctgatgctgtactgtaagagaagtcgtaaataagtagtgctatataattatagcagctgaattaagcaagcagtaaatgttgtttacctcttatccttgaggcgttctgatatgttgcgagccaacagctccaggtcgtcccccaacatcgtgatttctgagctgtttggtgatgatggtgcctccagttgctctatgatctgcttcaggatggtttgaggaa

SEQ ID NO: 73664 - DNA, 2628 bp, Oryza sativa
  unsure (1)..(2628): unsure at all n locations
aaagggcagatttagtatatcaagttaacataaagtaaacataatagccaaattaggtaagatcggctgaacggnnncngggggaaaaatgcggcccttaattcttcttaataataaaaccaaactagatattatgattttaagtattacttaataggttggattcactgaatgaagcattaagtataaatagaagtataagatttaaacaagttgatgaaagtattttgagatggtagatgcactatataatctaagtcaacgttgatatctaactctatcggctgttacctggtagtagatgctagccgatctagggttacatagcaatattgatctagattatatagcacatatgataactcggcaacttacataaacaagattagagtgtcataaagatggaagcactaatcctgagaacgcaagccgccataacaagctttacctcttgtcggagatcgaacccgatgcagcccaactcgaaagcaagaactcgtcgaaaacaaacgaaagtaaaagggtggcaatgcgttgagattgttattgaactgtgcgttaattgattacatgggtttgggctactttaatacctaaagtacacaatatgtccttgtcggacacgactcctaactctattacaacttaggatacaaacaagtccctaaggcggacttttaccgactcaaagtttaaggaaattacaaaaaatattctaattaatagatacaattgtcttcccagaactcaatccatgcgtggcaatccatatgaagcacattaacccgatccgatgacgtatacccagtcatattgtcggaatcggctcaatcgacaaccttggccgactcgaactctaccgatctaggtcgcagccgattcgaacttcagccgactcttgctctgtttccgaaacaatcgatctcttagattccgcttcgattttatcttcatctccgatacttgaattaccaaatttagtcgttaacaacagaacacttgatggagtagatcctttgtcactgggtagagcagattgctcaccgtgacatggagaactctctcgacatcagaagccatggtgagtggctctgataccaagttgtcacgacccgaggccttgacgggataaacaccaccgggaggatagccgggtgacgttggctcctagagaagagatgtagatttaggctagggagaagagcattatcgggagaaaaaagactaattgatattcattgcttaacttgagatgaatacaaaccatcccttatatagagatgatatgacttgacccttaagaaactaactcagactaactctatctaatcttgtcgtatctcctaaccaactgctacagtactcgaggtactgttcatccactaggacttgggcttgtgggcctcggccttctgcccaatgcctatgacactacaacctccttttgagcagcttgtcctcgagctgcaacatatagcagacttctagacgtacacgactccctaaataaaacttaatataattgctgcaactatttgtcccggaggttgtgacccccaagatgcagccctgctcgtcagcatcactccccctcgccaacaacggcgccattgccaggaccagtggaggatcctctggaagcgtaccctgtccctcgctccctggctgttgctgcaatctaatggccacggaccacgtcgacttgaacgacaccgtggagggaatcaccacccatggctggttggggagcaaccccttcttaggtggtcacccatgggtgaccttgatccgcttgcaccacttcaagacttgtggatgtggttgcagtggagaggacagacaacgctgtctgcatgcctccaaacccgccggctgagttggaggtgtagagatcggtgacggcatcaccatgcccactgccatgtcctgctctatggcctcctgcttgctatgccattcctctttcttcaccagtttctcctgaattaaggtcgccaattccttgagaacgaccctcaactcctcgatgcttttaactccttgatcctggttgtggaggtctgttcgtactggagatacaacagccatcgtagatgttgcggccatggaaggctttttgtgcatactctgcatccgcatgagattggaatttaattgaagcctccacatctgttctcatctgctgcatgttgatcttctctgctccataagcataaatgttgatgcgaaaaacatacactggcctgagagatttgcttaactctagtgcaggacctaaatcttgcttttgggtttaagggcgtgccagttggtttgatcctgcaaccaacaagaaacaaacaaaaaaacatagttaaatccataaacggtagccgatcggccacatgctgatgacatatcgtttgtaagttagccgatgtaacgtgaattagatcggcaatgatatataaagcaaaaagaaagttaaatctagtcgatcggctgtagatattaacagtatataatctatagattgaaatatgtttaaaccaagtgattaggatagatcagaccagcttgccgagacagtataaatcacttatgtttaaaagtacttcaatgtaaagattatatatgtttatagcatag

SEQ ID NO: 73665 - DNA, 6310 bp, Oryza sativa
ttcctgcagccccactgaagcgatctcgaggatgatagcgctacaaacactgtcagggattgggatctgcaagagctcagctggagcacttgcagacatgcacaatctcaccaagctgaagaagctcagcatctataacgtcaaagacttcgacagcaagaacctgagtcatgaattgctgtctgccatcgagtacctaactggctgttcgctcaagtctcttgcaattgatgatggtttcaccggatttcttaatctgatggattctctatccactccaaaatacatccacacactcgagctttcaggcgaactacccagagtgcctaaatggatcagtgagctacaaaacctggagaaattgactttatcattgacatcactgagcacagatgctttgtttatcattgcccaacttcccgtgctcttctcccttgcgttttcggtcagtgcagcaagccaggaccacggtgtcatggagatcctgacgaagaacacgatgaattcaggggggaaaatcctcatcccttctgacggatttcacagcctccagctgctccgtttctcggcaccgttactgccactgctaagcttccttgatggcgcgatgccgaagctacagaggctggagctgcggtttaggatcttggaaggtgctcatggtgtggaaaacctagctagcctccagcaggtgcttcttagagttagccagcaagctcctgaaactaccaaggtgcaggtgtctgatatcagaagttcagtcagcttgcatcccaacagacctacggtggtagttgatgaatactacgggtgatcaattatccccttcttattcttgcagattgcagtgttgtttgaacatgtcatttttactgtgcctgaatcatcaaaataaataacaatcctactggtacgggttttctcctttttctagtttattttttgagctatctcatgctgtgacgcgtatttctagatgtctttgactactactagcatcgacatgggagacctggaatacgcggtacttcgataatgacctggaatacgcggtacttcgataatggttgtgtttagatccaaactttagatccaaactttggatccaaactttcaacttttttcatcacagtaacctgttatacatacataatttttcagtcacatcgtaccaatttcaacccaaatttccaactttgaaggaactaaacacagcaatatctctgttggagcttgtgcaataagttaatactccttccgttccattttgagtacagccatgattttctgtgtataactttaaccgtctgtcttatttaatttttttaaaaaaataattaaaaacacaaagtattattcatttttttatcatctcataacaataaaaatactaattataaaaaaaattcaaataagacggacggtcaaagttttgcgcagaaacttatggttgcacttaaaattagagagagggagtagtattagagcagatacaatagcaaactataatctagctatacgacattttgagaagataaaagaggagagagaagagtagcgggctatagatttgtagccagctgcagcacaggctctaagatgcatgtatgtatgataagtgagaccatgtattaattgtgtactatatactctcttcgtttcaaaatgtttaacaccgttgactttttagtacgtgtttgaccattcgtcttattcaaaaaatttaagtaattatttattcttttcatatcatttgattcattattaaatatattttcatgcacacatatagttttacatatttcataaaattttttgaataagacgaacggttaaacatgtgctaaaaagtcaacggtgtcaaacattttaaaatggagggagtattatagataactattgtatgaattatctattaaattgactagtattaaattgactagtagttgacttgttcttagtactactagaactagaactagtcacttgagctggttttggggtcaagtgcaaattgtcggataaaaaaagggagaacattttcattatccaacagcgtatccccccttcaatttagcttggttatgctctgcactctgcactccaaattgttgctcttttggtcttctccttaatacaaaagatattcgtgtttttctgtattcacaagaaataatttttaccgttctgtcacagtttacattttaaattgccacacggcttcgaccatcacagaggaaacatgtaaatatgttttggcctgcagatcttggtgtttagtaactagtagtcctcgttggattgaattttgggaacagctatgtagtctattggtatatatcccaggttctgaatcgacgtttcacgaagagacttgtgaactgccagtgtagtgtagagtgattttttcgaaaaaaaaaaactctcaattcctttttacttgttatcgttgactcgtactatcactaataattcttaagatctttcaataaagatggcatctcatggtcgcgcgaacgcgcaactccgagtggctaagtacatatggaacaaattcaccaaacgtccctcaactttagatcgagtttgtatgacatctctaatctctaataccaaaaatctttacccctaaactatacaaaaccgtgcataaaggaacactttacactatacccatatactagattcccagttaatcatagaaatcttcttgttctttcgttcaaggaaaacaatctccttattatctcagaataaaataataataagacgatttcttctcatatatatatgatttgcatctgtgatcatattaggttgtgtttagattggtccaaagtttgaaatttggttgaaattggagacgatatgactgaaaagttgtgtgcgtataaaaggtttgatgtgatggatagttagaagtttgaaaaaaaaaactttagaactaaacacaccatgagggaaatcaaatcaaatactacgtactgtatttcgtttatttaaagattagagacattgcttcgttggactaaaaaaatcatgagagatcgattgcttcattagctcaaagtttcaaacccacacgaaaaaactcccaaagtaaataaaaaaacgaataaagaaaaaaaccgacacgaacggattccacgtcacaatcctcatccaatcctctcacatcgtaaagcgtgcgatagaaagtccgcggatcgacacgtcatcatgacgagcaaacgaagctcgacacgcaccgtttatctctcccatcctttcctattaacccaatgacatgtgggaccagaaaatgcaaaggaggttgtggccccacctgtcagtgagatagtgggtcacgagaaggtagttagtcaaagaaaggtaagccttatctacacatcaccatctgcttgttgccacgtcaccccatatctcctctcgcttccttgccttcgctgtcttaacagtaccaaaattaccaaaaaaacgcccacagatttcttcattattacacagatttcctcagaattcggaggttaggggcatatatgaaaatattagttttgttaggggtcaatctgtgagagaggtcaaccttttgtgcccataaaaaagcaacgtcctaacgtaacggcaacgaccaccgcttcgctttccgtcgcgcgcgcgtttcgtcgaacaccacgccggcgaccacgacatggccaccgccgcctcccgctccggccgccgacgcggcggcggagacgacgaagacgaccggacggcggcgatgcgacggctgcgcgtgctgtccctccacctgcaggatccgtccccctcgtcggaggcggggctggcgcccgcggcgtgcgcggcggcggggaggcggcgggcgacggggggagcggacgcggcggcggcgctggcggcgtacctgagggggaggcaccgggacacgcaggcgcgggtgttcgagttcttcctctcgcggcccgacctccagacgcccgtcgagatgtccaccgccgcgcaccgggagctctgcttccggcagctgtgcgcgctggtgcgggaggccggggtgcgcccgctcagcctcatggcgaacgaccccgccgagtacttcgccgtcatggaggccgccggcggcgccgacatctccctcggcgtcaagctcggcgtccagtacaggtaaaggattacaaattgagtaatactaaataattagtaattgactagttcctgtcggtgctgaatgttctgcacgtctcatggtttctcttcaaatttttttcacgctcaactgcaatttgttatacacttatactaattgttaaactcaatcaaatgtatgcttcctcgaagagttcgtgtgttccaatccaatgggaactcaataaatctaaaaaaaattggtaatagttagctggttactggtagtctggtagtgatcttctttccttcttcttcttctttttttttttaccgagatgaataattgaggaaaacaaagcgaccatgcgatgtaatcatgtaatacatgctaattgtgttttcaccttcgcaataattaaagcattattgctgtgattgcgaaaggggggcttgtacctatcgatagctcaacgagatacagtactgctgctgttggctgttggcaacaatatgccaatattgcatttgcactcttccacgagggcaactattgttagttgggttgttagttataagggctatgaaaagcaacagttcatttataatacgaaattttttgtttctcttttgtaatggtttgatattaaatgatggtcgtcttttgcaaccgtcgagtgtcagcctgcttacttgctatgataaagagagctaattaattcttgattttgatggctcaatcaagcatcaaaacgtgcttgagcttgcttttggaaagcatttttgttggttattagtttttaggccattttatttacaggatgaatgatagcatgccaagctccaaaaatgcagatgatcttttaccctttttttaacaaagttattttttaggagctttgcattggaaattcactacatgacctgcttgttaatgcagcctttggggaggttctataataaatctgggaaccaaaaagcacagagataggttctttgacggaatcgacaatttggattatcctggctgttttgctatgacagagctgcaccatggttagttcttacttctatttactcactaactaatcattatcactgcttggttgctttacactttatcagtccaaacctcctagttcaacctccatcccattactgttatgtaccatattattttggttcttccttacacagtcggatctgaaccctgcaccaaacaacactgttctgttctcaataatttgagaatgaatattcatgcccatgcagcctgttagctcccatcatgataatagttaagtcctccacacgttactatttcatcttattttatttattttcccttcttaacaggatctaatgtccaggccctacaaactactgctacattcgatccagttactgatgagttcattatcaatacacccaatgatggagctattaagtggtggattggtaatgcagcacttcatggaaaattcgctactgtttttgcaaggttaattttgcccctccaaggaaaaggtggggaccctgctgatatgggcattcatgcattcattgttcccatacgggaccttgacaccaatgctgttcttcccggaattgagatcaatgattgtggtcacaagataggcctgaatggtgtggacaatggtgcactgaggttccgttcagtgaggatacctcgtgataatcttctgaaccgattcggagacgtgtcacgagatggaaaatacacaagcagtctgccaacaattaacaaaagatttgcagcaacccttggtgagcttgttgggggacgcgttggtattgcatatagttctgtaggtatactcaaagtttcagtgaccattgctgttaggtatgctctgcttcgacagcaatttggtccacctaagaagcctgaaatcagtgtgttggactaccaatctcaccagcataagctaatgcccatgttggcatcatcatacgcatttcactttgccacacggtacttggtggataaatactcagaaatgaagaaaaccaatgatgaggatgttatggctgatgtgcatgttctttcatctggattgaaagcctacataacttcatatacagcaaatccattagcgtatgccagaatcatgtggtggccatgggtatgctgctgtaaatcgttttggtgctttgcgcaatg

SEQ ID NO: 73666 - DNA, 11943 bp, Oryza sativa
ccattgctactgtggtccacttgacgaatgatattcctactgatgagctcattaaagtagtcgtcagcaacctcttcgacggtttttccatgcttctcaacaatgaaaccttcagctatccatcgcctgaccaaacgcttcctgttgatgctgcagccctttggaaatatgctcaagtaaagcaagcagttcttctgatcagctgacaaatcattgtaacagagattgagtatctgtgttactccttcaggagtaaggtggtgtttacatcatggacttaactttagtccctgtctttagacactaatttagagtattaaatatagactacttacaaaactaattacataaataaaagctaattcacgagacaaattttttaagcctaattaatctataattagagaatgtttactgtagcatcatataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacaaggcctaagattcatctccagctctgaacttaaaagaatcttgcacctttgtccaatggctctttgaccttgggtctctggccagaagtcctgccaccgcaactattgccagtggcagaccaccgcatttcttcagaattttgtccttggtttccctgaactcgtccgggcatgaatcatcaccactaaagattctttcattgaacagtcgttttgatttctcatctgaaagccgatctagcatgtggatgtcacctgtttgctgatgagtgctggcgtcagctacagatttgaaccttgttgtcaccactattctactgccattgttatttttgggcaaagatccccagatgtattcccatgaagatacagaccagacatcatctactaagaggaagtacctgttggagcaacatgcacaaatcaaatcaggatcattatgacacaatgatgcacacatcacaattgtttttcatgataattcctcttcttacacaatgaactagtaaggtgacccgcgcagattgcgcggctagcgtcatttttttttcacacatgaaacatatattttcatattttatttttaaaagatagtaaaatgggagcataactctactcctcttataatatttattatttttttaaattccgaatttacattttatattttttttacttctacatggactcgaaagataattgttaggaggtattgttaaactaaaaaagagattgttttgatgttagaaatggttggctaatgtgttttaggccctgtttagttcctacataaaaattttacacccagtcacatcgaacgtttgaacacctgtatgaagtattaaatatagggtgaataataactaattacacagattgcgactaatttgtgagacgaatcttttaagattaaatgcttcatgattttataatttggtgctacagtaaatatttgctaataacgtattaattaggcttaataaatttgtctcgcagtttactaacatattctgtaattagtttattttattagtacctgaacaccccatgcgataccgtatataatacccgatgtgacacgcaaaaactttacacccctgtatctaaacaccccctggaaaaatatgttttttctattgaaaataataaatggataactcaaaagattattgttttttactattttgaaaaaaaaagtaagtgagatattggatcgatcgctgtacctagcgcacaaaagttatgaacaaagctgaccattaaataatccttagattgcttgcttaatactccctccgtattttaatatatgacgccgttgacttattgactaacgtttgaccattcgttttattcaaaattttcgtacaaatataaaaatatttatatcatgtttaaataacatttgatgatgaatctagtcagaataaaataaatgacaattgcataaaattttttgaataagacgaatggtcaaacgttggataaaaagtcaacggcgtcatacattaaaaatatggaggtagtagtatatctagtgattacccataataaggagcagtagttgttagtagtagtaatggtgctacatttaatactactaaatagtgtcaaatatccggtatgacatgattaaaatttagtgctgatcaccttagtcattgaaatatttattactgaaacttgtatgtttttagaccctatgagaacataaaaaaaaaatacagatgtacccttgaacttctatgacccacatgtcagcccaacccttctctcactgattcgcttctctcctcccccatcgaacacatcgatgcggcgccgccctctcttccccgtccgagcggcgccgcccttttcccctccccaccgtgtccccttctccggccgccagcgcgcgtccccggcaccgccgccggagtggatcgaggcggctccgtccccggccgccaccgtaggtgcggattgaggcggctccctccctggacgccatcgcaggcgtagatcgaggctgctccttccccagccgccgacggcgggcgtccatggccgcgtcgggtcctgatcttctatggagcttatgcacgcgctagcatcgacgcatcctcccccaacagcctctcaactcctctccggatggtgagcgcttcagtgattattttttttatttttttaatgatttttgcatttctggaatgtcggcttaatctaatcctgttggacttagataggatgtgccagtccgtttttcttttttttatttttttaatgatttttgcatttctggaatgtcggcttaatctaatcctgttggacttagataggatgtgccagtccattttatttcgcggaccttgttctgcatgtacggacttcatccattaatagcatatcaaaactcataatctcatctgttgcaaaatttaccgattcctacattctcaatatcgctttgattctccatgtttgaccttttgttgtcaactcactaatcttcttgtatgccatagtgattccagcaagaacaattcctgggtgcctttttgattgacgaagtggattccggtgagaacttctggcttgcagatttgtggcgtgctggcgagaagtttgaacggcaagaacccggtgaatttgctaatttgtggcgtgcttgttgatgatcacggcgacggtcactgcaagaagtttttttttggcttgttgaagatttctggtttgctttggttagcttgttgaagtatttattgacatgacaagtacttatacgattcggaaacggcaagagtttgattagagtttaattaggattggtttgtctttcaatgtttctaaaagtggtgtgaacatgcggattcccaaaacattgtcagtttccaatgtattgtatgactcggttttccttattttcattttgactgattgtccgattaatctttttttttcttcagtttttaactaattctaatcctaatctagttctatttttctttttccttattcttttggattaatcttattttcgttttgactgattgtccgattcatcttcttttctcctttctttagtttttaactaatcctaatcctaatctagttctatttttcctttttcttatttttttgattaatgtgagaatttctaggttgtgagagcgaacatggaggcttctttttctattactttaaagatataatagattagtggacagacagaaccataaattttgaatactaggaagtacttcatttgactgtgcttcaatggtgtcctagtactaacaattccgaaagattaagcggaatgctgaatttcttgctcatattcatatatggtggagaatgaacttcaaagttggtattcatctccattagttacgttagttgagaatgcagttatcattttagaaatggtaaattgcaacttgggtttagccttaggcatgtatggtagacacagaacatcagaattcacaaatcaggatcaatctgctgtagtggtagcctgaagttattttgcagatttgctaataaaattgagggcattctagcaacttttatccaaaagaaaaacatgattaataacacattaccatggcaggaaatataattaaatacataattacgaaatttttattagaaaaaaagccagagaaaaactgtgtttctccacatttagttatttttctataatggatagaaatcggacctctatattctccgcatttaatcattgactggattataaaagtaataactcagcactaaagaagtaaagatgatagcaaactatgtatagtagtatgctccctctgttccataattccaagttttggacaataacacgatcttcaaaatatatatgtttgactatgtttttttaataataatatatataataaattaacatatttttacttttattataatactttgtaagataaatctatatatgtgttgatttagggtgtgtttgcaagagcaagttcccaacactctcctctcgttttccgcgtgcacgcttttcaaactgctaaatagtgtgttttttttacaaaaagtttttatacaaaagttatcaaaaaaattcatattgatccatttttgaaaaaaaaattagttaatacttaattaatcacgtgttaatgaaccgctccgtttttcatgtataggagatggtttctaacacctatctccaaacatagccttaagtgcatttaaactaaatagttttaaagttataaaagtttgatgactttaatattatccaaaacattaagaatcatggagccgaagggggaaaggagtacctcttttgttccaaatgtgctgtgagcttctccttaagctgcttgtctgtccatctctcgatccctgcaagagagtctccatctgtgctctccttgtcagggacctgaggcatgacttgcctgaggatgcttctgagcagcgccgcgagattgagcttctgcgacgcctgcacgcacgcccgggactcgaacttctccccgaacttgcggtgcagcgccaatgccagcgtcgtcttgccgaggccgccgaatccgacgacggcgaggaccctcaggtcgggcagcccctcggtcagccatgccccgagcttgccgatggcgtcctccatccccaccgactccgcggcgccgacgagctgcggaccaggctgggggcggtcgttgacgtggtaggaaggggcggatctggcggccttcccgttcccggcgtccggccggccggggtccttcacaccgtacctcgtgcggcgctcgccgacgccctgcgcgcggttcttgaggtcgacgaccctggcggcgatgccccggcgctcccagagcgtggccacggcgtacctcgcgcggcggaggccggacaggaggccctcgccgcgtggctggccgccgaggcggtggctgaagtcgtcgatgcagtcctcgatgtcgtaggcgacgtcgcgcacctgctccatccagtccccgggtctgctcgtcatggtggtggccggcggcgtggccgaggttgaggaggaaggcgtgcatgctggccagctcgtccttgatgtactggatctcgctgcgaacgccgctgatgagcgtgtactcctgggccaggaggctgccgagctttcccagcagcgacctcatggcgctgtccgaggcgcctacggcgagctccatcttgttctttgcctgcccctcaccgccggcgacctcgatgacgagacgagatgaagctacactacggcactacgcccaacccaacggacgctggagtgcactgtagcctgcagaggactccatggggacgagcaggtataatagcaggctcagctatacatatactctcttcgtttcaaaatgtttaacaccgttgactttttaagtacatgtttgaccattcgtcttattcaaaaaatttaagtaattatttattatttttatatcatttaatttattgttaaatatactttcatatacacatatagttttacatatttcacaaagttttttaaataagacgaacggttaaacatgtgctaaaaagtcaacggtgtcaaacattttaaaacggagggaatatattttaaagagataaagaaagatagagaagagcagcgagctatggatctgtagccagctgcagtacggactctaagatgtaatgtgtgtgacaggtagaatcaggtattaatagtatagtaagcaactattgtataaattggctattatattggctatactattaaagttggtttagttgaatctatgccactgtaaatatatcaatttagataaatatcactactattcatttattcctatatgcagaaaattctatccgtgccactaccgtcatcttttccgtcgtaaatgcagaaattctatccgtgccactactattcattttctgcataaattcatctattcgtatatgcagaaaattcatttatgctctctctcctcatcccaacttgatttgatttagcaaagattgttgtgtgtttgcttcgcagcttcgctgcttgtttcagtgatttcaggagcagcgcaccgtcaatgcgatcttgttgcaagaaaactactagcatctatccaacttgagtagagagccctttgttagttgcgatctccagggtgcgtgcgttaggactgatcgggaaacctcgtcgaacaaatatgagtagactagatctattgtggtggtaccaaatacgaagttctccttctcattgaaaaacaaggtgtgcctgtaaagcaagtgcccctaacaagaccaatccatattaccgagaccaatctcgctagccgcaagagagaggcctatgttcaaggaatgaatctttttttataggaaggctggtggcatacgaagagagggcgacagaacatttgcattccctttctttgattgagagaaggataaagcaggggatcgtgaaaccgatccccactccgcctcacgcgccctgatagggggcgcccgccgttcaatggctgtgggcccctctcacgaagtgccatataaaagagggggagctgttggcgcacgcaaacaaacgttcgtcgtcgtgcacacgcactccccacaaaccctagaacccaccgatccgggataggcgctgaagtgaggggaagcctaccgtcgggatcgccgtcgcctacaccgtccacgccaccggtcgacctcaccatcatcatcgacgttgtccacgccgccgaccccgggagcacccacaggcaaagctacattgtcgccatggccgcatcaacctctaagggcaaaggtacgtccctcacatctctctccctcttccccgttcattctctaagtgcatcactactattgccatgagttagtctacctctagatccacacctaggcaaacactaagatctaacaatggtatcagagccttaactaggtgtagatctggtagggttagaaagagaaagaagaaggggtctcagatcccgaagaaaagccaaagaattaaaacaaaagcaaaaaaaaaaaacctacctctcccaccgccggttgtcgccgacgctgcgcgggaagtcctaccgccgccgctagctgtcgccgacaggcgcgggaagttccaccacctccgccggctttcgcctatgccgagggtagtacgccgccaccgccggctgacaccgatgcgcgcggggagtccaccgccgctgccgccggctgtcgccgacgcgcgcgggaaggaagcggggagaggaccgcaaggggcgtcaagggcaccgtcgcaatgccgctcgacgtgttgacagaaaacacgaggcctgggagatctgcttaactccagtgcaggtccaaaacttgccttcatatgtgtgagcgtgccagttgatttgatcctgtaatcaacaagaaataaagacaagagaaccgtggttaaatctataaatgatagccgatcagccaggtgccgatgacatatcatttatatctgagccgatgtcatctgtatatcgatcggcaatcgtaaataagtaaagaagaactaaatctacttgatcggctgtaaatattaacgatatatgattcttatgtcgatgtatacttaaatcaggtgattggaatagatcggtcatcatgccgagacagtataaatcacttagaccgaaatatacatccacaacaggactatatatatatatttatagcgtagccgatcagatagatctagcgtgtatcggctaatactccgatactactctatattaagatattgaagcaataataatatatcaaacaagagtttaacatatttagttatggcagtatcttgacataaagggcagatttaacatattaatgaagcaaataggataactgtagttaaatcagatacgatcggctgaaactctgatgctattctaatcgacaactaggtggcaggctagagatcaatattctaagcacgacttaatagatcaaactcaattgatgcagcattaagtatgaaaagaagaacaatatctagacaatcaagccgctagaagattcatagaatggtagatatcttatataatctggatcaacatcaagatctaacctaatcggatgccttctgcatacagatgttggtcgatagtagattagatagcgatattgctgaagattatgtaagatatatgataacttgacgaattatataaataagattagagtgtcataaagatggaagcactaatcctaataacacgatccgtcataacgaattttaccttttgttgaagatcgaaaccgatgcagctcaacccgaaagcaaaaactcgtcgaaacaaaattaaagtaaaaggatggcgatgcgccggaattgtattgaacgtgtgtgttaaaaattacatagggctcagggtctatttatacccgaggattacaagatatgcccataccggacacgaccattatctctaacaaactctaaatatcacgtctttgcggcagacttttgcccacacttatctataaggaatttacataaaacatcctaattaatagatacaattgccttcccaggactctatccatgcgtggcaatcatcttgaagtacatcaacctgagcccgacgccgtgcacaagtcgtattgtcagaatcggctatatcagcttatttagcttagctcaacctcagccgatcctagccgtagccgatctggactccagccgattcctgctttgttccagaactcgatctccgcctccaactcttcttcgatcaaatcccctttcctgacacaaatgctaccaaatttggttgttaacacgacggtggcgcgctcagcctagggcgagcgtgcgcgccggcgaggggccctgcggcggcgccgccatcacctccagctgccaccgaccgtggccacagcgaagagaggagggagaaagagaaatggcgctagggtttttcggccggccgggagggagggttttgttccccccgatctcggcggtcagccgtccgatcgtaaccctagcgatcggatggctgaaaaaaggcgcttggttggtggctgtgggccgaacgtgccaggccggccaaagtctgattttggttcctcgtggccgaagcaaaaaaagaaaaagaagttagatttggatccctattttagaagcttttattatttatgtttattgaagtatttatttctaagcaattttaaccaacgtgaaaattgttcagggagtaaaaaattgtaagaattgcttctgaacatgtatgtaattttaagtttccgctgctataatgatgtttacaagttttccatgcattagttctatttctgcccaacggtgatgtagaattaatgtggtagtatgttgtatgttttaattttgaccaacgttaaattaaaacatacaagagttttatttgtttcttgatttatttaaatttgctttcaggaacaactaacccacttgtgtatatctcggccgttgagccccttaatgggaataattaaggctcatggcgagagaagattgagatagcacttgcgctgtctaatatagatttagctctcaccgagccctgtcccactgcgccagttgcgccagtgagggcggagggtgagagcgaagatgcttttaagcagagaacgttggaccatgctccaatagtatagaagtacgacactgatcatgcgaagtgggagtcttccaaccgcaagtgcttgatggtaatcaagagctcaatagtggaggcagtaaggggagcaatcccagtatgcaccaccgccacagagtatcttcagagagtggagaatcagtttactatttcttcaaaggcttatgcgagctccttaatcaagagcttagttactatgaagtaccatggcggagatgttagagagtatattttgaagatgagcggtatcacttcaaagctcaagaagatagacttggttctccctgacgacttcctagttcacctcatttttgcctccttgccttcagaattcgagtcatttgctgtgaattacaactcattgcccgaaaactggaacattgagaagttgattgccatgtgtgtgcaagaagaggatagacccaaaactcgtggtgattctgcaaattatgtgaagaacaagaagaggaacaaccacagtcagaatgtcgcctctcccaaagcacgtggaaaggcaccacaggttgatccaaatccacgacaagaagtggagagggacgcttgcaggtggtgcaagcagaaggggcactttcagaaggattgccctgaattcctgaagcatcttttaaaaaagggtgagacatcattacattcgtagatgaatccctgtatgtaagttattcaaaatccacttggtgggttgattcaggtgcgactattcatgttgcaaattcattacagggcttccatacgaggaggatgctagcaagaggagaaagatgcattagagttgcaaatggtgtcgaagctgaagtcgaagctattggagaatatccattaaagttgaataatggcttcacactttatttgcacaatgtgctctatgtaccctccttaagtagaaatttagtttccgtttcatgtttggcggatgatggatataattgctattttgaaccagatttatgttcaattatattcaagaataagtgtgtgggtcttgccatccgagaaggccaactttacatggtgtctgaacatgagaatgcgaatgttgtatgcaatgaagagaatgttgcgtgcaatagtgtgtctttcttatctacgaatgtaagaagtaagcacaaaaggtgcaatgaggaaacctcggcaaaattgtggcactgccgtttaggccacatttcgagggggagaattgaacgattgataaaagaagaaattttgcatccattagactttgcggatacagaatattgcatcgattgcattaatggaaagtatgttaaacaaataaaaaaaaggagccatacgaagtttagaaaaattggaaatcatacacacagatatctgtggcccttttccaattaagacagtggatggttatgattcatttaaacattcacagatgattattcgcgttatggctatatttatccaattaaagaacaatcaaaagcattggataaattcaagattttaaggctgaggtagaaaatcagcatgatctaaagattaaagtagtaaggtctgaccgtggaggaaagtactacggtcggcataccccttatggccaaatacctagaccttttgcaaggtttctacaggaaaatggcatactagtccagtactccacacctggcgagcctcagcagaacggagtagcagaaagacgcaaccgtgctctaatggacatggtg

SEQ ID NO: 73667 - DNA, 16021 bp, Oryza sativa
gtcatgaatttgacagctcttcaccttcccattgctgctgttgttgataggccgaatcaagttcctgccaatgagctcattgaagttgtcttctgcaacttcctctgccgtctgcccatgtttctcagtaacgaacccttcagcaacccatcttcttatcaaacatttcctgctaatattgcggcccttcggaaacgtactcaagtagagcaaacatgtcttaaggtcaggtggcagatttttgtagcagtggttaattatccgcactacttcagtggtgagattgtttcccaactctgcacttaaagccttctccacttcaatcaatttctgatccaacgtctttccaatctttgatttcagttcactagcaatgagccctgatactactactatggccaaaggcagacaaccacacatcttcacgacaatctcatcattaatggttcgagtgggacacagaccgttagcagatattatttgaagaaacaatttgttggagttctctggatctagctgtttgagcttgtgcacatgaccattttgacggcggcaggcttcagctacagagttaaacctggtagtcacaattacgcaactacccttatcattcttaggtaatgaatccctaatactttcccatgctgatacagaccatatgtcatcaatcaagatatggtacctgttcaagaattgtttagaagtaagtagttgtaaatagagtgtgcttttaaggtagttgtaattgtaaatagagtgtgattttacggtacttgagaaggtaccgtaaagttcctctctaaataatattttatactaccttcttagtttaatatttttatggggaatatcttcctttaatatttgaacttaaaagaacgaagggagtagtactcatcccaggcacaaaacatattgccaaacattttcaacttgggtatcaatattttttccctattatattctgcataaagttattggactttataaatactagaaaaaagatgcccgtgcgttgcaacgggaaacactaacgttattaacttagtaaaataataaaaaaatgagctcttatgatctagaaattcacatgttaaaaaataaggagaactcattgtagaccaggactctttcattttgtttttttttaaatcgcattgcccaatcgaatatgtacataaaacaacttaatataaagtataaattataaattagaaaataaataatattggatgaggactctagaatattctccaaaagaggctagggtgcatataggaatacaatttagaaaaagaattaaaattcaatatacaaaatattgaaagaagagtttagagttcatatatagaaatacaattagaaacaataaaaaaataggaatatttgaagaagaatagagaccatatagaattaaaaaataattgatattatttaattttagtctaaatttaaattttgtatcacgacaaataaataattatatttttagtcagaaaataaatccatatcatgaggaaaacaatttagttagaattaaaataataagtagtcataagcaattataatgggcccttttatggcctaatgggctaataggcctatagaaccaacgagccatcaagcccagtaggcagaatagactggaggcccaatagtgtggcggcccaatgaaggagaagccggggccgtccgatcgaatggacggtccaaattgatcccaaactatatatatactctgcagcaatccctaaccctaaaaattcattttccccctctccgcgcctctaatcccctcccccccccaccccaacacacacacacgagcggctgctgtggcgccctcgatcccctgtctctgaaagcgacagcggcgccctcctcccccctccccgagcggctgcggcagcacttagcagcagccggcgagcagtgacgggctgcggcgcctctccacccctcgcctcctctccctctccatggggccacggcccacgggagggctcgaccgtggcgggcggtggcaggcggcggcgctctccccaggaaggaagccgacggcggcctggagtccctgcgacggcgacagcggcggcgacctcattcgatctaatttttggatatatttgggtatatgctttctccaattttatttgtatgactgaattttgattgggattttttttttaggggggggggtggattgaattctgattgggatttggggggttgcgacggacgaaaaatttgcgtacgtttgaggtaacgaacggaaaaatacgaatcttttaattagttaagatatacaataaaaatgttgttgaaaagttgtgttttgtagactatttgtatccaaaacgactgttacctgtgaacggtgaaagtacaatttatccagatcagtaactatcataattcaaattcggtattgctatttaattactaaaaacttgtgtgagacttatccaaagataagttcaagtgctaaaccagaaaagtcaaggaaaactatgaaggaatgaaataaatactctgtattactccctccatccctaaatatttgacaccgttgactttttagcatatgtttgactgtaagttcttattaaaaacttttgtgaaatatgtataactatatgtatatataaaagtatttttaacaatgaatcaaataatagaaaaagaattaataattacttaaatttgtcgaataagacgaactcaaatatattttaaaaaaatcaacggtgttaaatatttagagacggagggagtatatagtaacaaagccaaaatctatacctcttgccttctagttgatcagctagcttcttcttgagctcttcaactccccattcctcaattccttggagagcatcctgagaagcgccgacctgcttctcatggaactggctaacaaggcttcttagaactgttgggagacgaaacttctgcgacgcgagcatgaacgctctggaattaaactcatctccaaacttgcggtaaaatgacattgcgagtgtggttttgccaagcccaccggatccgacaatggcaaggtaactgatttggctctgctgctggctgttgtgcttcgagaccatgaaccatctttgaaggtcgttcatggcgtcctccatgcctacaggttcaacggtgccaatcagccgggggagagaaactggatggtctctgggatcgccggagttgttgttgcctccaccatttgcgtttgctaggaggttctccaccccgtacctcgtgcgccgctcgctgacatgctgcgccctgaccttgaggttgccgatgtcggcggcgatgcagcggcgctggtacagcgtggtgagcaggtaccaagccctccggagggtgactagcttgccggccccacggggctcgcggccgaggcggtggctgacgtcgtcgacacagtcctcgatgtcgtaggcgacctcgcgcacctgcttcatccagtcctgccgctgctcgtcgtggttgatgtcccgcttgagcctattgaggaaggcctgcatgctggcgagctcgtcgttgatgtactggatgtcgtcgtggacgccggagatgagggtgtactcctgcgcgaggaggctgcccagcttgttgacgagggacttcacggcgccgctcgaggcgccgacgaccagatccataatcagctcccgtttcagtgaataggtataggaacctgagaaagtaagaaacggtggataactttttttttttctttttgattcgaacgatggagaattggaaatttggaaccccaggggcagggatgggtcatgggcagggttttaaatcttcctctatagctatttgagaaagactctagttatttattctcatgtacaatttagctgctatagctctatttagcctattatatatagctgccgctatagccttttgagaagttaaccgctaaatgtcttaacccgttatttaaaatattggtcatgggtggtccagccgctgggagtgggattgaccgagtggggcaatcatgatgccataatgaggcctatgcaattatctaattattttaatacatgattttctttaaaatttgttaaacaaccatcatgttgtgttaggattttttaaaaaatcaagccttattgtcatcaggtttataattttacagtttttaaaagtcacagcaaccaccacctcttacttctttcctccccttgattccccactcgctatggctttatcttttatagtttttaggaatatcgtctaatgccgccatactagtacattatggcgtgtctgctgcccattccctttattatcgttaggatttaaatatggaataagtttatctgaggtcccttaacttgtcagcaaatccaattttcgtccttcaacccgaaaaccagcccctcaggtctcaactatcaaaaccgatgcaaaataagtttcaagacggtttggatagcggtttcagctgacgtgacgtctacgtggataatttgactcagtcttcatctgaggtggcattaacatggtgcttacgtggaaatttgatttcaaaaataataaaaactatgacaccacaaatcagttatataaaaaaataatataaaatggtggggcatgtcattctcaccctcttcttcctcctctctcccctccactcttcaggcacgacggggaggaagcggcgcgcgacggccggtgggagaggaggggcgcacggcggccgacaagagaggagcagtgtggcggtcgggccgacctaaggccagcaacgacgaggctgttggaatgtaatctctttcccttcattaccaactccccttccttctcctcccgatcctgtttccataaatcggttgagtgagtatggaaagtggatgcctatacatgtaatgctccgtgatcaattcattatcgcgatgagtcattcctgtctaacatggaatcaatcactcatcgatccttcgcttctgcataacccgccggcgtcgctccgccgccgtgcgtccacttccgccggtgcaccctcaccggccgtgcgttcccggcgacatcatgtcgtcctcttccaccacccctccctctccgaaatcgaccgcgatcgattctactgccggtgccgtcgcagacgctgttcgtgcggccttcgctgttcccgtcggtctggagatcgaccccactacggcaaacaccgttgccgagtctgcggcgacccgcgcctctgacgccacacgtgaggccctctccgtcgccctcagtgccctcgtcttgtcaccggttgccacggttgctgcgacctctggcgctctcggcgcgacggccattgccatgcccgcggcgacactccacgcgtcgtccctacccactgcgacgatccacgcaccgccgcccgcggactccacaccgccggcccttgccaccctgtttgcctaggcacggctcacccacggcgccgcggcgccgcccgttggtcacatccggcggccggccacgcatgcagccctagcagccctctatgcccaagccgtcggcatcctcaacatcaaggccctcgtctccgtcgtgctcgacgtcgccaccgccaaccacacccggtggtgtggactgttcttggcggttctcggcaagtacgcgctaacggaccatgttctctccgactccttccacttcgaccgtgccgattgggtccaaatggactgcgtcatcctcacgtggttgttcggcaccatctccttcgacctcctgcaagacgtcctcaccaccaacaccactgcccgtgtcgtttggctaggcctcgagcaccatttcctcgggaatcaagagcaacacgccctcaacctgacaaccgagttccacattgcaacaaggcgacctccccgtctccgagtactgccgcaagatgaaggccctcactgatgactgtggcgacctcggcaaacctgttcgtgaccgtaccctcgtcttcaacaccctcaacagcctctccgacaagttcaaccatcttcagtcgccgatcctcatgcaacgcccgttcccgatgttcgccgagctttgctcccttcttcgcctggaggagatctccaagtcaccgcactccaccaccacttcggccgtcttcctcgccggcacctccaacaacagtggcaagacctctaatccagcgcacaccaccggttttggtgcagggaatcaaggcaacaaaggcggcggcaacaactccaagaatcgttgtcgtcgcggcggcggcggcagtggtggaaacggaggaggaggcggcggcggcactccagccgccaacaatggaggcaacagcgctaagtcgggcgctggcggcgcccaacagtggctgacgccacacaacccgttggccggcacaatccacatgtggcgtgctcggcccaaggccggccgggcctcccttcgctggggctgcgcttgccggcccagtcggcgcccacccggcccaacagtggcaggccacctagatgcatggggcgcagggccaaccagcccaataggtggtctcccagccacccacccccatgggctttcaacagcctatgggttggttcgccggtgctccctatcaatgggatcaagcgtctctcgcgggctctttcaacaccacgacacttcagcagcccgccacgaacgaatggtacatggacaccagtgcaacggcacacatgacatccgactctggtaccctctccttcacacaacccccaaactctacatccccctcccacatcgttgtcagtaatggctccactattcctgtgtcgtccatagggcaaactgacatacatcacccgaagcgctcctttatacttcgagttactctttgctctccacttattatcaaaaacttgatttccgttcctcggttcgttattgataattggtgttctgtcgagtttgatcccttttgtttctcagtgaaggacttgcgcaccaggaccatgattgccaggttcaatagctcaggtccgctctaccccctccaccaagccttgtctccatctacagccgccacagctctagccaccaccaccaccgacacttagcaccgtcgtctcggtcatctcggccatgaagctcttgctcggctctcctccgttgtgcccatggccaaaggtggatcccctagagtttgccatgcttgccagcttggacgacatgttcgccttccttttgccacttctgtcactagggcttctagcaattttgagttgatacattgtgatttatggacatcccccgtcattagagtttcgggtttcaaatattatcttgttattcttgatgattgttctcactatgtttggatttacccacttcgctttaaatccaacaccttctctactttgccccacttttttgcctatgttaaaactcaatgttccaccaccatcctcaacgtccaatgtgacaatggccaagagttcgataactctgccgcccgcacttttttcctcaccaatggtgttcacctccgcatgtcttgcccccacacctctccccaaaatggtagagccgagcgcatcatccgttccctcaacaacatcgttcgctccctactcttccaagctagccttcccaataccttttgggttgaggcccttcacaccgccactcacctcattaaccgacatccaaccaaaacacttgaccaccgcaccccttttttgccctttatggagtccatcccacctacatacatttacgtgtcttcggatgcaagtgttacccaacctctccgccaccaccacctgtaaacttgcaccccgctccaccatgtgtgtcttcctcggttatccactccaccacaaagggtacctgtgttttgatcccgccacaaatagagtcatcatctctaggcacatcgtgtttgatgagggttcgtttcccttcgcgactacaacgacaagtgccactaaccttgattttttggaggattctaccacccctgtgcaggctcctatcggcgccaaccgacgacctgcagctcccttgccagccgccccaactccaccacaggctgcccatacacctgggtcagccaccgctgcatcaagctcaagtccagctccctcggcctacaggatgacgctctctcggtcggctgggccatccgtgccgcaggccacccactcacctgggtcatccgccctgtcactaggccgacgcgcgttgctccacgatgggccgctgacacatgggccacgctccaccgagccatctccttcgactggcccacgacaagactactctgctgggtcgtccaagtctcctgggctgaccgaagcagcacaagccgagccagaggttcttgcacccccatgcccaagtctgcttcctccatcgcatgtctccattcccacttggccaaggtctgctcgtgtggccggcgtcccgaagccaccatccatgctcgacgcttcccctgtcgtcaacgaccatcacatgtccactcacagcaagcacggcattcacaaggtccccgaccggctcaacctccatgtcgacacgctctccccgctcccgaggacgtacagggccgccctcgccgatccgccctggcgctccgccacggaggagttctccgctctcctcgtcaatcgcacatcggagcttgttcctcgtcctcccaacatcaacgtggtgataggaaagtgcattttcaagcacaagctataggccgatagctcccttgaccgctacaaggcttggtgggtccttcgtggtttcacgcagcgccccggtgtcgacttcgatgagacattcagccccatcatcaagcccaccaccgttcgcaccgtgctcagtttggcagtctctaggaggtggcctattcatcaactcgacgtagaacgccttcctgcacggcaccctacaggacatggtctactgtatccagcctcctggctttgtcgacaccacccaccccgacatggtgtgccagctcaacaagtccctctatggcctcaagcaagcaccccatgcgtggtacagtcggttcgcctccttcctgctgacgctcggcttcgtggaggccaagtccgacacctcgctcttcatcctctgccgcggcattgacaccgtctacctgctcctctacgtcaacgacatcatcttaaccacctcctccaccgagcttctccgctagtccatctcggctctgcagtccgagttctccatgaaggacctcggcgacttgcactacttcctcggcgttcgggtctctagcagtcctctagcctcctgcttagccagcgccagtactgtctcgacattcgggatcgggctggcaagacaaactgcaagccctgcaccacccccatcgacacctccgccaagcactccgccacagatgatgctccggtcgccgccccaacggacttccgcagtctcaccagggcacttcagtacctcaccttcacacgccccgacatcgcctacgccgtccagcaagtctgcctccatatgcatgatccaagggaaccgcacctcgctgctctcacacggattcttcggtacgtccgtggcatgttggacctcggcctccacatccagccgtctgcagcaacggaacccgtcgtctactccgacgccgactgggccggttgccctgacacaaggcgctccacgttaggctacgctgtcttcctcggcgacaacttggtgtcttggtcttccaagcgacaagtcacggtgtcccactctagtgttgacgccaagtaccgcgccgtcgccaacgccgttgccaaggtcgcatggctacgtcagcttctccacgagcttcactcgcctccgcccaaggccaccttggtctactgtgacaacgtgagtgcggtctacctctcgagcaacccgatgcaacaccagcagaccaagcacatcaagatcaacctccattttgtttgcaagaaggtggcggttggcgcaattcgggtccttcatgtgcccacttcctcacagtatgccgacatcttcaccatgggacttccttcgccgattttctcgaagttccgttccagtctcaatgtccactagcatgacgttgcgactgtggtggggtgttggaatgtaatctctttcccttcattaccggctctccttccttctcctcctgatcctgtttccataaatcgattgagtgagtatggaaggtggaggcctatacatgtaatgctccatgatcaattcattatcgcattgagtcattcctgtctaacagaggtgaatgtgcgacattgagcttgtggttggacggcgacgggagggaggatttggaggaactggcagggctatgtcaaagaacgtgagggaggacgagaaggactgtggcccttccttcaccgctcgccactgctggggagaagcaatcgtcacgcgggggtgggaagatgggtgttcgtcatgctcaaccctgacccagggagaacatccaacactggggttggggagatggatggacgaccgatgactctagatctgaatgatggccggggactgtgcactctatccagtcacggcggcgatactgtgagctggtgggcgcaggcggtttttttgctccgggagtccagggaggcaacgagcaagtcagcaaaaggaacatggaatgccggcggcggttgactttttgctccatgtcgctcactgttgaggctgatgtgtgtctcgactctcgagtagattaacgcggtccagcaggctgcaacaccgacggcaacgacttattgtgttggtggtggtgcgccgccggcatgccacgaacgtcttcgtcggcgtcggtcttcaccgccgctgtcggtccctttcgctgctcctccagcacccgttgcccagcatgtgatcgccggaagtcgagcgacagcaacaccgacggcaacgacttattgtgttggtggtggtgcgtcgccggcatgccacgaacgtcttcgtcggcgtcggtcttcaccgccgcagtcggtcccttccgctgctcctccagcacccgttgcccagcatgtcatcgccgtaagtcgggcgacagcatgaggccggtaggcatgacagacttgtgagctcgacctccaccaccctctcggtctccggcggtgttggtggcggcgcaggcgacgacgaggagaatggggagaggagatgagatagagaagagagggaggagagaagagaggggatgaggtggaggaagtggggtctcactatttcctaatcttattatttaactgacatgtgggcccatatattttattttacttttaaaattgttagattttgcttcatatgccacgtcagatgaagaccgagtcaaattagccacgtaggcgccacgtcagctaaaaccaccgtccaaaccgctatgggatatatattgcaccaatttcgacaattgagggacccgttttatctggttttcctgttgaatgacgaaaatcggattcattgacaagttaatggatctcagatgaacttattcctttaaatattgaaccttatcattgttggagtttctatttttagtttctacaagcctcgtcaatcgttgtcaccctactcctttacggcctgtctgtggcccttcctctttattatcattatgattttagaaatcaaacttaattattattgggattatgttttatagttttagatgtcccgtcaattgccgcaatgctactccttgacagccaacgttttgtccatcctgattttaaaaattgaacctgatcatattggttttggtttttttattgcttagtcctttgccatttctcggtttgtcctctcaatgatataatagaattttttagtctaaattttaattaatctcttgttgtattctagatgacctcttctttttatattccttatcattttatttcaaatttcagttatatctaattatatttctacttgaactctcattttttctaattttggattttactttattttttattttgaaattaattaatcttttgttgtgttctggatatagtattctttcaatattccaaattttagacatttttaaattttattcctaattgaactctatttttttcattgctccaatcaatgtgaaattttttattcaagattttagttatttataaattatatttctactggaactcttttttcttttctaattttataatttactttattttttattttgagttttcattaatcatgttgtgttttaggtagcctgtgcaatagcgtggctagcgccaattgaaatatactttataacacaaaattatcttttcttaacacattgtcatctttttttaagaacttcatggtcatctttaaagtttgttaaatggacgacctatcttgggattaaaaaattgatacttatcatcatcgtcgccacgctcccaattttatttcttcaactctcaccagtgtcccccgtgctactcctttggcgcctctctacttgctggcgcaccacaccttatatgtattgtccttgagaccagctgagttcgtttctcagggatgctaacctctctcctttgttttttacgagcgcgcttttcaaactgctaaatggcttgttttgtgtaaaaaagtttttatacaaaacttgtttaataaaaatcatattgatctatctttttttaaaaaaatagctaatatttaatcaattacgcgcgactggactgttctatttttttcgtgcacaggacatgtgttaccaacattcagcttgtcttgctgcgattcctttttatagctttttgaaatcctgcccgttgcccctcttttccttatttttaaaagttccgccagttgttgtcgatctactccttaatttgttgccattcagcttgcctccacactgccgaagaagaggatagctagaaaatgcagcttatggcagaggcggcatgcagccagcttgggagaggagatgagaagaaagcgacgtatctggtggggggagagatgagtggataagggtggggaagaaataagatgttccctgctttagttgcgcgcaaacattagcgaaataaacttactcgcctagcttgcatttggcatgcatctgcaatcagtacagttgtttgttgcaataattctgttctgtcgtgctgtaccagctagccgtacaacaaaagaatagaagaaaacaatgggttttcagcccaaaacctgcaaagaattttcattaacttttttaattataatgtatagtggtcctaatggttcaatttattatccagcttctaataattgttgtatcactgaagaaaaaggtatttacccgttacagcgcatggatatcttttctaatatattaaaaaattgaaaaagaaaagaaagcggtatgcatgtgtatattaaataatctgaaaaaagtggtttcgtttcgtttgtcacgctagagaggacaaagaaaagagtaagggccggggaacatatggctcgtcgacacattaccgaagaagaggatagctagaagatgcagcttatagtggaggcggcgtgcagccagcttgggagaggagatgggaagaaagcgacgtttctagtggggggagagatgtgagggaagagataaggtgttccctgctttagttgcgtgcgaacattagcgaaatagatttactcgcctagcttgcattcggtatgcatctgcaagcaatacagttgtttgcttaatgctacctttttgccaacatttggaatgccctaatgttacaccatcgatccataagaaaacagtctttttccccttcttttaacttctttgttaaagcgaaggaatagaaatatatgaacacatatataaatccatatgaatttttccaagaggtgtgagtggatgcaaaatctcgtttattttctctctaaatttgtaggaaaacgaattttatataaaccaaatgacacttacgaattaatccttagaatctaaatcctttctctttggttcaaaccgaacaagccgagtttagggcctgtttggggagcttaaaattctgagaagcagttactgagaagctagctggtgagaatctggagaagctagaaaacctagcttctggcttctagttcattttacagattctacaactacagattctcagaatctgggtaaaaagctgaactgtttggaggagcttcaggcaactggagattctaggagaagctgcagccagggccgttcctatgattttgagggccctagacgaactcatcatgatgggccttctaagctatatataaaattttatgatatatatatatatatagacgctaatttttcttgcaaaatgaaaacaaatacatccatatataaatttaacatgtctggtaattattgataaaaagaagtcgaccaaaataacaatatatttgtacatgggaactaatatcattatcttaataaagaaaagaacccccatcatatccattgcttctcatgaaaagaaagttattcggacatttcttgatgcaaaatcatcaataacggtattaagatcaatattgtccaaaatatccttctcgatagagcacatagctaagccatttaacctttcttgcgacatagttgatctcaaatagttcttcaacaacttcaattttgagaaacttctttcagctgaagctaccgtcacaggtatagttaagagaattcgataggcaactgaaacatttcgatagcaatctgcatccataacaaacttcagaatctcaggcacggatatcgaagaatctggcaaactcacttgcaacacttttaattctgaataaaaatcattgatctcaacatcggataagttctcatgagtaaatatttccacaaaaatcttgcaatgcaaccaaagatctacttcatctaaggattttaaattttcagagttgaacaaaaacccaaaaacattatcaaatgctttcatctgctcaaatatattagtcagtgaagcaattgcagcatcaatcataactaggaagttctataaacaagtctataggaggacgacactccaactcctctcgtctcgacgtttctgcttctaggtaggccataggcaggtactagactactagtattaggtgttggtcctcaccatcatgagcccccggcggtcgcatcggttgcataggaccagggccggccctggctgcagctgctaaaagctcctcctaacagacccttagatcctatgcatatggtgatggggtggtagaattactactcacaccacaactattctcctttaaaggagtatagagtgctagggtggaggggcccgcacatctgtcggttacatcgaccaacttaagtagtttaaactattccaagatagttttttttatcaagtattcctcgatattttggacgcataggattgtgaaatgacaattaaaatatttaagaaaattaaatataaagtgcatatttgggtaacacaaaacagacccttagatcctatgcatatggtgatggggtggtagaattactactcacgccacaactattctcctttaaaggagtatagagtgctagggtggaggggcccgtacatctgtcggttacatcgaccaacttaagtagtttaaactattccaagatagttttttttatcaagtatttctcgatattttggacgtataggattgtgaaatgacaattaaaatatttaagaaaattaaatataaagtgcatatttgggtaacacaatttaattgttttattactattttagtggagcttaacatggtcgtattagaaaattagcgcattaaaaatattcactattataagccattttaaatttgttttttcgggggaggctaattactatattttaatctctgagagtgaacgtaaagatccacacgtttatccagctagcatcaagccatcgagttcacttcaagtaattcaacacggtttaaaaatatacatgtatataaagtttgtttgtgacgtattaaaaaatggaaataaactaaaagaaaaaccgaaaaaaaa

SEQ ID NO: 73668 - DNA, 7423 bp, Oryza sativa
cttccatcgtccgtcaaaaaaaccgtgtaaaaaaaaccgggcagaaaaaaccaggtttgtccgataaaaaaaccggaacggaaaaagaagtccgatccagaaaaaaaaaaggggcgaaaaaaaccaaaaggcaaaacggacggagtccgatccaggaaaaaaaaggcaaaaaaaaaccaaaaaaaaaccggacagagtccgatccaaaaaaaagccgaaaaaaaccgaaaaaacaagggacggaaaaagccatgtttgtctgataaaaaaacaaaaaaaataagtctgactcctatatccttaacagtaaaaaaaaaagtttgactcctatatcaaccaaaaaaaaaagtctaactcagattggtgaaaaaaattgatgtgtcggattgaagatctgtttgcaaaaacggaatctacatgtcgagagcattccatttttatatgattttaatttttggatttgtaattttatatttgagtccctgtaatttttatatttgcatttgagtccctataattttgcaacaagctacttgaggttgtttttgttaaaaaaaataaaagagaaagagaacaaaggcagaaaggtgcataaaaagaaaaagaaaagccaaaaaaaagtctgactcagattggtgaaaaaaattgatgtgccggattgaagatcggtttgcaaaaacggaatctacatgtctgagagcatttcatttttatatgattttaatttttagatttgtacttttatatttgagtccctgtattttttatatctgtcatatattctcctgtattagaaaaaaaagcaaaaaagaaccttcgaaaaaaacaaggaaaaaaacgtgcgagaaaacaagaaaaaacacacgagaaaagaaaagcaaaaaaaggagaaaaatatggttttcttcgtaagtgaaaaaagcgaaaaaaaaacatggtaggagaaaactgttagaaagaaatgcgccttttcagaaaatggtttgagaaaatcgcgcaagaaaaaaaacactgtttataaaaaaacaagccgctcattaaaatagaaacattgtcattgacatgattatgcatgaaaaacgtatattattattagaatttttttacccgttgcaacgcacgggcatttttgctagtatagaaaaaattatgaccataccgataccattttcataaaacaatgaagaaaataatactgtttttgatcatttctaaccgttttcgtccctagcttagtgaccaagatttggctatatatgctcatttcatgattttatcattatcactgcacccaatccatattatttccattactataggaaatatgattatgggaaaaagaagaaactgaaaaaatgggtaaagcagatcaaccgaacctacagggatctgctaattaattggcgcacgcgccctccactgtgccacgtgtcttttatttttcacgattttatttcagcgcgatttttttccttttttggtgcgatttttttttcactattttgacgttcctcccctcggcgcattttccatattgatcgcattcttttcgattttttaaaatctgaattgaaagttttcaaatctcgagctgaaagttttcaaacatggacttgaaagttttcaatctcaaattgaaagttttcaaatctcgagttaaaaattttcaaatctgagttgaaagttttcaaaatttgtcttacaaatttaaattttgagttgaaaattttcaaaatttgacttaaaagtttaaatctgaagtgaaagttcaaattttgagttgaaaatataaaaaattgtgtttagagtttcaaattttgagttaaaagttttaaattttacgtgaaagtttctttcacatatagatttcttttcaatctgttagtaaaaaaatcttcccaaaaaaaataaaatattttcttaattatcgtcattattctaaactaaccgagttagttacgttgattcctccggaatcgcgcgctggcgcacgcgttagcttttccggaacctcgatagatatagattaaccatcaacgactcttcatcttatgtccatacaatataggttaatcatcaacgactcctattacgtttcttggttatcagccgcgattttgaattaattctaaggttgttatcgtatttttttagcattggattttaaataacacagatataattttttttgaatggtttatcaagtataggccaaaagatccgcgccgctggatccgtcgcccccatgcctcccctccgccagatctgcaaggggagggaggggaggggccgggcgccgccatggtcgcccactgacgccgctgtcgctgcccttctccccgtctgcagccgagggagaggaagggaggggctgccgccgctgtcgccgcccttctccccgcctgcagccgagggagagggagggaggggccgccgccactgctgtcgctgccggccggctgggagaggagaggagaggagtgggagagagggagagagtgaggtggcagagaatatcgagcagtggtcgcccagtgggcgcggagggcgaaggatatcgagatctggctagtattttcacgtgcgcagttaacaggcccgcacgtgaaaataggtttattttcgcgtgcaggcctgttaagtgacccgcacacgaaaattgattttcctgtgcggacgatagactagcgccggtttccccatttttctgtgcagttccacttatggatcgcatggaaacaaaattttgggggaggggggcggggcggggtccagaaatatcaatcatgtagtagtgaaagaacattatgttttcccaagaacattatggtttcctctgggaaaacattaggagatatgcactccttaggaggacacgatcagtgtataaaattgtttcaagtgatttacacattcggtttatgcagggaagaaaaagtcaacaatcagaattgactgattcatcggctgataatagttttcaactgcaaataaaggctggcactaattgagtttgtatttgctattcagcagcactttatcatcttgatcttttttgccctagagaaggctgcctccactttttttcttagctgcatagcgtgatttgcagtagttatcttctgttagttttagggcatgttcaatggcagatacgagtatgatcttttaaacaatataagattatttagagaccgtgtctttataattgttgagacgacaaaggctctaatcattaactcaaaaaatattccttttgttaatattctttccatctttttaccttcatgcaacaatatttccatattgttgtgattaagagtcattgttaagctgttgttatgcatgacaacgatattttgtctctcctctttctttttcttccatgtcaataagtattcctaattagcaacgctaaaagaccactattgacaactattgtacatgcccttatgttgcagcataaaaaacagataagtttattacatagatttgttaactatggtaattaggatagggatctcttgtatgcaggaaaagcatgcccttgttgggtatataagggggaagggcttatactgcatatataatgggaaaagtttatagaacaaggctgctattcacattggaaatttgcccttttttactttggggtgttcttgaaaaattgatttgattatccttgagggtcgtacaagatggattcaatatttggtgcttgaagttgatgcatttgttagtgttttttgaaagatctagatagcacttgatcattatttccctttttggaaccattatcctaggtaagactaatttcataaagtatgcttccttgctgtcaatattccaaaaaatgttccccccgacatgatgcttgtagtttacggagatttcgaaggtggtgcagaatgcttttataaggaaaatgcatttagcatgatgcgcactctaaggaaaaggcttgacatggataaaattatgacaaatattttcaatattttaggtaattattgtcgtgggtaggtttctgcatcgtctgacatgaaagacagatcaaggtgttaacacagtgaattgatagtgttaccgctaacatatagcattacccaaattcatgtagatgttagaatctaaacatatatgtactaccagacttaggaccaaccctgtaggagtgaaaccgtcagaaaaattgatcttaccgtcagaaaatgtattcctgtaggtgcgccatcagaaatcgccgacagaaaaaagaccaaggagaaattcaatttttctgtcggtttcccgacagaaatgatttttctgtcgggtattcctgtcggttggctcacagaaaatatcaactggcgtcaggtttgtgaaatgttaattgtgacgtggacccgtcaggaaaaaccatcaatcaccgtcagaaaaaatgtgttccacgcccaaaaaaaaaaagaaaagaaaagaatataatacacatgccaatttggataaatatatgaacatcaatctcaattcaaacatcaaaattcaagctttcaaagcttacatgaatagtccatccaagttcagtaccaacaaattcattcaaatcagagttagtaatacatgtacaatgtgttcagttactcaaggaagttcaatgtgttcagttacaattgtattcatcaaatacatgtacaaggaaattgtcttccagcagcaatccaagttctgtggtgcttcaaccttggccatgaaaccaaaaaggttttaaaaaagaggttcagttggcataattttcttcatcattacaaaataaataacaagcgagcaagataaatttatctgtacaagcatgaaaaatgaaatacgacacttgaaatgataagtggacctcacaattattccagtagtactctgccaattcagataagacatgaatgctaggatcaaactcattagatattggatgagaggcataccttgatttttcatgttgtacaacgttctacagatatttaactgcggcatttaagctgcaagctaaggtaaattataaatggtttgtacataataaaattttaaaaacaaagagactgaaattaattttgtttagatggcatgtatatatccaacacatgtatcagtatgtcttgccaaaagatatacatggatttagacgtgtgaagtatgtatatgcactaccagagtacaagagactggaaagcactaatgtattcatacatacaaacagagctaaataaatgttttgtttgttcctgaaacagagaaagcaaaacactatagtgttcatcattcacacaatcattaccatgaatgacaaggcaaaaatagcataagaaaagcatctgcatctgcattctaactagatttatttttctagggaagatattaaccaacatctaaattctaactaaatgtgaccaataaaagcatagtctatgataaggagtaaattctatatccaattctataaaaaaagaataatatccagatatattatcctttaaaattatcataaagctagtatcataattttctaagccactgataggttaattccatgtcaaacaaatcaccgtttcctagttttgcatgtagatctcaacataagctgcttcaaaacagcaaaataaaatgggggtattctgagtgagaagccaaaaataaatttacctcacattaatattccttggtctttcacccatccttcatagtgtcctccctatgcactatgcatttcagtagttaaatactctcctaaagagatggaaagacatcaactggcaggaagctcacgattcgtagaaagaactaggtctaatttgttcagctagcatagaaattgggggatttgtagagtatccaaaaacacaccaaaaaaaacttcttatgctaagaggtctaacaaggaaaatagcaacagatcttagtgatgcaccaactcagatctggacacaaggaaaggcaagggcggcttttactgaccactaacctgattaaaagagatgaggcagtgactaccgaggatcgggtggaaggggaatagctggcgcctgctctccccatggcaggtcgacctcgacgacgcggggtggtgtgagggacggcggaccgcttacctcgaggccggatctggagctggtgaagctagggtcgtgggatttggagtacccaaactcgggatggttggatccgcgacctccgagttcagggtgtccggatctggagcacctgagtccatggtggctaggaccggtcaccggaagggggagggtcggcggaggctcgtcgtcgaccggagatgagcagcgacggatggcagattgacagggcctgtggatggcgcagggcagcaacgtggttccccgttcatcggaggcgccgacactaggaccggcatcagggagaatagagagagaggaagagtagtggcggcgagccactgggaatgaggggaaaaaatttaggcattgtttcgataacgggattgggaaatgatttctcacccatcaaaaggtatctttaaatcctaaccattcattcttcctcttccatttaatcataacccttcattcattttccaatcccaatcctactctccatttcccattatccaaacacacccttagggcttcggttggatgagcaagttttatacgatggttatatggcccaccagtcagcgctgatttttctgtgagtcctagccacaaccgacagaaatataccaatttttctgtaggtataagtaaaccttcacaaaaactcattatttctgtaggtcgtctgcgggaccgacaaaaaatatctcagcccacaggcttgccctcaagtctggtaatggggtgtctaaaatcattaacatatatatgaatgtggacaatgctaaaatgacttatattacgaaacggaaggagtattcatttgtataattgtatctgttcgcagttgtgttgtcgatacaagttcataaggtctatgtatttgacatggtttcgattacttgtttcttaattggattggtcattacctatcatgtggtattaacttatatgcgaccttttaaacctaaatgaaactaaaggtgatcatttgatcagcaacagctagcacgtgttttttggttgctttgattaagacatactgtgtgcgcaagtgtggtattaacttgtatgcaatctttgtaacctataaatgaaacaaaagatgagcatttggttgacaacaggtaacatgtgtttaatgcttgttttgattaaagcatgttttgtgtgcagctgtgtgcgcggcgtgtcgtcgcgtgttcgcgttcatttctatttaacttactgttgttctttctaactaacaaacaattattcttactatcgttaaaaaaaagtgcgagaatgctcgatgtcaggcgcccggcgcgtggggggaa

SEQ ID NO: 73669 - DNA, 17394 bp, Oryza sativa
agcccctaaatagcaagatttcggagggctatttaatagcccggaggatccaaacagagcctatgtcttattgatctaacacagtagagtttcaagtatgatcattcactttttttcacgagattcatgttgattcgcattttaggccctgtttatatttcaccccaaaatttttcaccctatcacatcgaatgtttaaacacatgcatgaagtattgaatatagacttaaaaacctaattgcacagattgcgactaatttgcgagatgaatcttttaagcctaattgttccataatttgacaatgtagtgctgtagtaaacatttgctaatgacggattaattatgcttaataaatttatctcacgttttactgacggattctgtaattggtttttttattagtgcccgaatatctcatagaacaccctatataatatccgaagtgacagtaaaaattttacacccttatatctaaacaccccctcaaacaaaaaaacatcgcaaacttttgacaggaaaactaattagcgcgtacgcgccagatgagttagcggcacgcacgtacacgtgtcgctcacacagcgcagcgctaccgttattataagtaaaagccggaaaccagaagaaaaaaaggtgatgcgtggttttttttttcagattagcgagattagtgctgattttttccagaataattaggccgtaatctgcattcaatgattttacataattcaaggatttcaatgatttttaaaaaatcgacccaaaatttgaaactttcaacactaatttaaaaactttcaacttatatttaaaaatttttaaatcatattaaaaactttgaagtcaagatttgaaaactttcaactcaaaatttgaaactttcatctaaaaattcaaaaactttcaactcaaaatttaaaactttcaactcaaattttgaaatctttcagctcaaatttcaataactttcaactcaaaattcataattttcatctcaaaattgaaaacttcttatttgaaattcaaaactttcaacttaaaatttaaaacttttaaatcaaatttcgaaacctttccacttcaaatttaaaactttccactatttttgaaaagttttcgactaaattaactatatatgctttttaaagactaatgctaatgatggtaattaacgctaattgtcgtaatttgcggcacgaatgtcgtagcactgtagcaggggcgcgcgttggtgggctgaatgcccaggagtcggaatgaggctgctccactggtgtaccgtataataaccaaaaaagtgcgcgctacatattctactcgcgaatccgcgcgaactaggtgtcgcgagaggttgatacgcagtcactgaagtccccgttcgcaaaagagcaaaaacattaaccgcacgcgcaatcacaacgaagcctctctggtcaactctcacccgcacgtacgactacccacccacccacccccaccgaagctactccaaaccagtataaccaccgggccccacgcgtcatcctcccgcgcgtacgccaccgtcgcgtggcaaaagttcgcgaccaatctatacctcgctcgctcctcgctagtccaccaccgcacctaacagccgccaacctctccctcgactcgtcgtcgtcggcttcgattcgatcgatcgaggcgaggaggaggaggagctagggtttcggatgggaggaggaggagggttgtagaagcgcgggggcaggctgcggtggatcgtcgatgggggagcagccggcgcggggggcggcgtcgtcggcgtcggagtcgtcgccgctgatcccaccgccgtcggagatcgacatcgaggccggggccggggaccagttccagtgccggatctgcctcgagaccgacggtacgcgcagatccacccccccttccgcccgcgaggcgcgaccttatcgtgcgagggggatctgagtgctttgttggctcggtgcgtgtgtgtgtgggtgtgtgcagggagggatttcatcgcgccgtgcaagtgcaaggggacgtccaagtacgtccaccgcgactgcctcgaccactggagagccgtgaaggtatgaagcttttgatccctcgggcctccccgctgatctcccgcccatttcattggttgcacgttagctgttaataaattgggggagctgctgtttgctgtgcgctgagagaagttggggggttgtggcattcttggtagataagataccatgtttaaacctcatttgttgtgataactaattttagcgttatatgaatgctgtgcctaaaatgtagtttaggtgcgatttgctacaatttaagctatgattcttcataacgtagagtatccagagttgcctttgtcaacatttacgctttcaagatacatattttaattgcacaaaaattggcaggtcaatgttattttgctaagctttgtttcgtaagaaaactaactttgcttggcattttctttgtctcatgtacaggaaggatttgccttttcgcattgcaccacttgtaaagctccttactatttgagggttcatgttcacactgataggaaatggcgaacattgaaatttcgtttcttcgttactagagatatattattcatctttgctctagtgcagtttgtaagtccctctagatactctttgttagttctcgattgtctttattctaatgaatgataaaagagtttgttttttgttatttatttgttcaggtcatatctgcattagcgtatttggtgcattttattgatggattacagaattactggttgaggacagcctgggcatttgacaatgaagttagtttttattacatatgtggtaaattactttatcatatcaaacttgttatttcttgcacttagttttgcatgattgtttgatgaaattgtaccctgattgaaataattatcatgatagttcaccatgcatccatataactcaatcacatgggcgctgtaggttttacaaggttaaatgtgcagtgcgtacacgatgaacctcaatggctcaatcttgtttcatgtatgatgggtgagatgggcttgtaaaaaggaatttaagtgtagaaatgtgatatgagagtgaatgatatatgtatcgaataggaaagagcaagctacttttccctgtttaatgcatggtaattgttgtcacttgaatatgttatagtttgcttgtgacttattcgaggcatgtgtccttcgaaaccaagcacctctgcttctaatttgctataaccctataactaacaagaaactcctgacatgagctgctcatttcacccatttttacattaatgccttcagtttgattaattctgagctcttgctgaaacatcgcaatgaacagttttatagacatctagttaactttgttcggctcaataaataaatgccaataaattaactttgttcggctcaataaataaatgccaattatatcaaccaaactacctgagtgtagctcacatggctggattaatcaggaacacatgttcgttacatggttgagttgttgaactttctttgttaatgaggtgttcacaagtgataaagatgaagattaagtatgggcacgcaaaccaagaaagccattaatacatgattaattgaattttaattattttaaacttgaaaaatggattttatcgaatattttacagcaacttctatatagaaagttttcacacgaagcacaccatttagttgtttgaaaagcgtgctaacggaaaccgagggataatctgcccctttcatcacaaacgaacggagaattgggcaagctaggatattcatctgtatcatagccaagtatgtaaagaagtggatatatgatatgcatgtcgtattctccctactgcgtgaattcattgggctctgttacttatattatgaggaactaagatttgccaattgtgataatagatattatgtggaaaattcatatatactcactaaatctgtgggaagactcgctataagattcaccgtaccttctcttgcgcatattagtttaatctggactaaatttgagtattgttcttatggttacaggggcattgctattttttgctttgcttgggttatcaggatgcttcataacttgttatgaccgaagagtacggaatgacctggcacagccttgtcgagagttatgtctttgttgctgccaaccagggtatgcttcaactaatttagcaattgtattaacaagctactaatgctgcatgcttgtttcatcagcactgctcattgttcttttctgtttcaggatgtgtgcagattgccatctacctggtacgctttgcatgtggacagattgcactacatgctttgagggctgtgcaacgacagctggagagtgtggtggttgcttgggtggtgctggagaagcagggttaccattgctctttatcatgggagtaatcgtgcttggactattcacagttatcggcattttctacagcgtcttggtagcaaccatggtgggtcagcggatctggcagagacactaccatattcttgcaaaacgaatgttaactaaggtgagttctgtttgccgcttatttctcagtctttgactttagtttatttccttctgcacttaagctgtatctggttcttacaggaatatgttgtggaagatgtcgatggcgagcgcgcggattggtgtccgccccctctcccttcggagcatgtccaacagctgaagtctctggggcttctataatctgtagcccatgattataccaatgatgaccttaatttaggacttgcggcactatccagctgtacaggagatgatacaaattaagcggtgaagcaggcgtttcggtttttaagcagccaaatgcacaacaatatcgtttgtctttttttgtacattgtaacaagggaatacctatctgaaaaatgacaacagcatttgatttttatacgatgaatggtttcacagttttatttcgatgagctcatttcttgtgcatgttaggttggtgatctgaacaagggaaaatatgtgcttctggtattaggaaaccttgcaatgagttttgtctggtagggatgcctgaatacctgatgctctgtgtttgatactttggttggtgacagcttgagtagaaacgtagacaaataattctccttttaaaccagatgacaatacggtaaaactgtatttgaatttgaattggtaccagaaaaaccaagaatgcgccttttaaaccagaatagaggaaatttctactcagtcagtagtcttcaaagtgtggtaccaataccgcaactttttaagtggtgcttaaaaaaaagataaccgaaaaaaagataattaacttcacaaaactaattaaattatcgcggaactaaatatttaaaatatactttgattaaattatcgtaaaactataaatttaaaatgatatatcacaaaactacagttttaacaataaatcacgatacatcatcttaaatttatatttatagttttatgaaaggttagtcaatatatacgtagtttgaaagaaaaatactttttttaaaaaaagctggaacagtttgaaagaatttggcccatcgggctttgatttcacctgcacccgcaacgcaacacgcaccacttcgctctttctctcgcggcgccacctgaaccggagccggaggggaggagatctcggcggccgagcagaagcggcggcgctcgccgcggttgcggagggggaagaagaaggcgcggcggagcgtagcggagggagtagcagcgaggcgagcgccgagagggagagatggatcccgacgcggtgaagtcgacgctctccaacctggccttcggcaacgtcatggccgccgccgcccgcgactaccagaaggtgacttctctcactcactcgcggaattggctgtggaggttggtgtcggagccgggcgtgctgctggatggatctcggcaccagcgggggggaatcgaatctcggttcttgattgggagtggggttgacgggcggttgattcggccgcggagcactcggctcagctgtgctgcaggcctgcagccatggattgtggaaggtagaggtaacggggaagatgatctggtaacacgacaatgcgaatttctcgtcttgggaaagggcaggcacatgtatttgggcatttagcaattgggtggtattagcttgatctggtatttggttgggatcatggggaggtttagttcataaaggggatgggttagctccagtcctgtgttgatgttgcagggtttgaagaccagtgtattccatgctgaataggagtatgctgctttatgacacctcagtgtacacaaaaacaatggcgcttctcacgtgtagccaataaacatggatcaatttgagtataatattttggaagtttagaataacaaagagttggagtggatcatgatacatctggccgttcttttacatgttcaaaatgggttaccttcttaggccacgaatgcatgtcatgtaacatttgcaggtaatccttttgatattcttcctagatttacagcaacaaaatgtggtgtttgcatcaaagtgtagaggaaggtataactgtccttcatgcacacacttgattcttcactccttgcaatgtgatttgcaagttataatcttctctgcttatttgtgtcaactgcattttatgtccttgttgtaatgggggtaaaaaactgatccagcgggttgggtcgtgaaattggctggttggtggccgtggagccagtgtgctcctggatctcggaaccagcgcgtgatcaaatcttggtttttgattgggagtgaattgtagtctggtacacctatctttagaacttgtgtctgatttgcctccactcagctttgccacaggcatggattgtggaaggtataaccatagatcaacgtggaggatgatcctggtaacacaacagtgtgattttttgtcttgagaaagggcaggtgcattggatttgggcatttggctatgggagtggtgttagctcacgtgaaaagtcttgccttccagactgctctgtcctggtgttgctgtagcatgatccaatctttggctgggaacattggggtgggggacagttcattcggaggatggattagctccagtcatgtattccaggacaacaaatagagtgatggtgcagggtctagagaccagtatattctatgctggataggagataatgctttatggcacctcagggtacacaaaaacaagggtgctcctcccatttaggcagcctataaatgtggttagattggaatatggtttgcaagtttgcaataatcaaagttgcagtggatcattctccattcgggtgttcttaacttatgtatgttgaaaatggattaccttctgatgccttttgctctctcatgaattcatgttatgtaaaatttgtaggtattcatttttctatcaaaatggcctttctgtatattgacagcaacaaactgttgggggtttgcatcgaaagtatagtacaaaaggatataactgtcctccacgcacatcactcgtttccattatttatacttgattcttcactccttttgatatgattggcgagctatatcttctcttattgtttgtgtcattttcatttatgtccttgttataatgggggtgaaatactgtatttttacactcttgttccagtgctttgaacctcttgcattttttaaaaacaaacttgctttcaaaacaggctaatactactctctctgtccccttttgttttttttcctgtatactgacatagttaacatgttaggaaattgtagctaaagagaaagcccaagcagcaaatgcaagccatgatgaggttgatcttgatgaattattggatgtgagtttaactatagtatcttctatatttctcttgttttttttccttcagtttgaagcactgattacctttttatctatcatgctgtggaactacaactataggatccagagcttgagaagttgcatgcggagagaattgctgctctgaaggtactgatctgcacattgcccttgaaggttgtgaacctgtgtggataatcttcattttaagttattcattttcctgtgcataacagaaagaggtcgagaagcgtgaagtgctaaaaaggcaaggtcatggtgaatatagggagataactgaaggggacttcctaggagaggtcactggcagcgaaaaggtcatctgccatttctaccaccgtgaattttaccgttgcaagtaggacataatttgttcttttaaaaataagttgttttataattgacctgatgataattaattgaccctgatgataattcatggacacctatctaaatcttttctaggatcatggataagcatttgaagacccttgcaccagtctatttgggaactaaattcatcaagcttgatgctgaagttagtatgctatctctattagcatccagttacttgtattttattacaaagatgatgtctaatcttgtaaataactactccagaatgctcctttctttgtcacgaaactaggaatcaaaacattgccctgcgtgatattgttcaagtaagtgcataaactttcatcattttacccatcggatttggataacgtgtgcttaaatgtttggtgctccttgctataaccttttcatcatgcgaggaccaatccaatagtcagggttctgtttttgctctcgaactgaaattttgttctttaggaagggcattgctgttgaccggttagttgggtttcaagaccttggcagtaaagatgatttttcaacaagagcgttggaaaatatactcaagatgaaaggtatctctattacatctccatacacaattctgtcaaaacattgaaatgacaaatatgataacacacaataatgtaggtataatcgacgaaaagaagaaggatgaggacgatgaagacgacgaaaccgatatgtcaatgaacaggaggattaggtcttcaaccgctcaagattctgattcagaatgaacaagaggtgatacactccactgtgtcatcaagtttcttttgcactctgtgtgtttatgtaatatgcattccgagttgtatcaacccagttaggaaacgaggtatttgaaaatgcaatagctatagaggaatttattttgtgtactgtttagttagtttttcattcatactgccaaagtgccaagctggcctatgcgagtcggtacgctttaccccaaacagtttttcttttctggccatcatgctgtcaatgttttacctacaatacctgattggttgctatacatgaagtatcacataaacatgacgagctaagagttgaaaattggacgtaactacacagctagtgatagccagctaccactccatctataagagatactatctacctatatttcaaatgcaattttctcttaaactactcacccgatctacgatccgattacaccgttgtgttcgtaacaattaaatctttacaataagatctcacatgattatattttgatgaaaaatcataaattacttttatgatatgtctaaattacttttagatttcactaagttacttcttagatatataaaagtaaattcagtaaagcctaaaagtactttacatatattatagaagtaacttagagcaaaacaaaggtaactttggcatgtcatttgaagtaaatccgttgtacagataaaaacatgactctatctagaaattaaattaatcagcacaaattatagaattaactaaaaacaataataaaagtaatcacctcagagcattatgaatgtataggaagtattttaatcaaatctaaaagtaagttatatatatgataattatatatatgatagtttgttcaatgaaaaaaaggcattaattaaagttactttccttttgttataagttacttctataatatatgtaaattacttttataatatatgtaaattacttttaggctttacttaatttacttttatatgtctaagaagtaacttagtgaaatctaaaagtaatttagacatatcataaaagtaatttgtgattttttattaaaatataatcatgtgagttcttgttgtaaatatttaattattatgaacacaacagtgtaatcggattgtaaatcggatgagtaatttaagagaaaattttatttgaagcatagatgataggaatatttcccctacttacttaatggattagtaatatagtaaagtaagattcttcaagttaacacatatctggataggggtcgctcgttatgactaaatcgagagtgctctcgatttagattttgcgttgaaaattaccatctcaaaagcaattaaaaaaattgcacagctacgaaaaggaaaaaaaaagaaaagaaaaaagaagcaaactttcgtgcttctagaatctattgcctagacaaaggttgggtgattatgtgactgcaacaaaattgcgaaaacgcttagtatcgtacgtccgataacaacgaaactccggacgcgtagggacccacatcagaaacccatcccttctccaaccttatcctattcttcctcatccaaaaccaaaaccatttcccccatttctctcccctaccatggacttctccggcggcggaggtggaggcggccagcggcagcggcggaggtagcgtcgcgtccgggagggtgcaggcggagcggtgattggagatcgtggggaagctcctcgcggcgagggagttcgtcaggtgcaagcggttcgcagagcgcgcggtggaggtggacccgcccctccctggtgccgacgagctcctcaccgtcaccgacgtcctcctcgcttcccagtcggtcctccccttggtccacgccgacccgctcgctgtcatccagcttccctcggccaccaacccggccgaccacgctgccgtctcccacgcctaccgctgcctcgccctcctcctcaggcaggagaccaacccccacccgggcgccgatgtcgccctcagcctcgtccacgacgcctacgccatcctctccaatcccaaccgccgccctccgcccgccgttgccatcgtcgtcccccacactataaggttggcgaaggtgaggaggcttgtggcaacgtcgacctagctagcgagcattgttgcacaccatatgttttttgtgttgcacatagtgtgtttgtgatgttgtaatccgtcttttctggatgtttcttaaatcagtactggatgttgcatttggtatcttcggatgttgcacatattgggttttgagtgttgcattcaattgaaacatcttcaataaagcgatgaaacattcttcagtgaaagatgaaacatctttaattcatgttgaaacattttttttcgagcgatgaaacattgcaacatttcatttaacatacaatgaaacatcgttcggagatttcatgttgaaacattttttttcgagcgatgaaacattgcaacattcattctacatacattgcaacaccgtccggagatttgcaaatctccggacgtccgatgcgtagcactctccacaaaattgatgacacaatccgaacatctatctatactaatataaaaagcaccagttcatcaaacacctgtcttttctatcccttagatctattcatccaacggcttgtatcaaaatttggatcaccttgcaattagcgatctcccactccgcttcgcgtaaccagcgattaaaggaaaaaatagtgatcggattagcgttcttgccgtccttgccaaaccgccgctcctccccgcgatggcgaatcaggatgtccgctctgctggacgtcctcgacatcaagatatctacaaaatacaagtactgcgaattacgtgctgaaaaacccaaaagggataattgttccgaaacgacaatacaagcctagaatgtttatggcacgaaatcaaaaagtacaaaagaagaaatttactcttcaaatagagaaggaacaatttcccctagatccaccacgtccgatatcacgtcctcgcgtgtgtcattcgctgccccctgcgacaagatctctttaagatccaagttgggctgcgcaagcctcacacacgcaaggagatggcaagccccggtgtggatcccgttggcgatctcatcagacaccttggccgcatgcttcgaaggaattacctccatcgcttgggccagggtgaacagcgaagatgtcaccgaggtctcgtcagggtgctccaggatcttggcctcaactccgcacgcccccgccttctggtgaaggcttgtgaagctctgacagagcgaagcacggatggaagcgaggtggtcctctaactcagacatccgcctttcgaggccttgccgctacgactcgttcccggccacgagttccttcatcttttgaaggtcctcgcgagccacctccagttcctgctcaagctgggccacacgtccatctgctgaggtcacgcgggcgttcgcctgctcgatcacccgagccacccccgagcaccaacgtcgaggaggcgcttcatctcggccatcatctgcgtcaaagtcagtggctcgatagcagctggcggaagaggagcaagtaaggctatgacgacgtcaggagcaggctcggccgcgacaggggcatccccgattacagcagtggcagtaagcacagccgctgcggtagtcgtgctggttgcgacttcacccctgctgtgggccaatgacgtcgaggaggccctgaagacatcacatcgtgtccgtcagaagacaatattagaagggaattcgtgaaggagaaaaaggttccatttttttgctcacttgttcgccgccagctttaccagtcttcttctcggggttggagggaggttgcccgcgtcctaagtgagatggtaaaataagaatctgctcgctccttttcacgacaacaatacaccgaagacgactcacctcggaaccgctcaccttgcgacgagacccagtgccggtgactgtggtcgcccacctcttctgtttcgacgtcctgctgcccccagcagcagcgacgtcggaagcctccttggagactttctccttaagtaaggcggaagcttggtgatccacgagtgggccaatggtgtccgttagaggtagagcctgcaaagatgaggtcatatcgttttctcggaagaaagaggaaacggatgtcaactatgcttacgttgatggcggtagctcgttctgtgccaccttgctcacagagcggggccaggatctcggccgccttcgaaggcaggctaatcatcacttggcacaccctctgggctacggtggcgctgtcaagacctacgataaggaactaaccttggttagatctgaaaaaactgtagacgcagaataaggtaacaacgcgagaacaagtaccccgctgcgagatccgggtcacatcgtccggcccagagtagtcataagcagggtgaacacgggcttgcagcggctggattcgacgacctatgaagtcgacagcaacctcatagctggtcagtccttgtactcgcagatcatctatgatgtccacgaatgcttggagagaagaagtcaagggaggtttcgaggtccactcttgagatcactcaggttggttctcgggaacgacaaggacaggctctgagttttcgatctgaagttaaaaccacctcgatcttcacttgctacgagataaggggtattggaagggaatgtatttcgccttcatgccatcctgaaggcgaaatccgtagcatccagagatcctgctggattccatccaatgaagctcgtagtagtagcagaagagatcgagaaaaggcactaccacaacagagatgagcgaaaatgctcaggaaaataatcgaattggggttgagatgaagcaaagaaagaccgtagaagttcaagatcagcaggaggaattcggaaggtggaggtagacaaccacaataaacgaaatcctctaccactaccatacgacctaagatgggatggggttcagtacctcctttgtcccgctccatggtcccgcggccgggtagagcccccttcttgcagtttcttcatggcggcggtgtcaaaagatgatttttccagatccatggccgccagaagatcgccgggaagtgaacagggaaaaaaggctagggttttttggggacggaggggtcaagagcgccgggaagatggaagaattttctcgcaaacagatttgaaatggatcccaaaattcctttaaataggcgcacaacaacacggttcgtatcctaaggaaaggagagagattgctgccgaaaatttctaaagctcgttatgggctgtagtttagacttcaatttaaattcactcacgaccgttgaacttccttcagcattgttgctggctccgtgtctctacggttttataccgggatcgaccaagcgagtacgacaacgtgctgacgagcgaagttgcgcatgacaacgtgagttcatttaagctgaagtcgggggctactgtcatggttatggataaggcataccctctttccttggacttatggaatatacggatacaacataccatcacaaatacgagctatctccgtatgcgttaaggaaattcgccagatgttatggaaaatgtctctacgggacaagcgacggacgaagtcctactcggaaaggatagggtcttactatatcgtacgagatccgatgtctccgagtcctacttggagatcaagatgatccacggtataaaagggacccctgagagggattcaaggcattgaatctcaccaccaacacacctgccatagtttacgaagccggagcacgcagagctaagtcaccgggagatctcgtcgaatccattgactacaatttcatcggtatcgtcgagttcatctattcctattgtaatatgtggtttcttccatataatctcatataaattggacaagggctattacttgataaggggcctgaaccaatataatccttgtctttgtgtttgcttgatatcatactacgtagatcctcataccagcgaaccccaataccctaatcatccggtctacgggtatcactcgtcaacagaatgagcaacatagaaaaaactgcagaactcctagcattgaaaattaaatcgagacactatacaagttgattccaggaaggtatttgtaaatacaatattttcttacggaatatttggatgtagaaacaaatacacgttacaaacattgttgactagaataaaaacggttaactagaattcatttcttgacaggaactaactagaattctagaattactaaaactgaaatttggttaaaaatattttggcagctacttggattagtgaatccttctacaggcaataattaattgtcagggatcattgaacccaattagagactgaaaacagatatttgtttcaagttaaaatttgctaggcaaataaatagcatcattaagtaggcaaatattattagaattggtgaaacacctttatatttattagttttcttaggaaaacagatgacattttttttacactagcagagttttgggagcacagcagacgaaacaaatatgccacagctcaacaaaagaacaatacaagaatttgtaaatagttcagaaaatcataaaaccaaaaagactacagatggagtaggtacaacacatcgatgacacactggttccctccaactatggagattatgtcacgacccgaggccatgacgggagaaacaccaccgaaaagatagccggacggcgttggctcctagagaagagatgtagatttagagtagggagaagagcattattaggagggagagattacactaattgatattcattgcttaacttgagatgaatacaaaccatcccttatatagagatgatatgatttgacccttaagaaactaactcagactaactatatctaatcttatcgtatctcctaccaactgctacagtactcgaggtactgttcatccacttggacttgggcttgtgggcctcggccttctgcccaatgcctatgacactacaacctccttttgagcagcttgtcctcgagctgcaacatatagcagacttctagacgtacacgactccctaaataaaacttaatataattgctgcaactatttgtcccggaggttgtgacccccaagatgcagccctgctcgtcagcatcactccccctcgccaacaacggcgccattgccaggaccagtggaggatcctctggaagcgtaccctgtccctcgctccctggctgttgctgcaatctaatggccacggaccacgtcgacttgaacgacaccgtggagggaatcaccacccatggctggttggggagcaaccccttcttaggtggtcacccatgggtgaccttgatccgcttgcaccacttcaagacttgtggatgtggttgcagtggagaggacagacaacgctgtctgcatgcctccaaacccgccggctgagttggaggtgtagagatcggtgacggcatcaccatgcccactgccatgtcctgctctatggcctcctgcttgctatgccattcctctttcttcaccagtttctcctgaattaaggtcgccaattccttgagaacgaccctcaactcctcgatgcttttaactccttgatcctggttgtggaggtctgttcgtactggagatacaacagccatcgtagatgttgcggccatggaaggctttttgtgcatactctgcatccgcatgagattggaatttaattgaagcctccacatctgttctcatctgctgcatgttgatcttctctgctccataagcataaatgttgatgcgaaaaacatacactggcctgagagatttgcttaactctagtgcaggacctaaatcttgcttttgggtttaagggcgtgccagttggtttgatcctgcaaccaacaagaaacaaacaaaaaaacatagttaaatccataaacggtagccgatcggccacatgctgatgacatatcgtttgtaagttagccgatgtaacgtgaattagatcggcaatgatatataaagcaaaaagaaagttaaatctagtcgatcggctgtagatattaacagtatataatctatagattgaaatatgtttaaaccaagtgattaggatagatcagaccagcttgccgagacagtataaatcacttatgtctaaaagtacttcaatgtaaagattatatatgtttatagcatagccgatgttgtagatttaacatgtatcggctaatactccgacactactttatactaggatatcaatatagatcaaatatattaaacaggaattaatcaagtgttaatgtagtttaacagattaatagggctgcagga

SEQ ID NO: 73670 - DNA, 9020 bp, Oryza sativa
acactggcgccgtgcccatgccaccgtggcactagggctgtcgtggaggtgctgactgggcagaaagggggcgccagccacactggcgccgcctctcataccacggcgccagcatagctggcgcgcccctcctctgtgccttaaaccccgtgggccccaccacctttctcctccccactcccattttcgccattcccagcccgagcagcgagctgctgttcttctccctctctctccccctcacctctccacctcaaatccacttaatttgaagccgtttttcgcgggattttttgtggaaatcgaagagaaaggtagactccttcattcccccctctttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgacggaggtttgggctgtatgataaagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcgtgtttactacggtggtagagtggtggaaccttatgttggtggacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagatctcagtttagatctctagaggtgtttgcatcaaagttagttcgtaccgtagaaaatttggatctaaacaaatctccttcttatcattacgttgagaagaattttgtgacatattattctcgtcgtggagggggtgcaagtaagagtgagttggtacgagaagacttggagggggaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattccctccacttagtaataatgacaagttagcattagaggaatgccgtgcgtttgagaaggtgtttgggaggaagccgggcattcctgagtttagggacctaacacatgcccatggtgcactactagatggcggcatcaacctagatcagttgccagaaccattccaggtggatggtctcagaaagggtttagagttcccatccatggtcgcattgaagctatggcttcaggagtacgccatcgtgcaccatcgtccataccgtgttgtcaattctgccgcaaatattaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagagtgaagtatggcaaggcttggagggcacgagaggaggctatgaagctcatttacggtgaatggggtgaagcgtatgtccgtttgcccactttgctgcaagccattaagcagaggaatcccagtatggtctaccacatcgatactcatcctgatagggttgtcaacgttgatggagtgaccaagaaaatttttatgcgtgcattctggtgctttggtccttccattgaggcttttaagcattgtaggccagtactagctataaatgcaaccttcctaactgggaaatacggtggtgccttgatgactgcattatcagctgatgcggaggaccaacttgtacctttagcttttgccttggtggagaaagagaattcacgagactggtgctggtttatcgatcttttctgacgggttgtggttgggccgcatagggaggtttgtattatctcagatcgacatgctggtataataaatgccatgatgactcctgttccaggattgccatcggttcaccactggtggtgcatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccagtggggttacatgacaaccaacatggccgaacagttcaatagcgtgctagttggtgttcgtaagcttccagtgacggccatcgtatcatttacgttcatgaagtgtaatgactactttgtgaacagacatgatgaagctttgaagcgagtccagttagggcagcgttggtccaccaaggttgacagtaagatgaaggtgcaagaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgataaggaatctcccaaccgaatgccgtatcagttctcttcaagagccgttgtgaacacatgggcaagtcgctttgagccatacctttaccccacacagtggccatcgtacgatggtgaagaatttgttgctgacccaaatttgaagattaaaacaagagggaagaggagatcaaaacgattcaagaacgaaatggactcgggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttacccagccttagaggcgtactacgaggcccgtcatcacggggctgcgatcgaggcggggagggtatgaatcggcattgattcacttgtgcataagtatcggtagcgtgtatttgacattatattaactaattgatttacaattgctaatgcaggtacttcaaccgctccgagtcagagctcatgccccccagtgttcgacgataggtacatcccgtacctaagggctgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccttaaaatactctccggatttttctgtgaattttcggagctcaagaagtaattataataatataaagttcatttaatcaatttaaataaaaagaaaagaaaataatcttccccttccaccctttcgggctcggcccaaatcccttcccccttcccctccggcccggccgccctcttttccccctttgggccgccggctcagctcctcccctccctctccctctagtcctcttttcctcccccaaccggtctcccctcttcctctggctgacaggtgggacccgcggccccacctgtcatctcctacctctagctccatccccaaccgccgccatggccgccaaatcctcccacgtcgccgcctctcccgcgggactccctctcctgcgcgtgcgtggacgcggtcatcgccacgtcgccgcctcccgcacctctctctcctcccacgtcgccggccagtttccacccctctcgggctcgatcccgcctcccctcccctataaagagcatccccggggcttcctctcccgtttccccctcctccccgagcccgcggcgccttttcccgctctccccgcgcgcgtcccagctccgccgctcctcggcgaactccagccgcgccgcgccgccgctctcgttcaccccgcactgcgccgtcgccctccccggcatcgcagccgccgtgcgcaccccgtccaccgctccatttcccctctccaccttcgaagcgccgcagccacgcgcaccacctctttccgccgccgccgccggctccagccgcctcttctcgcagcttcagccaccgccgtgccgtgccgtcgccaccgtcggcatcgccgcgccgagctccaccccgtcctacacctcttttccctaaatctcccaccaaaattccacctccgctgtccacccgagccacctcaactataccgcctccagccgccgcctctcaccgctctagccgtcgtcgcgcagcgtcgccgcgctccaccgcaccctggctgccactccactccgtccagaaccccacgggagccgcttttccaaagtcaaggtcagctccactccgtatcgccgccgtcggccgtcgtttttggtcgctccgtgccggctcttccctccctaaccgctccaatatcttccccaggtcttgccggccctcggccgcggctccgttgtggccgggcgtcgtcggaacgctgttcccgtcgcctcccatcccggccgccgccatcctttccgccgccggtcgtcgccgaggccgcccgcgccgtcttcccgagaaggcgtcgccgccgcccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccagtggccgtccggccacgcgccgccgtctggtcgggttggtcggcgagccaacccacccctccgccttgcacctctaccgtggactcggtccacggtgggctagatccttttgcccactgacgcgtggggcccgctcatttggtggacccggtccaagcccgcacctccttgacgcgctgacgtgttgggcccacctgtcggcgccggcgccccttgctgacgtcagcgagtgccatttcccttgagaaaataaataataattgcgcaataaatcgagtttaattctagaaattcatttaaatggctcaaaatttctaaaatccatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaaaagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcactgtgattagtcccaccttaataaatcgacccaatgcactgtagtacaggtgggttggttgggcctgttcaacgtggtgtagcgttgatcagtggagattttaatgttactttaattactcaacagttttactgtttgctaaataaaacgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcggaccccagttgagttttgcctgtggagtggagctgaagccccgctaggatcgccttttttccgctgctgctgttttcgtttcggtgcgaggactaagtgcctctttaagtattttacgctttatttacgtttggaactgtatattacttgtcgttttgtgtaccctggctggtcctggacagggatttaatacacaaaatagtctggaaatttgggctaaatttctgggcgtgacaagggctgccgggttgctcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacgggggcatgctgtgacgggcaggacagagactcctggatggcatgcacaagtgcagcagctgtttggcattccactgaacattgagcaggggcaaggggggaagaagaagcagaatggaatccctatgatgtccggactagagttggatatcaaatggagcacgccccacttagagacagagtcgtaagttttcttgcatttgtcaaagttacttccatttgcaccctagaccctaacatatatcttttaacgctttcagtcgagagagctccttaggagtgtgaatgaaatggggcatgccctccaagctccgaggggtggtgaggacacggagaacacgctccgcaatgttttagaggtaaaatttatttagcactttgcattacttgagttatgcctaacaaacttctttttttttgaaatgcagaaagttcgtcaaaggtgccggaaacttgtagcaagattaggttgcaggtcggttggattggacgacgtgtaccaaccggggagactaccaccaccactacctcaatccgcgcgttcaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactatgtcacaccagacgccgaggagatagacatgtcacagcttcccgacgcgcctcaggggacgcaacccacgcaatacaacttgcgatccactcgggcagcgaaaaagaggtaaaatgaacttaccattctcaaatgttatttgatttcccttattttgtttttaaaatgttttaaacattggattttcaaatgtaggtacactccgggctcgcaagcaattcggcgccaacggaagaagtaatttgtatgaagttaatctattggttggtagtatgacatatatggtgcactatgtgatataaaatgtgatggactatgtgaggactatgtgatggacttttgacattgttttttgtgtggaatataggatggactttttgcattgtttgatgtgtgggatatgtgatggacttttggcattgtttgatgtgtggaatatgtgatggactatgtgaggactatgtgatggacttttggcattgtgatttgtgcaattggaatctgttttagtctgtacgaatctgtgaattgtgatttgaattgcgaactgtgaattggtacatttgtgcaatatggatcttcaatttgcagggagcagacggcggcccaaccaccctggcgccaggttggga

SEQ ID NO: 73671 - DNA, 12194 bp, Oryza sativa
tcattgttctcactaaaacataagacaaactatgtgcgaagaactgaccttgtgaaagaacttcggttcaaattttcctgcaagacagtttgtcatagtcacattcatagcatcttgaccacctccaataaccacctaacacaacgaagaattcttgtgattagtagttagaataggaatgggaacaagatgagctgactactcgttacagtaacatctcaggtgaacaattcagatgtggccaattagacatttttttcgtgttagtacaactacacatccatgacagccaacagcactcaaacaaattatatggaattagggcaaatccagggtgaaaagatgtgctggacaggtacataggtgcttttgcacttcctggtgtatattcattgttatgtatgcatgtatgcatgtaaaagtactaattgcagataagaagcatgtgaattttcctcaaaaaaaaaaagaagcatgtgaatgaatcatttgttgctctcgtcttatagtaaaactaatcatagaaggaaaatgactcaaaagtgagaaaaaacttgtgccaaccaaaatcatcaaaaaaaagcataagtaatatccatattcaactaatcaggaggtttacttcagagcaaaataaagaaacagagaccataggcatttcgatcccaacaataacatgttgggaacatatgcagttagcataacataaaacgaagtaatttaaggcatgaccatgtaatcttgtaaaaacattgcatctataaaagaacttgaggaaatgtatttaggaattaggtattgtgacataggtcgctcagtgacacatgtcttgatcagtgtcaagagttcttgtatcccatagctagccagatagaaatgtgcatgacagtaaataatcatatttgtagtatgaagtacaaacaattgaagacatgattatgctagcagcatcaacaaaatatcaccttagcagacttatccaaggagcctgtttggaaaggcgatcaatctgaagatttggaaagtgaagtaattgttttctgatgtccttgttccttgtctgactccttcaggcattgtccagtctgtacatgcataaaccaaacagaatgtaaaagcatcccatgataaagttgatggaaaaacctgttcattcccatacagttacaaagtcagcatgtttaataaaaggtaaaacggcaacaaataaccagcatgcgttatgcataaatgtagcatgtttttggttagtgaacagacaacacaaactaccattttgtcatttgcactatattgccagactcaattcaaatcaagaagcctgcaaggtatttatcaccagttcaatgactacaaacatatgtcatgttaattcatactgttgccatcaataaactgtgacagtcgcacatacgtaacagtgatttttcaaccatatctggtaattttttgactatcaaacaacttcacttgtcagtccacagatacatgtcgaatgctaaacaagagcgctacaggttcagaattatatgcaaattatcacattccggacaagcatcacacacctactagtcaagagtttctagtagcacgagtggtaagtagagataacatatggcaatgcaagctaacctcggtgatgaactgatgatggtcctgttcgacgggccctacacggcactgttaatcctccccaataatcacgagaagagactcttccggctctgcatccacaaccacacacttcagaattcacgcatccggaagcttccaagcggaaggagactgaagaggtaggaagaggagacgcgtcttacggtcatcggggtcctcggcgatgcgcttgacctgggcggtcgccggtcggcaccttctactccatgaagctgtcggtggtgatgacgacgaggccatcgccgatggcgaactcgtctgagcgcgctcttcgccgccgggcttgtgcttccctgcgccgccggggaggaagggtggtaaactggtagggttagggagagaggatggggtgggggatctggaattctggatcggtgcggaaaaaccctaaccgggccggcccaatcacttcttggtatcatggcctcgtgggccgttgggccagtgtatttacatttcgaatgggaccacctatatatttgtcgacaaattttctagtaaaaatttgacagatgtaattatagtacaatcgtagtgtaattacactataacttgtatgtaattacactgtaacttgcatgcgactatagtgtaacttgtatgtaagtttcacgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgtttcgaataagttcacttgagctctcttagcttgtcatcgagtttaaatcaaattcatgaactgtaatagcagacataacgtgaccttcaaattgcaatatcgtagcattctagacaatattttatccggttttagctatcgtggtgaattcatggatcgtgttttttgaacggttcagggaaattcataagttatttttattttgcaaggacattaaggggatttcagaaattcaaaagttcttaattacacgcactgtactatgcgtgtaagagttgattcaggctgtgtttagttcacaccaaaattagaagtttggttgaaattaaaacgatgtgatggaaaagttaaaagtttgtgtgtgtagaaaagttttgatgtgatggaaaagttggaagtttgaagaaaaattttgtaactaaacacggcctcattttcttgaagaataactcaagctgaaaatatcttaatcacaatagagtaacagaagaccagacgactttattgacttgctggtgcatgggccagagcttgcagaatgtcaggaaggagggaaggtggagcaacatggtaagcgtacatgacaattgacaagttgacagtatacacgcgcgtctccgttcttaccgcgctcagctgtctcggcgaggattaattactgcctccacatcctcctcgacgccattgttgacgagcttgaccgtgtaccggagctcggcgacctgcctccggatggcgtccaccgtcgccctgacgctccggctgttgatgtaccacgcgtcgtactgcacggcgacctgctcgaggctcaggaggttggcgatgcccgacggcgggctctcatggctcgccgggcccgtggagagcttcagctcgaggtcagttagcttcggcatggccccttccttgaacaccagccatggcacccggcaatcgacggacaatctcaggagctcacggaacgggtagatgatgatcccattcttctcgtcgtcgccgtcttcttcttcttcatggatttttgagttcaggggagctctgttgcttctgttttgagagctggacatgaacccctgaccttggatcacaatggcttctcttgggaggaaatccagccccagctcgaggcactccaacctgtgcaaacgtccaagaatcttgacgccttctggggctagcttgcagaccctgatatgaagcgaggagaggtggttgagccctgcgatccaccgcgggacggtgaggaaccgggcgtgcatcgcgacgtgtcgcaggttctgaggcgcgtcttccggcgagaaatcgaggaactccatggagcagccgagctcgcagcggatcgtcagcgacctgaggcacttcaacctctggacgaggaagctcaggttgtcctggtactccttgtcggtgcactggcgaagggatagcgacacggaaagcacctccaggcaacgaagaagggaaagtttcctgacgacgtcggctgagcattcgcgtagatcgacagctgctagtgtctccaacgtatcccggagcatcccccaatcgatccccttggggatcctcgtgctcgccgcgccgtcgccagcgcgcagatgccgcagcgccactaggtcgtcgattcgctccggcagccgctgtatccgggtgcttctcaggtcgagctcctccagcgagcgcagggtgcacacctccggtgggagcttggcgatccgggtgtggctggcgtccaacgtctcgagcgagctcagcatcccgatctccggcgggagctcgctgatacgcgtgttcctcaggctgagatacctgagcaggaacagtttgccgctgctgaatatccgtggcaggtcatcgtctttcagcttctcccagccttgcagatccagcacaaccagatgcgggaacatttcaagagaaataccgtccacttctccagagaccgtgagcgagcgagtgaaggagaacatctcttccatctgcgccgggacctcctgatctgcaggctgctgctgctgctggccatggtggaggaacacccgccgtatctgcaggccggatgagccgcggagcgtgccggtgtcgcagcaactggtggtgacgaaattcttgtccgcggatttcgacgcgaggagctggaacatgaaatgattgacctggtagctgcaagggttgcattcacaatcgcacgccctcctcctcgtcctcgccggacggatgatacaccgctggacgagctgcgagaagcattcctctgctctttcctcgaacccgctctgcaacgtgtgcaccgcgatcagcccctcggccttccatttcctgatgaggaggtgcttgtcgatcacgtaaccctgcgggaacgtgctcatgtacagcgacagtagccgcagctcgcaggggagattgtcgtagctaggagacagcgtgtcctcgacttgcttcagttctctgattccgcttggcaaatatgctgcaacacaaggtctggagatatccatcgtcaccccactctgatctccttcttcgtcatcgtagtcttcttcctgcatctgcttcgacaccaggccggccatggcaattatgagcagcggtgtgccgtcgcataccctcagaatctcattggagactcgtccagaattggctggccgcggccaaccgtgagccactgccgagaacagcctctcggaatctgtcgcgccgagaggcttgacctcgtgcacgaggccgttaggccatgggtgcgagcagcaggagcgagcgacgcttctgatgcgcgtagtgattattatgcggctgtggcatctgttgctcgggaaagcatcccagatgtgctcccagtccgatgttctccacatatcatcgattacgatgaggtacctgcagcaattgtgtgtatgtatcacatcgccagcttaaaacgaacaaactggtttatagcctccaaaaacactgagggctgctttagatagtaggattgaaaaaatgaagaaatagaaaaaaaaacataggattttaataggaatgtaagtgtaaaacagatggatgcaaaacacaggaatagtcgtttgactgaaccttatgaaaaacacagaaattgaatgagagtgatagactcaaaagtaaattttttaagaggtttgagctcttgctaagttttcctcaaactctatatgcaatgagccgttccatcggaattttaagatttggaaagcctcaatcctttgaatcaaatgaccacatagaaaacattaattcctatagaatttgaatcctacgaaattcttaaaaaaaaaattcttttgattcaaagagcactattttggtacttgcgatttctcattaccttaaaaataagtcatataatgcattcacaatataatttagtccatgttggggggatggctccgggtagcggagccagcctccatcgtgtgatgcagcacctaccggagccatccaccctaggagaatgaccggaggaatctactgatctgggcttcagagctagccaaggcctccagagccgacctgggccttcggagccacctaggggctccggagtcatccaaggcctgccaaggcctccggagcaattcacaggctccgaaggaagccaagggctccggggtcgttcaaggtctctggagccgaccaaggcctccgagccatccataagctccggaactattcgagggctccggagccgaccaaggcctccgaagctctccgtacgctctggaaccatttgaggcttccagactctatcaaggcttctggggctggtcaaaggccccggaggaagccagggctcttggagccctggatataggatagaggatcaggcgcgtagtgggactacataaatacacactgcacgcctgccaaccacctctgacatcgttgacgagggcaagacggtgcatgctattatccggagcacggcattacccgagtaatagcgggcgccctcaggaatcggcgctgcttccttaatgggcgcagtcctcctatcactaggggaattacccgagagcccacaagctggcccactagccagccacttagattagttgataatatgggtagcagtgtaatttccctttgtacactctcgtataaatatgtaaacgttgcccgcgattgaggcatcgaatacaaaaaagaatacacactcaatcgttggattttgccccaacagtccaaaagcttaaaaattaaatatgtcagtgcaacaacttgacatgtgggtgcaatctactatagaaactaaggccctgtttagttccaggggtgaaaagtttggtcgtgtcatatcgaatatacgtacatacatttgaaatatcgaacgtagaccaataataaaacaaattacagattccgcctgtaaactgcgagacgaatttattaagcctaattaatccgtcattaacaaatgtttactgtagcaccacattgtcaaatcatggagcaattaagcttaaaagattcgtcgcaatttacacgtctgtgtaattagtttttttttgtttatatttaatactccatgcatatgtccaaacattctatgtaacagggtgaaatgtttttgcgtaggaactaaacagggcctaataagtgagtattcaacaacttagcaagataggtacaatttcggtacaataagcgatgcaacaactaattatttcaagcatttatctatacaagtttaggctgtgttggaaactaatccctgcgtacgtagaatggatcgacttattagcatatgattaattaagtataactaattatttttaaaaaaatggattaatatgatttttaaaacaactttcgtatagattttttaaaaacaaaacatatcgtttagcaattttgtgaaatgtacgcaccgaaaacgagggagatgagttggaaactcacacttaagaacacaaccttagtcttttaagtactcactatgtcaatatactttgctttaaaacagacgtcaatatatacttgcacacatttttataagcatacttaattcaaattgttgtccgtaactaaaattcaattaaattttacagtgtacaaaattttgtatttcatttgagatctaagaatgtgaaaaaaaaaccaatggttgggtttgctatgtggtggcagttgacatcatgaaaaaaaaattcacatagcactctttaactaaaatatagaattcttcttgtcctagatcacatccacccgcatacgatgtacgaaagaaataatggggactagctatattattataacataatttaaatttccatttatctttaaaaaaaatctggggcactaaattttccattaaaaacataagtttttaaccattcgtcttatttaaaatattactccctccatctacttttgatagttatatttccaaatctgaaaattttatttttgatagtcatatttcaatacaacaacctatcctcttaatggctttctcggatttaatgcgtaactctccattcttccacacaagattggttgcataggcatcgagaaatgtaaattttaatgaatcgcttgtttacaagaaataactagtaacatgtttaaatggatgataagtagaattacttttacttggactgtgtgccaagatgaaatatgatgatcaaaaatagatggagggagtatataactatcttgtgatttgttttatttgtagaggtactattggctgacttgtattatacatatttgcacaaaaagttgaattagacaaatgacgaaacgtgtatccaaaaatcaaatcctgtcgtatcatatgaaatccatataggacctgtttagatcacaccctaaaatttttcaccctgtcacatcaaaagtttaaacatctgcatgaagtattaaatatagacttaaaaaaaactaattacacatatttgtgactaatttgtgagatgaatattttaagcctaattgctccatgacctgacaatgtggtgctacagtaaacatttgctaatgatgaattaattaggcttataaattcgtcttgcggtttacagacgaattttataattagttttttattagtgtctgaatacccaatacgacatcctatataacacgccaaaactttacgccattgatctaaacacgggagggccattatagctgctacagcttgacagtggcaactcgtggtcagtggttacaaccgtccaatgtgagatccaaccgctcctaagcagcccccggtcacggtacaacagtagcagagtagcagtgggccccaccacttcatttgttcaccgttggatctgtaggactgtaaaaaatagctggaggcccatcagctactcaagctccacttgtcccgtactacccgtcgcaaaatacttgttgctttaaatttttatttgtaacatctgattatttgtcttattcaaaatattatgaaattattatttattttgtttgtggcctactttattatcaaaagtattttaagtgtgacttttctttttttatatttgcactaatttcttaactaaaataaaggaatagaaaaaacacatgattctaacaggaataaaagtgtaaaacagagaattgtaaaatacaagaatgaccatttgatcgaaccgtaggaaaaaacataggaatcagatgacagagatagactcaaaggaaattttccaagagctttgagctcttgataagttttctccaaaatctttataggattgtccatttccataggaatttatgtttataggaattttttctatgggattgaaatccttcaaaatttctatatgtgtttcctcctaatgaaaaggggccttaatgtgtagcgcactgataaccgactataacacatgtgttttgtaattctgatatacgctcttcttctgctcagggccagccctggggcagtgcgggaagtgcgaccgcactgggcctccaaaaattagggacctctaaaatatgtatactacggtaccaagcctgataggctactttgtgcattgagaagatgctggtaaataagattgttattgacactatcatcactgattgaatctagaactattagaagaaattggtttaaataatctagagatatttttttagtaattagtgtgaaattcgttaatgacaataagtttttaaatattatcttgtatttttatggtgaatcggggcttttatttttttttcgcactgggccaccaaaaagtcagggctagccctgcttctgcttcaactttgttcagtttggtttattgcagaattaatacatgtaaccgacaggacttatgctgtgtttagtttcacgctaaaattaaaagtttgaaaaaattaaaacgatgtgacgaaaaagttaaagtttatgtatgtagaaaaagttcgatgtgacgaaaaagttaaaaatttaaagaaaaaaagttggaatctaaacagggactagtattaaaattaaaactagtattaaaaggaagacagtgtgttgcttaaatagaagggatcgagctacagtacctcttagtttgcaggtattgtttgatgtcgtaagccagcgcgcagtcatcgccgtccaaggtggccgcgtccgcctgcgacccggtgatctgcgacatgatgtgccggaggagcttgtcgttgtgaggcggccttgcggagagcctggccaccgcgcggcactggaactgcccttcgatctggcggaagacatccatggccagtgtcgtcttgcccatcccagctggtccgacaacagagagcaccttcagctgcgcctccccatcgtcggaggccgtgagccatctggccagcttcttccttgggacgtcgatgccgacaagaatactgggagggccaacgtcgacgacgacgtcgggcgctgccggcggcgcgtcggtcacaagcagaagctgctcgatccaggcaaggttcagctcccggagctctgtctcggccttatctggtgcgtagccatcgatgaggtcatcgatccatctagccagatctatcaagtaggcgcagtggttcacggtctgggagtcgacatgccccggaccaattcgctcggccgatgccagcagctgccgcagtgctgcaacaaggctgctcagctccgtctccgtgaagacgaagccacggcgggcgaggacggagaggccggcgtgcccacgctccgaccggagcagatcggatatcctaccgggaagacgatccatcgcccttagtactccctccatctcctccttcgcggctgccgccattctggcatctcgttgtctctccaactcgcgcgctatcctgacctctctctttctcccaatctctttctccctcctcgacatccacccgttccaagcatcccaatcccgatccccctcaataacatccacctgacgagaaggcgaaggaaaacaagggaagccgactcctctccccatgaatgtgatgaacagcagttatcatacactaagggcccttttgaatcacaggaatgaaaaaacagaggaataagaaaaacgtaggatttttgtaggaatgaaactgtaaaaacagaggattgcaaaacataggaaagttatgttactagccctttgaatgggtataggaatttcacaggaaagagagtgtcaggaagtgtattaatacatgtcactttggccttatccacaatatcacaatgtatattttcttctaaaagaacaacaatgatgcatatgtctgtcatttatctccatcctacgcacacatgatggaaaaaagaggttagggtggatgttttcttttcctatgttttccctgtgaaatgagttccaaaggaaaatttcctctaactttcctatgccctactcctatgaatcaaaggctgctacagtgcccaatcctaaatcctacatttttcccatgaaattcctatgaatcaaaggaggcctaaattctgagatttgtctgtgcataagccttatccagctgtataagccggctgctagctcatacgcgctcggcacagtgccagccactgtctgggcgagcgtacctgggagagggcaccgcctcggtgagcgtgcgagctagctcttggcgtcctgttcatcgattaaaaaactctatgagctagctaagagctgcccattggagacggctttaggaaagagaaaagccagcgggctacagatttgtaatcagctatagcacagactttaagacacagtgtatgtatgacaggtgggaccaggtattaatagtgtagtatgtaactattgtatgaatgagttattaaattacctatagatgaattagagctagtagttggctgtactattgaacttgctcttaagagggggtgagcaaatgtactgtatataattttagagagggtcctaagcgtggggtccattaaagaatagtgctaggaggaatgtactatggtgggaccatcttaataaaatactgtaatctttatgattcttttctcttcaccaagctctgtcgtgatgtgttcaaacacacaggccacaggctcgcatataatacacctggatttttcatattttggttcttttcaaaaacctatttcataaatagacctaaaaaaacttatctcagaaatagtctttttaggacgccaaagtg

SEQ ID NO: 73672 - DNA, 9404 bp, Oryza sativa
aaacaggccccaagtgtcaaaagtggagagctctcaaaaaaaaaaaagtgtctagccgccgggggaggggggcgcattttcacgaggcggcgtcgcggcgacgaggagggagggaaaagggtggccgttagttacgcactacgccgtcacatgggggaggccgatgtgcggctgacgcgcgcacggttgtgctcgcgcggcgtgcctaccctaatgttttacacacgtatatatacgtatgaggatatttgtatatacaaaatttatacgtatataaagtatatgcatacatgtgtatgtatatatttttgatatgtaagaaaatataaacacgtatacaaaattagtatacgtatatctttacctattataaaaattaaagatgattccgtactaatagagtgtttcatccgtctttcttcccatgtttccaaagtcaacgttcgtccatcaaaagctagtccgcatcggtcacgagcaaacgagagcacatcttccggtatttttggtcttttttttgctagtattgttcccgatcactttctattttttcttcttcccagtggtggagccaggatctcgatacgtctgggctcaaattgaaggcttgtcaggactatgaataccacgtatctaatagtagttgactaaatttcggcaggacctaccacatactatgtcttataggagaagttccgcataaagaatgatgaatagagttctacatataaacgacaaggacttacgccaagacaagcttagtagtccccatacggtacctacgactaccgtcaggacggatctagcgctatctttgatctcgccggacatggattcgaggaggaagactaccctgttgtcgattacgtgttagcacttcagaccgccatattgataacagatagataggctaccccaaatattgtactggtgtgattataatgaataagagcaatgaccggcttcggccaacaggagtagggttattacctgacaatttaagagctcgaacctgtataagaatcctcgtccccatctcttttacctcagtctcgcatataccttggtgccaactatccccatactacgcaaaaccgtagtcgtgacatcaaacgtcgacagtagcgcgccaggtagagggattttggtgcttcaggattttgacgagatgagttcaagagatggattcttcaacagcaaactactcaacgacttcgtatgttgagtgatatgacctgaacgaagtacgttctccggtggatcgggatctttgtcaagcttcgccaagtcgtcgtcactatggattttttgacaagggatacttcaactattttggatctggtaagtcaaacccaaccagagtacgtgccccgacaagatcggaaccatcatcgtcaacaatttggtctatcgagatcatccaagcctcaagatacgcggcgtaccaaaagacgtcagatcgtatgatgtcgaacgagtacgcagtaaggtaattggaggattggtttttaaaattaatctactaatttcatagatacatccggcatgtatctacaaaggtacgtaatattttatatgcaatttatcgtacctatacatatcgtacatcattgtcagatctataattttttatgtttacctagagcatgttttttatacaatatcaattatgcgagtgcttccgatgttaggccatctacggtttaatgctgagggctcgctctattttcttccgtataaatcatacttgtttacggtttacataatgcctgatattaaatctgctcgttatgtcatgataataatagaagattcatgcagttttctgagtacatactcaatatgacctgctatatgtcttgccttctagaaaaaaaatttcaggaacaattgagcactcgagtaggttgtggtcaaacacacacattatcgagaacgttatcgataaatgtggagttgtcgcacccaacctaccaacgaagaccgacgacctatctcatagcactggccatagctgggctatttgagaaaaggttgttaacggataattcctcgcgaacgttgtcggcttgatcacccgacataattgcacatggatatccggacatgctataagttgggtatgtgagtcatgctggccacatgagatgcacatgtaataaatcaactttagcgcccctataggtgattgagagacgcctactcgctggttctcaaccagtcaatcgtagcgatctgtcgcacctcaacttcaatcggtcgagagactcctactcctggttctcgaatcagtagtaagtagcgatctctcgcgccacgacttcagatggtcgaggtacgactacggcaatagcgtagcggtcctcgcaccacgacttcagatggtcgtacctcgacatcactctgtcgagagatgaggctactcctggttctcgaaccagtaggccgtagcgatctctcgtacctcgacatcactcggtcgagagatgaggctactcctggttttcggaccagtaggctatagcgatctctcgcacctccacttcaaatggtcgagttaaggctacacctagttctcgaccagcggtgtagcgattctcccactatttccacttcaactggtcgagttaaggttacacctggttctcgaccagcggtgtagcgattctcccactatttctactttaagtggtcgagttacgactaccacctggttctcaaccagcggtgtagcgattctcccactacatccacttcaagtggtcgagttatgactacccgtgatcctcgaccagcggtgtagcgattctcccactacctctactccagcaaagttgatatcaggtacacaacatcgccaagtgttttacccagagatcccttaccacgacaacacctagagttgaaaccaatcctactgtccctttacgccgccctggcaaggcctccgaggaacctaagggaacttcggctggggacgcccagagtggataaggccttgtcaggtaatgcagagacgaacgatcatgtaagatctggtcatgtaagagttctcaccgtgcgtattaaccaagacgtgtaatcggaaattgagtttttcaacttcacggctaggggctagggtaagcgctttttcaacccaaggcaggtcaagggtccaagagccttatcctctgagaacgattctccgacgacaaggcttgggggcaagggagagtgtatgactcaacaaaatggactgatcgaagtcggtaaaagagaagacgctcgtacacaaaacattggtctcttaatttaatttcatttttcagttttccatacatattataacatgtcaccctttgaggcgttcgctcggaggctatttctatcgaatattcttttatgagtattgatttcaggaaaattctactcgacattgtcgaagactccatgtctctatggttctacaccaagatcgactaaggcgagcacgacaaatgttgacaaggctccatcgcagactctgcgccttctcgatcactcgagaacggttgatggatatcgacaaggaatacggaatgaagaaatggtgtacccgccgagataaaatttctagacttcaatccaaattctcgattacagcaagacgggagacttagtcgtatgctctgtactttcttggttgatgtcagagattgactcagacaaatcctatacgatgcccgcacgaggctgataagggaagtctaacgttatctctgaactcagcgataatggtcacgtgagctcgataacagttattccgaggtcttcgaattgggaatatgaactcgttcatttgcgttgaagtcagggctactgtcaggattatggataccacatacctaatagtagttgactaaatctcggcaggacccaccacatactatgtcttatacggaaacaaccttcggatataggaggagttccgcataaggaaggatgaatagagttctacatggaaatgacaaggactactcggattgtattcatattggtttccctagttctacttggactagggtacacctataggtataaatacaagaccctctaggaggagaggggacatgaaacaatagatcaacatacaagccaacatacgccaagacaagtgactggatatcaacatcggagataagcttagttgtcacaccctgaagttcttctcccaagcctaaattaattaataaatggtctcgagaaattacctatgtaaaagtaagagagaaaccctaattgaattaatgcaaataataatcggaaatggcatgtgggatttttcttgagttctacatgtcaaaatatgctaacaggatttttagaggaattttcagagctctacaaataattataaccaattaaaaatgagcacgagcaattatttaatccctgaaaattcatttcccctttttctttttcttttttccctcgttttccctaatgggtcgccggcccattctctttccccctccgcctccccgctgggccggccgaaggctaaggcccagcagccggccgcccgagcccctcctcccctcgggtcaccgacaggtgggcccacctgccgggcccgtccccaaacctccggccggcgcggcccgcgcccgcaaccgccgctcccgcctctcccgtgcctcccgggccacgccgcccacgtcgccgccttccccgcgcctccccgcacccactcactctctctagcccacacccgcgccgaaacggccgagattcaatttttgaatcccgccggccactccctctctccacctccccactactccggtgaaatcgagccactcctagcttccccgagccccctcttcccctatttaagcaccactgcccctccctctctatttttccccatttcgcagagctcccccgtgccctcctccgccctagcgccatcgccctcctctccgtcgccgccgccaccgctccggtcgccgctagccgccgcgccgagcctcgccatcgccgccgtcgggttcacgagcccaagggccacgctgtccgctcctccgccgccgatttctgccgccggagccccgttcgcaccgcacgccggtgagcttcgccatggccgccaccttcagctggcgtccccgccctctatgatctctctctctccctctctaatctttcccattgtgttccttaggtgatcccgaatctcgaccgctcgtcgccatcatcccgccgctcactgtcattgatcatcgccggtgaggaactcctccccttcctctctctctctcccacgccgcttagccgccgcctagccgctcagccgcccgcgccgctaccactgcgccgccgctgcgtcgagccgcgccaccgcgcgccatggccgccgggccggcttgagctgggcccgtgcgtgccggccgcgtgccgccccctccgccgtccgatccaccccgagtggattggggccatccatccggccgcccgcgtggtcgccacgtgtgcgccacgtggtggatccctcctccccggtcccgtggactcagtccaccgtggactggcgcccttgagcctatgacatgtggggctcgcatgttggcgccgcccccctctctccagggtttaattgttgcacaataaatcaattaaggatttttctgtttatagtaaaaacatagtgaatcttctaaaattcatagaaaattcatccgtgctccgtttaagcccattcaagtctcagtaaatcaagaaaaatacaaagaatccattaaaaatggttttattctctgtttcagtagtcttatagcctgtttgtattgtttgctttgtatatcgcatagattccggctctcccgacgctccagtgtactttgacatagtcgctgagtttcctccagccgcagggcaaggcaagtcatgcttgtcacttgaacatgttgatcccatattgcaaatgctctattgttttcctttaaatacaacattgttttacaatgatatcatgggatgattaccttctgtctcagccatactatttgttaccttgttcctttgttagcttggggatataacatgattagatgttgggttagggattgcttagccatgcttagttcaactagcacacaatgggggaactacattaatgcatagttttcagattctagtattggtgttggactagaaccattgctctggtgttggttaactaaaatatactaaatggtggactgtgggtgcatggttttgatggtcgctcccatggcaattaaggaccggttcgcgggatgccctggaagaacttaccgtacttactacatgccagtgtgggcaacggttgggcttgtagtgtagctttcctctagctgacgcatccaggcaagggtgagcgtgatgaagttcggatgggccctgtgacggcctatgcggctttcagattcacctaggcacgagaggggactgcccgctgccttgcgaggagtgggggtgaaacctgaggtgtggtgtgtttggttagagcgggttatgcgaagggtcctgtcacggcctctttccggtatgtcgtgttggcatgccggcgcacggtaacgtgtcgtggggctgtgtcttgtgggtacagttgaacacctttgatcagaggaaaagtattcgaatagccatgcccgcggttatgggcggtcaaccagattcaccgtgattagtctcaccctagcttagtctaatggaattgattagttcaggtggttggttggtcctgttgcaatgtggtgtagcgttggacagtggatggttaatattaactaattattacaactattttactgttttcaactactgtttataaatgctagctttatgcaaatgatcgaaagcaatattaaaaaattgaaaacaaagaaagcaatacgcatgtgcatcttttctagtatattgaaaaactgaaaaccaagtggtttcattccgtttgtcacgctagagacgacaaagaaaagggtaaggcgaacagatagctcgccgacgcattgtgaagaagaggatagctagaagatgcagcttaaggcggaggcggagtgcagccagcttgggagaggaaatggaaagaaagcgacgtttccggtgggcgcagagatgagtggataagggtggggaagagataaggtgttccctgctttagttgcgcacgaacattagtgaaagagacttatactcgcctagcttgcattcggcatgcatctacaaccagtatagttgtttcttgaaataattctgttctgcagcgctacctagctcttgagtccttaccagctagccgtacagtcttgcaggcgtgcggcggggatcatgtcgaagggagcgatgggaagaacttccatcatggagaagcaggaggaggcgttgaaggagtgggagcccctccatgagagtatctctaagctgctgaagggtggacgcatcaccgacgcccgcgaaaggcacagcttggcattcatggagatggaactgggcgtcattgtcgcatacctgaggatgccgctgccaccacacacagattgtcctggtgtcgatctcatcgataaccagatccagtaccactggagttactacagggatgtcgtgatatctctgtataatcagtacggagaagaagcacctaatgcggggctgctgcgaaaagccatgcggtgcttccgccgccgaaggtctttagagtataacattccgaggacagcgtacagtctctaccgtgagtgctccagtgatccacgcctcgagctcccaagctcggagctcatgccatcgccgcatcaagcagcccaagttgaggctggtgccctcaatgatcatcttgttggcatcgacagcatggcaaacgagatgctcagatggctcatggccaccgacaagggtctccgggtcatggccattgctggacccgccggcattggcaagaccacccttgccatggagctccaccgtcgactcaggtgccaaactcaagaatattatttccagtgccacgttgtggccgctaacttcccccggaggccttacaggagcaagcttgttcttcaaaccatcctgaagcagatcatggagcaactggatgcaccatcaccaaacagctcggaaatcaccatgtccatgttggaggacaacccggagctgttgactcgcaacatatcagaacacctcaaggataagaggtaaacagcattcagctgctatatgtatacagtacttatttaggacttctctaccagtgcagcatcagacctcggattcttttaatattttctcttcgtattctccctccagatactttgttttgattgatgatatattagacgaatcagatttggaaataatcaagggtgcatttcctaataataactgtggtagtagaatattgtttacggcacaacatgagtggatagctgggtggtttttgtctaattataatggggttgtgcataagatgaagcctctgaatgactcggattcagagaagctacttcgcacaaaagcttttagttccatggatgatttacttccagacaatcttaggctattatgtgatgaaatcttgaacaagtgtagaggaataccattgttcataactggtatggcagattggttgaaacaacagcaacacggcagctctgcagttcttagggtggaacaagtacgcctactgctgaaacagtttgaatactggctatcatttgattacagttatgaattgagcctatcgtcactctatctaagcatgtttccacagggatatgtgtttgataaggatcatcttgtcatgaaatgggaaaacgatgggttgatccgtatattggagtctagttcagaatatggagagttgtatttctctgagttggtcaacacgaacatcattaccccagtaggagagaactatggacccaatcttgatgaagatgaattgtgccagtggcaggtcaatcctttcgttctgagttttcttgcctccagagcagccgagaagggtcttgtttttaccagctcaacactcacctcattaccaagctgtggtggcaacaacactcggataaaacggcgcctagctctccaccaccctgatccgctactccccgaaatgctgcaacaaatggatttgtctcatactcgttcactactcatatctggtgcagtcgacagaacaacagtccctctagacaagtttggatatttggtgtttttggatcttcaaggctgggagaatttgaaggatgaggacctactgcagatatgcaaaatgtttatgctgagttatttgagcgtcaggaacacaagggtcagcaagctcccaccgcaaatcaaggagctgtgcaacctgaaggcattggacgtcagccaaacccacatatttaagatcccatcagaag

SEQ ID NO: 73673 - DNA, 13115 bp, Oryza sativa
catagccgcaccgccgagtcgagccacgccggcaccgccccccgtctgcaacggagaggagaaagagagaaggagagattagaataggatccaagggtatttttggtcatctccacaaaaaaaaattacaaaaatcattaaagtgagaaggaatggatgaaatggcattgcaacatgttgccttgtttgaggatggcattttaacgaaaccacttttggaagtggcattccagcgaaaccccgttttgacaatggcaaaatatcaattttctctctctaacagcaggacaccgaagctttacatgtatgccttggtatgtatgtgcacatcgccgttggagccactctggcgcgatgtactctgtggtacccctcacatcggtcaccgtggtgtgcacggtgtggtcgtcgaggagcttagcgatccccaagcagtgatcctcgagttgttcatgtcatcaaggtgtatgttgtctggcttgatatcacagtgggtgatcagtgagtagtacccttcgtgtaggtactcgatccccttggcgatgccgagtgcggcctctctacgctagctccatgatggcctgaagaggacgccgcggagcgagccgcctagcatgaacttgaacactagcatccgctcagtgccttcggtgcatgtatccgatcatgtggagtaagttccagtgggggacctcgttggtgaactcccactcgttgcacacatttgaaccaatcagtctctaattcaccggatgagccgtggctccgacgatctcaccgtcccttggtacaccccgccaaagcttcctttgccaagcagcttcaaaaatccattggtggtttggtggagctttttgctgctgaaagctctcacgctcgtcattatcaccaattgccggctctgtgtgtacttactgagccagttgtgtgccagaaagcctccgacgatgacggtggctagcaacatgaaggacaaacaaacggtggcgagtaagtgttgtccaggctattgttggtgacgaggtcgatgttgccgtcggtccggatgccatgctgaagcgatcggtggtgggagtacttgtgtttggattgtgttggttgggtgagattatgtcaaaaaatgctaattcacacgtgctttcgttcactacgaatagttcccagcagtcattgtttgcgatccgtggtgcaactggtcgattcaattcccagatagatgagggttacaaggtaggtgggaagtgcggctagaggggaaggggaagtgggggagaggacggatgatggcaacaaggcagggggtggggttggagagatggagaaggtggtttggagagctgtttgagctatcagcatcatcgaggaggtcgagctcatcggtgttgttagggacttttctagcacagagtgacaaaaccatcttgattttttctaggcgtactttctcgtgtgcagataacattggagttggcgagaggataaggtggagcgggacataggtcgtgggcaggaaacacatgcggtgaggtgggacgtgtgcgatacttatgcatgccatgagcttttatgaattagcatcacccgagatcgtgagctttcacaattttaaaccatactttccatcgacaggtcatcacaatctcaagcacatatacaaatttgtcaataattcatggttcaatgcttgggaatttcaagaaacgggggggggggggaggggggttaagaagacttgcacacaagagagttcaagaaggccaagagaaccctaaactcatattctttccacagtggtgtttcattgacaattttgctatatttttggcatcccttgattgtagttattttgtcaaaccttcattcagggagaaatcaaatcgagttcaactggagattaggaaagaacctgggagcatgtgattccatagagataggcaacgatgtatccgtggagctcggaaattgaggcagtgcatggacctcaaccgaaccctccagcatctgcaccacctgatgcatcgtcggccgaagtgatggattcctctcgatgcacatgaaagccacgcgagcaaagcgctccaccctctccagatcctccatggcatcgtcgtcgctatgcggaagaacctcaactctgccatgcttgactagctggcctgcccatccgaacaatgtggcggaatcatcctcgccgtcctcaccatggccggataccggatcctggcaccttctgcaacatatcatatccagtagcacgacaccaaagctgtacacgtctaccttggtgtcgatgcacctctcgctatgaaaccactcaggggtgatgtaacctctggttcccctaacattggtcactgtcgtgtgtatctattggtcgccaagtagcttggcgatcccaaagtcggtgatcttggggttgttcttgtcatccaacagtatgttgtcgggcttgatgtcacagtggatgataggagaggtgcacccttcgtgcaggtactcaatccccttggcaatgccaagtgcggcctcggtgcgccagctccatggtggacgtggagtctggaagaggatgcttcggagggaaccacccggcatgaactcgaataccagcatccgctgctcccgctccttgcagtatccaaccatgcggactaggttccggtggtggatccgcccgatggactgcacctcgttcaggaattccctctcgctgtactcgttggaggtgatgagcttcttcaccgcgatgtcaggtggttgcagtgacttggccatgccatggtagacctccccgaagcctccccttcctagcaacctttgaaagccattggtggctcggtggagctccttcttggtgaagtgtctcacaatgtcatggtcgttgttgttaattcttctcatgtgccagtgcagcagaagactggtcgcggcggccaatatgatcagaaacgccaagcaaccgaggattatgtacggcagcaacggtacccttccccgtgatggcggcgccggaggactgcggctcgtccgaaccttgatcaacgctttctgcgtgacgcttctctcttgccgtccggagcccgccagcaacgccatcttggtgcagcgggttgcgccgggctcgaacagcgccgccacgcagaagcagtcacgcaagcaaatgtcggcgcactgctcctccgccatgcgttcgtagatcacgtacggtgaggtcgtccaagtggtgttgggcagcttggtgatctcgaattcggcggagctgttcaccacgtcacagctctgcggtgcgaacgctgggcggcagccctcgtagcgtatattcttgtcgatgaaggagtagttgctcgggcacgcacagtcgagcctgctgtcggcgccggacacgacgcagtacgagttggggccgcagaagccgtccaaggcacgggttgacatgccacaacctacggctgggaacagatcggcgacggtccacgacgcgttggcggagctcctcgggcggatgtacacgcggacgatgccgtccgggtcgagcgttgcgcgccggtagctgccgccggcggtggagatcgccacgggaggtgtcaggtcgtacaacgagccattcttgatctggtattggatgctccccgtcgaggcgaagaagagagtcgtgttgccgtccggggtgttgccgggctgttgggtccgggttgcccagtacgctttgctggagtcggcattgccgccgccggcgaggtttatgaggtacaggacgatgttgccgtcggcctgcacgaagaggccgaagcagccagcggagaaatccgcatccaagcgcttggaccgaaggattgctccagcgcccatggactgaccagggaggagcgtgtcggtcgggtgccggaagctctcccacaccacggagttgtcgccggcggcgaggaactggaggttgcccgagtccagcagcacgagcaagaacccgttcggctgtcctggattcgagctcgtccaaacgttgccgcccacgccgccgccggtggtggtgtccgcgaggaggagctggccgagggtgacgctgaacacggactgcgccgtggctgtcactgccgacgcagagctcggatccgtcgcgtaccataccaccaccgccttgtgctcgtcgtcgtcgttattgaaccatacggcgaggaggaacaggccggcgtcgatggcgcggaagccgaaggcgaagtcgtcggacgagctggtgatgtactgaggaggcctcagagtggatccggccgtgaggttgaggttatccgcttcaagcagacggggttggtggtgcagcacgatcagcagcaacagcaaccgagcgaacgacgagagggacattcctgcaaatggcttcatttctgctctcaataaagctacggcacgcgcgccttgttgtgatgagttgtagtaatacgcttaataggtttcctcataggcatgcaaccttgcattgccacaacggatttgctatactactgtcgacagttaacaggggtgaaaactttcaaattttaagccgtctaatatgctggactgctggtgaaggaaaacgaaaaaaaaatcagacgcgtacagcaggtatggaatcgaacccaacacctccaacttggatttttttcaactaaccaattgctccatcatgcttttttgagttacacttgagttacatatcaattacatagtagttacatagtagttacaacgtaattacatagtagttacatttgaaagtttttcatcccaaaaactgtcgacagttctatagctactcccttggcacaattctacatcaatttattgctgacagattaatatgaaagcgaaattgcgtgttcacatatctatttatctatcttatgacccacataagatatacgaaagaaatgcaaggatattcaaccggaaagaaacagtccattaagtaatcaaccacatataagatgagtttggatttttcaatttttgtcccttgtgaaaacttattttacaaacagatcctaaaaaaacttatttcgggaatgaaactttttcgtgagcgccaacgtcattggtgtcgtggtcttgatggtgagctctgcgtagcgaagggcaacgagctccatggtggatgtgctcctcgatggtgcacggtggcggtggatctctattttcttccccctctctttttccactttctgaccacatttttctcatcgaagccattgtttcctatctgcacttgcccagttcgtgtgtccaagcagtgttgctgcagtccccgagttaaggtgcggcaagaccactgcgacctccacaagcatggcaaggcgtcgtgaggccccggttcccactaccacgaacgctcggctccaacgtgcatgctcaagaccactatccaccgtgattcctcgtcatccgcactggtcatcttcagccgtcaggttcttcttcgtttacttcgagcatcgccgccgcgtctccaagttgccaccttcgccgctctgggttggtggtctcgctacctctacatggctaccgacgacgtcgtcccggccgttggtcccactacttcgccttcgtcttcatccagcatgtctcatcactagcgttgttgtatcttcctcgactacacttcgctcctctctgacaacaccgcgctgctccggcaattctccttctatgccgttctcgtgtcgtgaccgtcttggaggccttctctgctagtttcctccgacattggagtatgattcatggtggtctccaacctcgcccgcgcggtattggcaacaccattgcgcgcgttcgtcccaagttgtccccaggtctggcaaacccggcatgacgtctcatcctccacggttcgacagcatagactctttggtgtcatcttcctcaacgattgccttgatcgcgtcaccgtcatcatcttcagcgcgtcctcacgcacgactactctatggcgccccatgcgcaccttgtagctcggctatctcgacatcaacacacccgatttcggctacatcgaccatggctactttacgcacggcttcatcgactacggctccctcgcaccctttgcttcgactacgtaaactatggcacaaagggctatcatccttattgagcactcttgtcggtttcttctccagtccaagtgtccacgctgctcacgtttggacgtctgcattgctcatgtttggactgcggagggatattagagtatatggtagttatagtcatattattaggataggattgatttgtgtggattacttccatatctataatccttccttatctcctacccaagtactcctatatgtaccggccctttgagactcaatacaataatccacgttacgcagtatacctctcctcttatatttgtttacttaaacattgtgggattgctggagagttaggggggccacgtcagatgccacttttgcaaaaaaaaaagccccacagttctgttaattacgcattggtccccgctgctatccaccgtaaaccgtccgatctcgatctagggtagatctggccatacacgtgtccaactgtggtggcccttccgcacccgtgaaatcgttggatccgcaacggacggtgcggatttcgctggcatgtaccaaaccctagcctctgcgcatcgccacgctctcctccctctgtgcaccaccatgctctcctcctcagctcctcccctcacatgcgccgccgccaccacatgcgaggggagccggatcggatggctgcgggtgaaggggagccggcctgcacgggtggcgcgagcacacaatggcgtgcgggtcccaaaggataccggtgacgagcggcggtaaacgctgcggaaggagacgggggatgcagggagttggaggctctctaggcatgcaaggtgagggacgacggtcggaggagttcggcggcgccctcaggtcgacgacgatgacgggagtccggtggttttctgtgggaggcgaaaggcggacgggggcgaccatgacctggggaaggaagtggagtgattagagagggaaggcgtggttcgggttgcgggaaaacacggccagagcggcggcggcgaggggtgagctcacctccgtgaggaaaaagctatcctggcagtgggttggggaagcagagtggttggaggtggcggcggcactgttgcgcgaggccccacccatcggcggcgagcggctggatatgacgaatacgacagtggcctcgggtcaatagggaaggcggctttagctttacggtggcagtttggaggagcggaggggttgccgcggtggctcttggcacggagatgccagtggtgcaagtggcggcaacaagcgatggatgggcggagtgcagcggggagtaaaagggagcgcgcagtgagctcgggcgaatgaggaaaatgagagagcgggaaccgggagggagttttatgggctcgaaaggcgaagatcatggccggagaggggcggaaaagccggtgatgtgggggaggtgagagatacagcggcgatggattcgaaaatcgaatcccaagagtggagagcgggcatgggaggtgcgggggagtgggtgcacgtgtagcagttgcgggtgacgcggggaagtcggcaaagtgggggcgccggggtgcacgggatggtgttgcccgtggccggctggaggtaggagatggccacgatagatgggccccacctgtcggtggcactagggaaggaacaggcgggccaaggagggaggtgggccggcggatggaagagagatgagggtggcctagcctgagggaagagaggaaggaggggagagcgggctgtgagggacgtaaagcgaacttcggccgaaacggcccaaaggcggggaagggaaagattttaatttgttttcgagtaaatttcagaaaactgcaactatagtgacaaaattatcagtttgctgcaacgatagcgtaggaaatcatcaaaaaaaaactgctacaggacatgtaggtgacaactatagcaacatatcacgtaaaagttgtagttttgtgataattttccacgctatcgttgcagcaaactgaaatatgttgctaatgttgtagcaaactgatagttttgtcactatagttgcagttttctgaaatgtactctttgtttttttattttaatggattaaatgttgtttgtgcctttaaaattattacttgagttttgaaaattcacaaaaaaaatccagagagtattttaggacatggagaatatcacaaaaatatttccagccatgattttaaaggaaattttaattctctcattaatttcacttcattaatttaatttttagtataatttctagaaatgaattattaaatgatttttaatcccatacgaaaatcgggacgtgacatcttctcctcgtccttttggccatgctgatctagtggtagccagagtaggcattgagggaactcaacaactcacaacgcggttaaatccaccagttggtcaatgagaggaagatggaagtggtccttggggcactctttgttaaggtcggtgaagtctacgcacatcctccacttgtcgttggccttgtgcaccattactaggttagcgagctgctttggatggaatacttctatgatgaagccgaccttgaggagcttgttgaactcttctcagatagcctcttttctatcctagtcgaatttacgcagcatttgcttgactgactttgcattggaatgcaaagacgaagaaaaaaaatctaatcacctcctcaatttgatcatctcaatacaagcaagcaatgaatgtgattgaggggcttgattgtagaggatttaaaataaaccaaatttagagaaccaagaggtgttaattaatgtatgtatgcatgcacgtcttatattatgatatatgagaaaaatggttgccttatattttgggatgaagagagtaggggtggaaaaaaaactcgaggagagctcggcttgggcttggtttgggctcgcatagctcggctcggtcgaaagccaaacgagccaagcccaagcctctttcctagctcatcctatatacttatatagttcatccccactaagtgtagtcaatgctatttctctcttctctcattaagccacatcaccctaattatttctaacctttggatgatagatctatgatccaaattgtctcttcttttttctctcttaaaaacatacaatctcaattacttttaggctcaaaaatgtatcaaattgttttagttctgtacatattatgcaacttaatttttcacagcaacgcgacggggtattcatctagtttctaaaacgagccaagcctgagctgtctcacgagccactcgcgagctcatttggctcagtataatagggtcatatacaataattttgcatcttttcaagatatttattaggttatgaagttgcgcatctgcgcgactttaaccattttgttatgtgctttgtgaagataagatatatacagaaaagagcatttagaatattcagtgatatacactcaaattggaaatgacatttgtttgcatgccttagttactgtaattgaagaagatattactccagtaaataaatttgggactgcttttagtgtcaatcaaaagcagatgagctaacttgttttgctttaatttgatccctcggcacaattaatggttctagctgaaaaagtggtcatgaatacatcacataagcatggtcttaaccatgtttagaatttcgtcactactatatctgtcgccctgtgtggacattcgtactctcctacctcaacacacgctgtagtctgctgccctgcgtgacaggttaacagaaagtcaaattccatatataaaatgcttttgattcaaatatgcgcaaattttatgcaagccaaaccatctcttatgatagtttccccctaattttttccagtaaaccaaatcacgctgactggctcatcttatttccttgtcatcattcattcaaagtagtttcccctatccttctttgagatgtcatacaggcaaacataatataacagtgattgtcttaccggcatatttttaaaaatagatctgatatttaccggtatcccaatagcccaggatttggccggccacaacaataacagctttattcacaatgctgtatcatcttttgcatcatcctcaaatcgaggggaggtaggcactgagcaaccattctgcaatagacgatttggtaagcaatccatcttctagaagatgttaaactggaggaaaggctggcaaaattttcctggccatcaatgaagggatcagctatcttgagcgtctccacgccaagaacggagcaaccaatggctgaatgcctgaatcttcatcagaatcaagtgatcgatcactcatcagcgaagatagggaggcaagacacatcgatcgctgttggttagaaaatccaattttatgtgactggatgataccctcgaggggcacgccgtcgtctgcaacgccatcattgcggcaggaagtgacggggtggcaaggagcaggtaggggttgacgctgccatggcggcatgcaaggtggcttggaagggtagcctccgtgcggagacggagccgtcgacgacctgcctcaccagtagcatcgttgcatcgtttcctcctccctctcctctctgttgggtggtggggttgttcgtgacgaacacccacggtggctgtattcgatggccagatttgatgcctccaactctccatgatcctgtgggaggacaaccgtcgatggggaagaggatagggaggcagcagtcgaaacggaggcggcggcggcacagggccggccctaggggggtcaggccgtgcggccgcccgaggctcccaaaatctaggggccccctacacacatatagtgtatatatactacatattgtataattttaatctatgggccatgtgcctatattaagttagacagctgaatagcccaattcagaaaatgaattttagtccatcgccaggcatgtttcagtgaagccgaagagatattcatctgactcccgtcgcttcgtctcgatcacatcacgccactcgcgtcgcgccgcctcgatcacatcacactactcgctgctcttgcgctcgcggcgacttctcagtctcgtaaatgaaaacagcaagtggacacagcaaatcgtagctcgccagtagccacgctcgtgtcaataagggcctccatataagtttttgccctgaggccccaaaaccccagtaccggccctgcagcggcggcaacggacgggcggtccacacggatggacgcatcgcggcgccgccgcgtgcggtgaagatggggaagcgacaattttttttctcgtacgaacgtggaggtggagggacctgtgtgcaaaaaaaacttcttaaaggatcgagaagatatttcacgaatcaagcaatgtgacggccagtagcgtccaaatgtagaatctgacggcttatgtttactgaatggcgtggcgctacaattttacattttgggggttcaactttcatatattaagatttgttgaaaatgataatcttgattaccatgttgtctattcatgtgttaggatgacatattgaagaaaaaatcactttactacacattctatgtgttaaaatgttgctcgatttctccttgacctgcttcaggtttacttgttgctagggcttgcgagacagcttgatctggctcgagcctattaacaagccatgacgtccagggcgcgaaaacagtattagatccatctcatttagttggaccacacttacactattaactctcttacgtttttgtcctcgctttcacgaaaaagttcgaaccggaaatcagactcccatccttataagctggtgctgctctagctgaactagcgatccgagccaagctgagttttccttccaccaaacttccacgagaactgatattcaatttggaagaatgcattatgcattagtattgagaattgatggatgtctgacataagcttagcaagcttcgatatttgtggatgtattgatgtacatgttatggtacgtggttaatgttcatttactatttcaagttgcaatgtgaattgtattatgtttatatatattttttgtccttaagtcaatttttctgacggtgtgaacattttttccctgtcggttagcacgtcagaaatttatctcacaaacttgatgaccgtggatttttctatgttgcatccacaggaaaaagccgtcggagatgatttttctgtaggaaaacccataggaaaattgatttttccgtggaccgttttatctgttggcgattcctgtcgtccatccacaaaaaataatttctgatgttaaaacgaattttcctgtgggtttcgcgcccacaggatagctgccaagtctgctagtgatcgcattatctatcaaaatcatctgctataattttcaaccttggcctcgatcttgagttagtttcactgtttcttcttcctgattatattcgtttattccactgtcgatttctaacaacaatacgtgatgacgcatcgacgagtgccgtcttggaacccaatcatctatagttcgattgcgcagcggaagaaaattcaatgtgacgtggcctcaaaactcgcatctcctagtacgtgctacctgccacagccccctcttggcctctttagaatttttctgatgcattaaaaaaatttcttttgcagcgcagtcagtgtgggcctatcagattttgacgactttaactagtctttaaaaaagggcgaggaaggggacagcagtgttccatacttatgtatgaagaaggatagagagtatgaagaagggaaagcgttttcatgcctaaagaaagtatctactcatttctggtatattacttgaatagttataaaaaaatgatattatagattaatatgacatatcattatgcaaacatgtaatttaaaattcaacttctacaaattataacaaaaataacaaatataaccgtgaatttacgttaacttgttttagttttatttattgtttttgctacaacatatgcaagtcgaatttgatcttacatgtttatgaaatgagggctgcaggaat

SEQ ID NO: 73674 - DNA, 2169 bp, Oryza sativa
cttcttgatagaaggccatccattattaggcaagcagtttgagctgaaaaatggtcctgactacaacaaggttgctgccctttctggatgcatgcgtcatacaaatcagagtaatattactttttattcactgttctgaatttagtattggaatttggaaattgaatatgtcatttatttattctggaatgtcaaatttctcgttgatacatagtacatagatctaattctagtgccatgacccgttccttgtagggaaagtttgggagtactggtcgaaattctgaactggcaaccaagcgaaactgttgtggacaagttctgatctggcaaccaagctaaactactgtgagtataatagttccgagttcgtaagaagtgatactccgtattacacataccgacacacctacacgcaccaattacatgaccattttgaaacgcaagttagcgcttacattttatatatttttgtatgcagatcgcttcttagcgtttacattgactgtttatggggatcggagaatttgaagatcaccagagtggtcagcacttgttaagttgcatgttttcatgaggattatgatgggttgcactggcttgaggagcgatctagttacccagataaatttgggtgtcagggtggcaaatggcatgcgtcccctgcgttgtgctgctgttcctgtgcaaattccaattgcatgctgcaatttgggttttccatgtgccaatgttactgaaatggtgcaccgttcggtttctgattatgcaaatgtgctcatgattcaatcggcaaaatccaatgcccacgttgttctcttcgctctatattgttcctgtttaaaatgtagaaaagctcagttgttgctaaagtggaattactggatttcaattcaatggctataatgattattctaggggtatgcaactaacaaatgttgatatttagaaataatgggtagaaatccgaactctatatccacaaatggatactccctccgtactcgtaaaggaagttgtttaggacaatgtttaagtcaaaccttgggaatataaatcatgaataactcttaagttgttgagtttgaaaatataaaaattatgtgaatatatttgtcttgaaaaaagtatacatatattacctttcaataaatatttttatagaaacaagaagtcaaagttgtgttttggagaccgtgtcgctgtccaaaacgactttctttacgagtacggagggagtatactctatcaataaatattgatagcagctgtctatgcgacgatcgtactcttgacaggcaaagtaaatgagaaatttctctcaattctaaggcatttagctttttaccacttttaagatgtggtagttaagaatatgccactcacagtatatgacatgtgggccctcatgtgtctgtaacatataagttcagtggcaatttcttaatggccacttatgaaagtggtaagccgatagttaaatactccctccgtactcgtaaaggaagtcgttttgacatggacacgatctccaaaacacaattttgacttcttgtttctataaaaatatttattgaaaagtgatatatatatatatatatatatatatatatatatatatatttttatgaaagtattttttcaagacaaatatattcatataatttttacattttcaaacttaacaacttgaaagttatttatgatttatatttttaaggtttgacttaaacattgtcctaaacgactttctttacgaatatgaatggagtatctctgtaaactcccaatacctccttaggaactgtccttcagtcagtgtcgtctgtcgtgtcgtccccttccttgatcctctgctctctttcccatccagcctccgggactccggtctcgcgtcaaacgcggattgatcgacaaggagattggagttctgatcctgccaatcaggtatggcgtttgtttcccctgtaacctagcttcattaagttatcctaggactcgtcgcgccgccgcgaaatcgtgcttaggtactccagtggcgcaggattcagtccttataatatcctctatttttttttaaatttttcggaggaaatacagatacttcgggttttcgggatagtacttcatacatgaagcaacgaagtttttgagaacttagtttatctg

SEQ ID NO: 73675 - DNA, 1848 bp, Oryza sativa
aagattaggcccagtgatgcgctggatgatcaatcccctatgctattaacccatctaaaaagcatccatgaactccaaaaactctaaaaatggagaggcgattacacttgcgatttcgagaggagatgatcatggctgaagtaaaacgaaatgtaataaatggagatgatcttcctcttaccaccacgggaacgacgaggcctctccttctcgacgcacgagtccttctccgtctcgccgccgccggggcccttcccctcctcgccaccctcctcctcaccatcatcatcaacatcgtcgtcgtcgtcgccgccgtcatcgacggcagcattcttgaagcgcacggaccacgcattggcttcgtcagacaccgcggcggagaggtccccgcgtccgccgccgccggcggcggcggcggcggtcatgtcggcgtgtccccgtaatcggcgggaggaagtgggttttgcgttgtggcgatctttgttttttctctcctcgatttcctcctctcaagtctcaactttatgtgatgctctctagaaaatcttctgtgtaatttttttttttcatttgccgctctgctggtgtctctcccgcgccacttacaaattgtaaaatctagtagaagaatagataatgctcctaaacggatgtctaatgtgattggaaaaaatcttactcccttcccttcccgggtccacaagttgaatgaatcaaaagtgacgctgacatgtgagcccgggtgacaaataaaaatgaaaatttaggagtggtattttgggcatgtgcattttgggaggatgctagcctcatttttcatccattgagctggtggacacgtgtgaacctgaaggagacttatatgtgggtctgggtgctaatgagaatgaaaatttgggagagtgacatttgagcatatgcacattgggagggtggtaaatagtaaattctcccacggctcgtaggcccattctaactggagtacttcacaacgggattgtagacttcacaactacccaatgtgtcatcgttcaatgtctacagtagtagtatcgatttgttggttagtagattgtctgatagcagaagaaaagagaagattgataagatacgtaatattaggtgagctattggcgtgtgattagttgagtattaattatttcaaacttgaaaaatagattaatataactttttaaagtaactttcctatatatatattttttttataaaaaatacattgtttagcagtttgaaaaacgtgtacgtgaaaacaatgcactttctctctcacatatgaattaacttggcatgtctcatgtgacaaaactgaaaagaattttgccttttgtatgttggattcatgaccaaaattcaaaacatgaaggacaagaaaaggaacaaaggtacataaaaatgaataacttgatcaacgatcgattgatcacagacaatgagacaagtattcctagttcttgttcatgtcccaaaagaacttgttttaggggacatcccatttccctcactgagtacgcagaaactaacacttccactactgctaggactactagataacacataagttcacatcatatgaagattaattaaagtgcagaaatcctcatgttctgaagcagatttatgattattaattaactaacatagactggcacctaaaagcgtcactagcaagaagcaaaatgaggcattgctataaccatctttctgaatcctagctccagggcgtaaaggcgtaaatttgaagatttctgaatcctaatgttagttggagtcgtctccttcctgttcttaataagaccttctttgagggcaattacggtagtcgtgggt

SEQ ID NO: 73676 - DNA, 715 bp, Oryza sativa
ccagccgcatgcgataataggtttattttcacatgcggccgtcttaaggggccgcatgtattagggcatgcggctccttaagatggccacatgcgaaaataggcccattatcgcatgtggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactattttttgcaaaatctagcttcaaaatatttgttttgatgggcaaattttgcatgtaatcacttgtacatactagttacatgtattgttgtaattttttttgggagacaaatgcatttaaacttttgtatgaaatacctgcggtctatttttttatctgtaacttttttgcctttatataattagatggatcggtcgtcatggatgtatgagatgcggagaacgcaaccgatatttattaaggaagcatctaaatttattgatcaggctaaggcccatgctttgagggagaatatg

SEQ ID NO: 73677 - DNA, 7086 bp, Oryza sativa
caggaatatttggcaatgtcagctgcagataccttggagcatcttaatgatgagagtgatcgttggacatatgtttggggcaacggtattttttcttcacagaaaatttatgccatgaatttttctcatgtctatgtgcctgtttatattaaatggatttggaagagcagttgtactatgaaagtcaaggtgtttggttggctcctcttgattgatcggttaaatacttatgacatgttagacagaaggcgttgctcccctcaaaatgcttccttgctctgtgtactttgttcaacaggatcaagggaaacaactctccacttatttttccagtgtccttttagcactcaatgttgggtgcaatttggtgtggtttggaatctttctttaagctttggtgaaatgttgatcacggccagaaattcatataactctacccattttgttgagaaggtgctttatgctgcttggaacatttggaagcagaggaatagtttaatttttgaaaacattgttccctctgttccctcttggagagttctctttaggaatgatctctcccttttagttcatagagtcaaaaattctgagagagatacattattacagtggttaaatttgttgtaattttttcccctttattaatataaaatcttaacggtgggggcttcccctaccgtagttctttcaaaaaaaaaaaaaagtcactgccaggctggttcggaaacgccatgttagctgagaattccgcagaaaaagaactttgcaagcttaattcgtgtcacaatggcatggtgtagtgcaggatttagacagctgcaaagataaatgtgttatgcagaaaaggaaaataatatcttgggaaaagtattcttagcaacagcactgtgtttcgcatatttatacgaacttaatttactatcttgtagctcggatcaaagatattacgaatacgaagtgacatgaatgtactagatttacctaataatagttctttcttagcgaagcatttgtgtaactgtactgactcgtgattgatatattattagcaaacaacatgtactccttacttttcatcaaaatctcagcacaaagcatatagaaatatactactattttcttctgtttataccctcaagataaatgaatggaatttcatctcagcaccagcacagcactatatggccattttcccatcatttgtcattgcagtttttctcccatattctaaacaggtcactctaaattcgatgacacactcatacgcttagaaggcatatatggccagctttgtggctcatgtcaaatccctactatcaacgtcgaagtactgtcaaagaacatctcgacccatccatgtcgtaggagcattagttttcccaatgcctttcacttccatttctaaattgttcatgtatggaaaaaaaaaactaaatcttcactggagcaatatatataggcacctgctgcagtaatattacaactaactctagcatacatcacttcacacacacatatatatatagcttaggacctgtttattcccaaaacaaaattttcacgctgttacattgaatgtttgtacacatgcatgcagtattaaatgtaggcaaaaaaaaaatcaattacacagattgcgtttaaattgcgagacaaatcttttaagcttattaaattgcgaccaactgtactatagcttattaatcaagctggctatgcagcaaaagttcgaagccgagaagatgattctgaaatcatcgttctctcgccaacgaatgatattttaggatacattaattacatcatcaagaactaatgaattaactagcaaagtgcttttgtgttacaacggaaaaaaatacttcctctatttcaacttactttgtcattctaattaattttgtcataagtccaattttagtaattttgattatatataatctgcatgttcttaaactatatgattttctataaatttgtattgctattagcttcagtacgaggaaatacaaatttctacgtacccgagagagtaagaaagttggcaaaatagagcggatttggttggtaaatggctcagtgaggcagtgtggagggagagatgggtggttgttcagcatggagggacgacacatcacaacttaccggagagatctagaggatcacttcaatatgcaattagatcgatgagataggaattcttgacttttaatttttatgaccccctaagttgtatgttctggatgattgattgtttccttctatttcttgttttaatttaaagtatgattatggacttactcatacatgaagatggagtagtttgacatcgaacgaggagtttgattggcagtaacatattacgattgcagctaatctatccacatgagatggcagcagtggcccatccatgcgcggcccgctgccaagggtccttgtgccacctgaagtatgaaatgccctggcacaatagaatcagacgtgaatcgaaagacgtgaaaaaaaaaccatgtgctctccaacgacaggatcgatctagacagcatgtcggtggatgaaaatcgggcagaaacactattgctttttataagtacagataaggattaaattgcatccatactggcatttttgttccagccccccaaaatattcggaccggcctatctttcctacatgttgtcggagttgaatctttcgctcctagttctttctgcttatgtgatatacctaaaaagtactcgatcatgaccaatgatatgcgacatgggacaacaaacactatataacaccaccatcctccacaagcacacatccttttatataggctcactctttacattcatcaagcttatgttgactggcggtataaaaattgtaatatgttcactaaatatggttcagttgcctcctaccgttgcaggtgtatgagtaggatggagcaaacagatcgttctatatatgctgtgttaaactggcctgcaaaccatgtacttgcatgttcagtgctcatagaaagaggcagttgtcttagagtaaagccagagcagttttgtattgcgtctaaggacgttggctacctagacgttggttctcttgtttaggcttgttggttggccaactcatagtggtctcctttggttcctggtgtctccaagtcctatatgcttaggtcgctacatgccacatcctagtgaagcaccgaaccagtggcttcaaataggaatgcaaatgattggaaatgatctgaattggtagcatctctttgcaaacgacgctcagtcggccagtatttgaccatatttatcatttaaattactcagtattagcatgaatatgatgcagaaagaaattagaaaaaaacaaatttcatatacaaccaataatggtaatgttagaaacagtaccccttagacgaaaacaacactgggtcgattgggaatttccatgaccattttcgcccctacccattcttatggccacaatgtgaatcatgatctccggccacttcacgatgctcaagcatatttaagttagatgtatcatgcatcttcatagaaagaaaagttagatgcgtcatctaggtgaacctattggttatgatattagagtgaacctattgtaaaggaatcaaaggagcccagattagcctcaaattaggtaaaggcccaaaaagggaaatgtgcctatgtgcaaaaccgaaaatgggaaaagaagaaatcatcatacggtcctaaaaaagggaggaccgcttgatctcaccctctcactttcgaattagcactagaacggataccatcatcttaatcgggcggtaagccccatctcaatcgggcatgacgtccgtcatcacaggctataagtcactcaatcgggccacaactagcgcccgtcacagatgacctatctcaatcaccatgccgtcccacccctctcccaagtgggtctttttttatcctcactcgtgtgcaccagggaagaacttcccgattggtcacccatcctaaaattgctccaggcctaacatgcttaacatcaaagttctttggagatcggcttccggaaaagtggctgtaacttgttgatatgagtattctattaatcttattaagccctagtccgggatgtcacaacatcccccattcatatacattcattcacatacacaaccatcaatatatttaacacaaccacattcacctaacatccattttgatcatatatttcatatccattcacatatttcacatatttcactagcaaaaccgagttaattggatcaaatatatatttagcaagtattatcatgaagaggaagcaaatcagacttctaggaaaatgaattttgaactgaattttataataaactcatatgtaaaagcagtcaaaaacaaagttgtagaactcattgagatctgtaaaaaataaagcctgtcacagatgagaacattaaatttaattttaggccgatttttgtgtgtcaaatgcaaaaatcataaacaacaaaattgtataacatttttattttggtcatttctccatctgaaaagtcaccaaaaccaaagttgtagaactcatcgaggtgcaaaatttttattttggtcatttctccatctgactctatttaaacaatttgaaatttaaaattcaaagtttcaaaaattcaaatagaattttagatcagtgaatgactttaactgaaaaagtcatcaataacaaagttatacaactcatcaagatctataacttttattttggtcatttttctgtataacattttttgaaccgtttgaatttgaatttgaaaatatgacaacttcaaacaacattttcaaataacaaatgatatcaactgaaaaagtcatcaacaacaaagttgaataactcatcaagatctaaaacttttattttggtcatttcttcatacgacaaagtgatagtaacattgttcacaaaattgacatatctcttatctgatttaaaaactataacacatatatgtaaaatttgcgaataatattactaacattttgttggatgaaaaaataacaaaaataaaagttttagatcttagatgagttattcaactttgttgttgatgactttttcaattgaaatcatttagtatttgaaaatgttgtttgaagttgtcatattttcaaattcaatttcaaactattcaaaaaatgttatatagaaaaataaccaaactaaatgttgtaaatcttgataagttatacaactttgttgttgacattttttccatttgaaatcatttactacccgtaaaattattttgactcataaaatgaattattatattgcacttaattatttagctatagttcaacttacaaatataaatatttcatatgaaaaatggaaaaatactcatcgttgacgggctttagttattgcccgatagagattaagtcatctcaatcgggcattagtatatagcccgtcactgatgagtcatctgtgacgggcctagttgttatctcaaacgggcctcaagttggtacacgtcacggatgatggtcatctatgacgggccccaacttgaggcccgtttgagatatgaaatgttatctcaatcgggcctaaagttggtgcccgccacagatgatggtcatttgtgacgggccgtaaatttaggcccgtttgagatatggaatgttatctcaatcgggcctaaactatggccagtcactgataggtgtcatccgtgacgggcttaagtattatacccatctaacatgtctgtgtgaccatatctcaatcgggcacttttcggcccgattgaaatgacttccttgtgatggcccgctatttgtaggcatattagaggccccacagatagaaggatctgtactagtgtagcattttttcaccagatgtcaagttttgccaagtcggctttgtccatatgctgcctcctctgagcctagttggtgactcatgtcccctgtctatgctagactcggcagcatcccagcccgcaaggccacttctgctttctccatatcctcccctcgatgtagggctgtcaaaaaagctcgaggctcgcgaggagctcgagcttggcttgtcttaggctcgattcgagctcggctcgagctccaaacaaaccgaacccaagcctgagcaaaagctcacgagctttactgagccgagctcgagcttctaccgagcttgaccgagcttgattgtgtatagtttatattacatgttcaccttattgatataataaactaatagataaatatatatattagtatctatttacacaacaaattagcatgttttagcacaatatatttattttaattattttctactcttttattagtgtgattaactagaaaataattatatttatcaagttattatcattaaaatattgtaacaccctgaaaattcgaccgacaaaaccaaaactctaaaaatacggattttcaaaaactttttaaactaattgcatcatgccgatcttattcgtctattttatctggagttgatctcgaagattattaatcgtgagtaaagaatagttaattagaaataaaccttaaaaacaaattggtaaaataaatataaattaaaaataaagattaggtgtggatagtaataaataaaatattatcgcgaccatatttggatcaattaaatttcattgcgatggaataagaattaaccctaattaaaactcaaataaattatataaaaataaaatatgagtaatattaatctagggtgaattcattagttaagataacacgaatattgagtaaaatgcatatatgtaaaattaggaattgtggaatcaaatttagatggaaaatacactaaaatcgggataaataagaaaagtcactgttcattgcgcctaaggtgttcgatgtggtccctagccttccccctcctctcccacctctgcccctagccgccccgagcccgtccatcgcgtcgccgctgccgcgccgcgtcgccgtcatcacgcgccgcgcgccatcgccgtcgccatcgtcgccgtcggcctcgcgccccgtgccgccgcctcgagccccgtgccgccgccttgcaccc

SEQ ID NO: 73678 - DNA, 40076 bp, Oryza sativa
ccgccccgtcctgtcgcctcgcgccccgcgcgccgcctcgcgccccgcgccccgcgcgccgctcgcccatcgcgtcgccgcctcgcgtcccgcgccgctgccgcgccgcgttatcgtcgcgtcgccgtcgccgtcacacctagccgcgccgagccccgcgcgccgccccgagccccgccgcccctcccctctccttctccccctcttccctataaatattccccctcccccattctctccactccatctcccccttcctctcccctctcccctctccactgcgctgccgttcccgtgccgctgcgccgccgttcccgtgccgccgcgctgccgttcccgcgccgccgtgccgtcactcctgtgccaccgtgccgccgcttctgtgccgccgtacgccaccgtcgccaccgccgtcgtcgccgctgctgccgtcggtgagccgccctccttccccctcgcgtccaccaccgccaccgctcgggtaggagggagagccgagagagagagagagccgagagaaagagaggaagaagaaaagaaaccgagggagggagaagccgaggaagagagaaaggagccgggagggagagaagaaagggaaaaagaaagagaggagagaaagaaaagaaaaggaaaagagagaaaaaagagaaaaagaaaagggaaaagagaaaagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataagaaatcaattcgcggtagtaatttagatgtaattaataactaaacaaataaatgaattcttatagattattatagattatttttgggtaatccctataagtaatcgattcacggtaaaaattcggatttaatcgctaggaattttagacgtatattatatttaatcgtttagtcatagactaaattaaattgtataatatttctaggatttcgtccaatatttagctcgtggtagaaatttctaacctattatatacaatgctcggggagactaaattattgacaacgaaataattatacccgcaaaatagtttaaatcgaaattgggtttgccgtagttcgcagatagtaaagttaataaaaagaatcaactttcgcgttcgactttcatttggatttatttggatttttatttgaattctaaccaaattcaaatcaatttttgcacgtaactatagagcccgagggagttgcggatccaagtgaaggccaagacccgcaagactttgagcaaggcaagtcatcgctattctttgaacatgttgatcccaattgcgaaattgttttgtttacaaataaaattgcatgcaatcatgaacatcctacttgtgattataccatgccttgattattgttcacctttaaatctttgtaaccatagatacgtacgagtccctagtcaactatgacacttgcttagaaatgctattttagattcatgcatactcatatttatcaaatgttatatgcttgggcaattacctttgggaaggtaattgagatgcgacatgtggagacatgagcgccacattgccatgatattgatgacataatttgtgaaaggaaaataaagtaaaacaactgttttcgactggggtggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactaccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtttgagtaaaccaaatctattcgaatagccgtgctcgcggttattgagcaccgggacatgtattacacttggctagactctaaattcttaacttgtgtgggaggggatattgcatgatgaatcttatgctgttggagccacttcctgagaggcgggaaggtggacgtcctcagaaaaccatgacgaatcaatggcgggaagctatccttgggatcacaatggatggtggacagaaccgtcgttgtgtaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatcccttgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgtttacacgatcgattcctgttataaaaacgggggtccacaaatatatattatactacttattgccgagctcggtagccgagctcgagctcgtagcttgcctaaaagctcgaaggtgcgataggctcggctcgagcttggctcgaacttgtgtcgagctcgagcttgggcagacgagctcgctcgagcttggctcgttgatagccctacctcgatgtcaccacacctcccagtgtgccttccttatctcgccaatggcatctgcccaccgcgtacatgattattcccgacctcaaaatagactaatggctagctagtctacagtatgtacaccctcactggtacagaaccttacatctgtgacggactgaaaaagcgtccgattgagatatggtcgcacagacatgttagagaggcataaaacccgggcctgtcacggatgacacctatcagtgacgggctgtatttaggcccgattgagataacattacatatctcaatcgggccacaagttggcgcccgtcacggatgatggtcatcacagatgactcatccgtgacgggctctatactaatgcccgattgagatgtagaatttttttccatttgtcatatgaaatgtttatatttgtgagttgacatgtagcaaaaataattaactgcagtataataatttattttattagtcaaaataattttttaggtagtaaatgatttcaaatggaaaaattgtcaacaacaaagttgtataacttatcaatatttacaacttttattttggtcatttttctatataactttttttcaacagtttgaatttgaatttgaaaatatgacaacttcaaacaacattttcaaatactaaatgatttcaaatggaaaaattatcaacaacaaagttgtataacttatcaagtgttaaaacttttattttggtcatttttcaatataaacttttttttgaacggtttgaatttgaatttaaaaatatgacaacttcagaaaaaacattttcaaatactaaatgatttcaactaaaaaaatcatcaacaacaaagttgtataactcatcaagatctatagcttttattttggttatttttctatataacttattttgaatcatttgaatttgaatttgaaaatacgacaaattcaaacaacattttcaaatactaaatgatttcaactaaaaaagtcatcaacaacacagttgtataactcaccaagatctataacttttatgtttattatttcttcatcagacaaagtgttgttaacattgttcacaaaatttacatatatgtgttatagtttatgaaaccagatgagagatatgtgaattttgtgaacaatattactatcactttgtcggatgaaaaaatgaccaaaataaaggttatagatcttgatgagttatacaacttttttgttgatgactttttcagttgaaatcatttagtatttgaaaatattttttgaggttgtcgtattttcaaattcaaattcaaattgttcaacaaattttatatagaaacaagaccaaagtaaaagttatagaacttgatgagttatacaactttgttgttgataatttttccatttgaaatcatttactacccgaaaaaatatttaaatttcttatattttgaaattcaaattttatatagttaaatcaagaccggatggagaaatgacaaaaataaaattggtagatctcaatgagttctacaaatttatttttgacatcttttttatataagttcatttagtattgtaaaattcaattcaaaattcgtttttgtctagaagtctgatttgcctcctcctcatgataatacttgcaaaatatatatttgatccaattaactcagttttactagtgaaatatgtgatcaaaatagatattatgtgaatgcgattgtgttaaatatattgatggttgtgtatgtgaataaatgtttatgaatagatgggatgctagggtgtgtcatactggcccagggctttataggattaatataatactcatgccaacaagttacaatatattttccggaagccaatcttcaaagaactatgaggttaaacgtgcttgttctagagcaattttgggatgggtgactgacatagaagttcttcccgggtgcacacgagtgaggtcaaaggcttgaggcgaacaaaaaaacaaaatttattttttttgattatactcatccgtgacgagctataatttagacccgttagagatgagagtcatccgtgatgggctataatttaggcccgttagagatgagagtcatccgtgacaagcttttgtgttggcacgattgagatgtgtgtcatccgtgatgaccggttgcccgattgagatattttctcacgtcactgacctttgcttagtcacgggggtcatgcccgaaagagatgatgtttaagcccgttagagataaccgatcccgttctagtaacataggtcatgattgtgatggattttaacaaaactaaatcaggataccatgatgttacaggactaatcgtattgcatgttacttttgtcaaaataattgtcctcttttagaacatggtttggatattagatctcttgaagaagagagggtagccgaataattacttttgtttgctgtgctacaggaacctgaaaatgcctgatagccaaagtatggaattggtaagctgatcgcctaggatgtgggcaattgaaataagatacatggcttccctccacatcattgcatgacttgttcatagacacatacggctcattggaacagagttttcgcgatggctatggatcattatatatcttggtgcgacgggatgttgtaaacaaacttataaacgttttctgctcctactaatacaaaatcaacaaattgttcaatattgcgaagaaaaagtattgcgtggtacacggtactacactctacctacaaaaccttttggtcctaagaaaggtccttggagtcggagtgtccatcgatatcaccggaaatccaagctgaccataaccccagccttcccttcaccctggcagtgtgcatcattatgttttgatacaaactgcacaagctggctagtccagtttggtgtgtgtcgtctgctctcaattgccctccatgaggtatggtctcctcgttcgagtggcaaagaaagatgcagttgttaatcatagagattttatcgcacctcgtgttggcaaacacaatgctgctacttatttgggcttggatgattcgccaagtgatactgcgctccttcgcttcctggtgcctcccaatcatataagtttggttatgccaccgaaactgttgttgctatgaaaatctcatatataaagaagttctcagctgtcgtcactggtggagaaatgatttttactcctggttggtaacctcctatagtcccggtttttcaaccgggagtaagatcgttaccaaccgggattaaagtttttttttctttttttgctattttgtatatctcacgcccattatcttaaatcattcaaagcaacgtatatagttcatcccaaatcattgacaacaacatagttcattctcaaaatcattcacaacaataatacagatcaaattacacattaaggaaaaaagaaaaaaaagaaaaaaaatcccgataggcgcgccgacctccaccggctgccgccacaccggcctccgtgccggccgccgccgcacgaggccgccttcgccgctgcgcgaggccaccgccgccgccacccggcctcctgagaatgggaaggagaggggagggggcggatccggaggaggaagaggaagatggggtgagtgaggagatgaggaagagataaaggtgagggatgaggagatagaacttatgtcgtgcgcctcctcctcctcgatctcgcgcgctcgcctcgtcttctctgcgcatgccgatctttttttctcgattagtaatatcaaccgggactaaaaataattaatagaggggtctgacatcacctgccgtttttttttgaaccgggggtaaaaatgatctttagtcccggttggtgttaccaaccaggacaggactaaagattaaaaagtagctctaaccaattgaactttagtccctatttttattgcaaccgggactattgtggaatttgttcgaccgatcaaagatggtttctccagtagtgcatattcttggtcgtttatctaccctcattttatattctgttgaagaaggattgcaacaatgctacagtgatgtaccgtcatagaccctggttataaattccataattctaagtccttaatgtttttgaatctgagcaaggggcatgctgacaaagcgtgtggaatagttggatgaaaaatgattgaggaattaatagctcaagtacatttgaactacttatgaaaaaatgggtaatggcttttcattcgtattttaccgtaaatggttatcggtaattcattagacacactttgattttccgactaaaaataaaagttacagctagcttacctgctgcccatatatgatcttctcagtttccctttttctatttccttgtttctttatctaataataagcatgtttatatctattaatacgtactttagctagctaggggacatttccctttatagcagcgccaatttttcaaatacctcgctatatgcatatagcagtagcaatgttgttaatcacaatcttgtttatttaagttcaaggaaaaaaatgtttgaaatggattgattccccaacattttagtcagacataactcatctaagcttttatttgtggaaatgatttttcttttgcttatacctttaaaaatgcatgtttggcagttcaggcaaatacagccagccgaggagatagcaatattatttggaaaatttgacacttagtagaatcttcctaattaaccagcatgatctgtcaaaaatccttgttacaaacaagtttggaaatcatgtgttccaatgagataatagtttctttgatttgcttggttatatgcttgcataattgatctcggaccgctcaaaaaaattacttgcttggtttaggccggctgcagcgaaatggcctgccaaatcagtttgtcatctttgttcaaagctaaaccacaatgatcagtaatcacgtataattaatccaattaagtttgagacagatccctgcttgttagcatattgagctcaaacgaattttgatcacttcacttttcgtaaaccttgatcaattaaggaacactatttgatgacgagcgtagttgcatgtctccgtttcttggattcaaatgacaaatagaacacatgcaagtcccaggaaacctagagaagttggtggaggccctttgatcgagctttttctcaaactctggtcagtattggctttccaaatgccttccatttctctgtctcgtctcatgagtacatattcagaagttcttaacttcagaactttttcgcagcaacattttcttcatcggtcatcactttaaatatttgcttgctcctgatcatcagtttatttgcaaggccaatgtgaatgcatgcataggttggcttaggttgggccggaatgcgcaaaccagaaattgtagcaactcctgatcatcagtttatttgcaaggccaataaatgcatgcatgggttggcttaggttgaaccggaatgtgcaaaccacaagttgtaacaactactagagaactgatatttagtcctgatttacaacccccattttctaccagttgtagcaacagagctggtactaaaaatatatagcaagtgaaaaaatatgtgggatgtgggattcgaggtcaagatctctcacctcagccctcacacgtaaccatcacacctactacacacatctaacttgaacagagatactttccttttgaacttaccttgaaggcatctttaacaccggttgataacacacatcagtactaaaaatgaatctttaataccagttggtaacaccaacccagactttttgatcttctatctttagtctcggttggtaacatcaaccgatactaaatatgcatttttaatatcggttgataatactaaccggaactaaatatatttccaggggcttggactttaaatgcaacagaaacaggatgtagagacgatttgaaaattttagaaccggtactaaagcatctctagtattggtttttaatctaaccgagatatttatgattttaggtaccatgtcaaaagatcagttctctaatactgtgtggcataggttgggccggaatggtggtacgatgaacatgtggcccatattggacaggatatttgaggtacgatatgaagaatcttgggacctactgatattctgtgaggctttggccatacaaataaatgtcggcttgcatgggcgggattgggactgtagtggagcacatcaggccacttggtttgctcacaccggatgttcaatgttgcgaggttggtttggtcacctcaaatggcagagctacctctcgggcaggttgagcggccgcacgggggtttcaccattgttgtttgcactacggatatttattaacacctattaaaattagtcgatcatcaaaaaacactattactcgtcagggtttaacggtgccgccggctctatcactgtactcgcctcttatgcatgatcatgtcgcccgtgccaagaccgttgatcttcctcgttgacagcgtcaataatctctcgccggccaagtttttgaaatctcagattttttaaaggttaggtgtagtaatcccatattttgagggcattaatgttgaagacaaatgcaatatgcacatcaagtcatgtggataatcaatatagtcacctcctttaagagcaatagaccaaaacaaccattcaatttatagctatatcacaacacaataaattttatgataggtgatgctccatttacatcacaaaaaactaaaaaaacatgccacgttccaaaacctatgatgttgacatgacaaaaattctttcgtcacctatcatgtgtttttaatcatgttctgtgatgaaaacacttttttttccattatgaagctagtgacgatgtcatttagtttatgtctcttagttttctcattgtcgaacctaggaaacgtcacacattatcttgtgccatgtcaagagccatgctattgtcaagttgtttatgtgctaagcccaattataatcccggttaaattttggcctacccatctaaagagtagggatttacgcattattggcatgtgaaggtccataaaatgagcaacctgtttatgagctcgatataattgcaaacctagttagatataaatctagttaagatgtagcaatttacataatatgttcacccaacttgttaattcatttgaagtggtaaataacaagtggactaagggtgtgtttgaggagaaggagattggggagattgggaagatacgcaaaacgaagtgagccattagcgcatgattaattgaatattaactattttaaatttcaaaaatggattaatatgattttttaaagcaactttcctatagaagatttttttaaaaaatacaccgtttaatagtttgggaagcatgcgtgcagaaaacgaggtcctttctcaccctatatcacacaagctaacgcagcctaagtccatttcaaaatactacataggtctaaatattatacccagtaacaacccatatggccatatagcacagaggttattgcacaggtaatatccaacaaaacccagtggagatctaatacagtgtaaatacatatggacaaacccagtcacatatccaaataatagaataactgaccataaattaattataggtcactaaccaaacaagtacatgcaattgcatcacaggttcacagccctaaaatacattataggtttactgaccaaattgaccaagctactgcagaccagggtctgttacacataaatgtgttgcttcggcctgggctttgttacttgcaattaagacaaccatcaagctactgctgactggtatatataaagatatagtattatgttcaaaaaaaaattgaatctttcgaactaacaacactaataagtgattcatatatgataacataatcatatgagtgcctcgaaaagggattatctgacttagctattgtgcagttgagtcactgacatgtggattatagcaaagtgggattcatattcatatgactgtgactcaattgcatgtgtagttaagtcagagaatcctgtcaggcatttcccttaatcccggcagtgggcactgttctattttgttacatctcctttagtacaggttgctccgttggttggtgatcgttttgctgtcctaatctgctattcaaaccaaatactcgcttgttcaattgatactcatcgatcgaaagatgcagacactgctgcggggctctcagcatagcttggatggcctactcatttggctgtgttagagtaaaaccagagaagttttatgttggctacctcaacacagattcttgggtaggcttggttggcctaatcacagtgcactcctttgattcctggtgtttcccagtcctatatgtgtaggtctacatgccacatttcccatggtttccgttgctatggtctcaatgcaaaatcatgagtttccctcttcatgatgctcatgcatgttggcacggctatgttttatttataaccgtatgtgagcagatatgcagagtttaaccatatttgagttagatgtatcatctccacagaaagcaaagttggatgtgtgtcatctggatgaacctattagcagtggcattagttacaatttgttatatatatatgttcgtgcaaaaacatttttttcaactagcgtagctctgcaaattgtgaattaagcaacactaacatctgagctgttaatattgtacgacgtaacctagcggaaaaaaaaatcttagaacggaggaaatgaaaatagtacaaggctttttattttctttatacaacgaaattcatgtaacatgtttggcagtttgggagaatgcagccagaaaatatagactagacagcgacacagagatgaaattaactaaactgggaaattgcaaatttgaaaactaaacatggacgaaacaatgctgcagtagctcacatttctaccataactgaatttgcacatgtgatccttctgtgggacccgttgtctctcttcctcatggtagagtttgcagccatcatcgtgcatctttactttatttctgtccggtggcattttagccgactgatctggagagtagactagcactgatatatgtgcttccataacgctttactccccctagttgtgggacactttgatgcaggagactctatatcatccggtttaatttcaataagacgcaccattgatactttttgaaggttagacggttgcgcaagtagatttgccatcgtttgggtcatgatgcttcctaagcctatgtatacgtgtgcctacatcacacaattgcgaagtagtaaacctctcattggtatgtacaattttcatggacgagttgtaggttccgtaagtctgcttcggttatctctttatgctcatcttttatatccaaattaggagatagtacatatgtacaacggaaaaaaagtgttgtaccttttgtattaattaagtataaatatgtgggtccgcatatggttttcatctgctataaattttaaaattgagtcaataaagcatatgtgttaagataaatggtgcccatactagataagtcgcaacaggttacaataggcatctatgccatttcagatggatgaggacaggatcgcaacattatgttgcctatattaaattggcctaaacatattatgaaggacacgcagcacgtatacttggctcgccagatatcaggtttcgctaagtcggcttcctccatagcgtggttgttgactcacgcccatgtccctgttgtactctgtggcatctctttgggctccctcttccatgtcgagatcctctcctcggtgcgaccacccccgtctttgtgtgccaccatcgcgttcttcatctcgccaatagcacccgcccaatgggtatatgattattcttgacctcgatatggactaatgggtagctagctcaagaatgtgcacacttcatataggatgcgataacaatagttttgacaaaactaaatgaggacacgacgaagttacatgacagatgatattgcatggtacttttgtcataataatagtactgttttagaacagggtttggatggcggatcacttgtagattagatgatgagcaaataactactttgcctgctgtaatacagaatcctggaaacggctaatcaccccttcaaggaatggacccatgtagccgcgaagtacggaatcagctagcttaattatcacctgagattcaggcaattcaaacaagatatagatgtctttcctcgacagcagtgcagttcatagacatggcgaccttgtcggaacagaatcatcacgattccaaaggcaggatttttttcagaaataatgatattgtctggtacatgctgaatcgtatgagtctaactgcattcggcagcaggtgatagagaatatttctctcgttgtgtgtttgttgcaaaaaatttctatcagaaaattgctttaaaaatcatattaatctatttttaaaatttaaaataattaatactcaattaatcatgcactaaggctcatttcgtttgtctaggttcccaaccccttctcatcgttttccgctcacacgcttttcaaactgctaaatggtgcgttttttttaaaaagtttatatacgaaagttgcttaaaaaattcatattgatcaatttttttaaaaaaaattgctaaaacttaattaatcacacgctaaaggctgcttcgttttacgtgctgggaaccctcactcccaaacacaacttaataggccacctcgttttacgtatcttcccaatcgtatgtgcacacacccctacagtcttggcatacatcctgacagtgggcatcactctatttttatagatcttcgccacgctggttagttaggtttggtgattagatcctctgcttgctggactgggattttgggatttgactaccacacaaagggcccactagttgtgttatagtgaaaaaaatggaggctatatatcattaggtttcaataacactctgtggatgaaatggctcatcggtgattgctctgaatgccctttttggcccagatgaaaaaaaaaagaaaaaagaaagggacacccctttcgttctttcagctaccagcgaatgcgtagttgcttttgggctcatgttttcaacacgagtggtgttagaggtattctttggtcaggcttctgggcctttgtgcaacttttttttattgcgttaggtttttgttttctactagcccacgtatgcaaaaaaacaaagcaatggcccactaagtagtaactactccctccgtttcaaaatgtttgacaccgttgactttttagcatatgtttgaccgttcgtcttatttaaaaaaaaattgtgaaatatgtaaaactatatgtgtacatgaaagtatatttaacaatgaatcaaatgatatgaaaataataaataattacttaaattttttgaataaaacgaatggtcaaacacgtactaaaaagtcaacggtgtcaaacattttgaaacggagggagtaggttatatggggcctcatgtgtttaggcatgaataatactacctccatattttaatgtatgacgccgttgactttttatccaacgtttgaccattcgtcttatttaaaaaaatttatgcaattatcatttattttattgtgactagattcatcatcaaatgttatttaagcatgatatataaatattttcatatttgcacgaaaattttgaataaaacgaatagtcaaatgttaatcgaaaagtcaacggcgtcatacattaaaatacgaagcgagtatgtagctcggaccttggccttgttgcatttggtaattaattaagaccttcaatatactgctgtgagtatttaaaaatactattatgttcagtaacaaaactaaacgggaataccatgctgttacatgaataatagtactctttcataacatagtttggaaggcatatcagttgcagattagaggatggccgaataaccacttttgtctactgtgtgctactataatgtgataataggcgccatctcttcaaggaatgcactcatgtaggtcgaactcactggttagccaagacaaccacatactgcagaaacaacaatgtgtgccggttggaaaaccctcatgggtgccagatttcctaatctgcatctagcagacagccaatgcattgcaaaacaaaagtcggatcaatgcatttgcttgataatagccaatgcattgagtagctcctcatcccacatccgcatatcaccatccatccatcccacatccatctagagcaaaatcgaagaaattgaaccacaaatttttcgcacaaaaattcatcactccaatgaaaattcattacaggaaatatttgcatgcatcaaacataaagaacaagatgaagaaatcagaaaaaaaatagaagttagtccacatgccctggtaattcagccaccatcgtggagaaacctctttgcatgccgtgctgtgccaaagagggggtggcgccaaaaaaggaggcgccggaactggccacccccgagcggcggtgggaaggggccgaaaggaggggttgcactggtgggaagaggcggagaggaggtgcgacgctggtggggggtagcgccgtatccagccgctccatagcaccggtcggggggaatggcaccagatccggtagcccccaagcaccgggtgggaagggtggcactggatccggccaccaccgagcatcgttgcggaggggcggcaccagattcggctgccgaactcgacgttgcaggtgcgggagccatactcacatggctgtgttagagtgaaaccatacaagttttatgttggctacctcaacacatattcttgagtaggcttggtttgcctacctatagtgcacccctttggttcctggtgtttcccagtcctatatgtgtaggtctacatgccacatcctagcgaagcaccaaaccggtggcctccatttgctaaggcctcaatacaaaatcttgaatttgcctcttcgcgatgctcattttgacacggctctgttttatttgtaaccatccaagtggcagcaatgatgtagcatgccaattgtgttgtatatatggagtatctgtcatagcccatgtgagcagatacgcagagcttaaccatatttaagttagatgtatcatctctggctctctgcagaaagaaaaagttggatgtgtcatctggatgaacctattagaaatgactttagttataatctgttttatttatgttcgtgcaaaaacatttgttcaactagcgtagctctgcaacttgtgaattaataagcaacattaaatctgatcgagctattaatattgtacgacctaacctaacgggaaaaataatcttagatggtggaaatgaaaatatagtgcaatgctttttatttccttatacgacgaaatacatgtaacatgtttggccgtttggaaaaatgcaaccagaaaatatagacttgagacagcgacagagaagaaactaattaaacagggcaatcacaaatttgcaaaaaactaaacatggactaaacaacgctgcagtagttcacatttctaccataactgtacttccattccattatgcttactcccccaagttgtgcgacacttcgatgaagcgtaccgtatatcatccagtttaatttcaataacacgcaccgttgatactttttgaaggttagatggttacgtaagtggatttgccatccttcgcttcacgatgcttcctaagcctacgtatacatgtgcctacaccacacaattgtgaagtagtaaacctctcattggtatgtacactttttatggacgagctgtaggttcccttagtctagttcgattatctctttatgcttatcttttatatccaaaggagatagtacatatgtacaacagaaaaaaagtgttgcaccatttgttttaattaagtataaatatgtggatccgcatttggtttccatttgttataaattttaaaattaagtcaataaagataaacggtgcccatactagataggtcgcaataggttacaatgggcatctatgccatttcagatggatgagaacaggactacaatattatgtcgaatatattaaattggcctaaacatgttacgaagcacatgtagcctatatagttggctcgccagatgtcaggtttcgccaagtcggcttcatccatagcgtggcatctctttgggctccctctgccatgccgagattcactccatggtgtgaccaccttcccataattgtgtgccaccgtcgcgttcttcatatcgccaatggcacccgcccaacgggtatatgattattcccgacctcgagatggactaatgggtagctagctctagaatatgcacacttcacataggaatgtgataacaatagttttgacaaaactaaataaggacaccatgaagttacatgacaaatgatattgcatggtacttttgttattataatagtcctcttttagaacagggtttggctggaggatcacttgtcgattagatgatgagcgactaactactttgcctactgtaatacaggatcctagaaacagctaatcaccccttcaactccaatgaatgggcacatgtagccgaagtaaggaatcagctagcttatcagttatatatcacctcagattcaggcaattcaatcaagatatagggcctgttggcggagcatctcccagaatcagaagctcccccaattaaaagcttcaaacaagatggctttcctcgacagcagtgcaattcatagacgtgatggccttgtcgaaacagaaccatcacagttcgcaaagacaggatatttcagaaaaaaatgatattgtgtggtacatgctgaaatatactcttatctatcgcaccttttgatcctatgactctatgagtctaagtgaccagtcaaccaacccctacacagccttggcatgacagtgggcatcactctatatttttaagatcttcgccacgctggtagtcaggtttggtgattagaacatctgcttgctggactgggatttggctagcacaaaggtcccattagttgtgttgtagtgaaaaaaatggaggctatatatcattaggtttcaataacactctgtggatgaaattgctaatcggtgatagctccgaatgccctttttggcccgatgaaagaaaagaaagggacagcccttaatttgtttctttcacttaccgtgccgaatgcataattgcttttcgggctcaagtttttaatacgagtggtgttagaggtatttcttgatcaggcttctgggtctttttgcaattttttattgcgttagggttttttttcctactggcccacctatgcaaaaaacaaagcaatgacccactaagtagtaactaggctatatggggcctcatctgttttatttattttttttaattcacttgcaaaaaattatataccaaaactttacacatatgaagtttctatatacaaagttttcatgcatcgtgtttcgttgcatatagtttatgtgaaaattgctatgtgtaaagtttcaacctatcaatttctttttctaggccagaacattgttcagtgggaaaaaatatgtgaattaaaaaaggtctatgaagaaaagcaggttgtgtcaatcgtgggctcccaaataagaaggccaacaacgcatagcaggctattactccctccatttcaaaatgtttaacaccgttaactttttaatacgtgtttgaccattcgtcttatttaaaaaatttaagtaattatttattcttttcatatcatttgattcattgttaaatatacttttatgtacacatatagttttacatatttaacaattttttttgaataagacgaacggtcaaacatgtgctaaaaagtcaatggtgtcaaatattttgaaacggagggagtattttgaaaattactcccgcacgtgggttctctttgttcaaatgcaacagtgtgagcacacaatgtcacgcagaacaaaaataaaaattcaatgggacggacgacatctttatggtggagacgtcttatagaaaagaaacaacatgtggagagacctggacgtgattatgtgcggcgaggtctcaggatagcttgtgaactagacctaccctatgatggattcattctgaaggtttgacgatcagcaaactagctgtgacattctttacttcacgatgcttcctaatcctacgtatgtacctacactacacctatacggatggacaaaggtaccccaaattggtttgagtcagaaaaccggcatctattgtgggttcccaacctgttctgtgtgtagtgaaacctctcatttgtatgtaaattttccatggacgtgctgtaggttccccttgtcttgtcttcacctctctgctcttctttcatattcagagataatagacatacacgatgaaaaaaatactgtatttttatataaatgcaacatgtgggatcaaagtagtagggagaatccccataccagatagaccctcaagcttacatccgactcctagcccattttagatgtataggaaaagggctgcaacattatgcagcatgtattatgtattaaatggacctaaacatgatatgaaggacgtgcaacatatagtagtcccgcaagatattaggtttataagtttttagtctaaatactcttatattagttttggctgtacacatcttttgggtatatacagaggctggattttaaccaatattcctattaaaaaataatatgtttgatcaagttgccttcgtccataactccatgtaccgtcgcctccctctaagcccggtcgccaaccggcttggctctccctatgctgctgtgatcctcccctcgccgcgaccaccaccctgccaacatgtgccagtaccgcactcttcaacgcgccgatgacacacgccatgccgggcatgcacatgatagataacattgactgtgttctttcctagacgaattttacgaaaataagatagcacacaccaatcaatggcgagaaggaagattattgacgatgttcctaggcagtgcaacgagtaggggtgggcattcggactagaccgaagtttcggtccggttagttcggttttttaaaaattcggtctttggaaacaggaaaccgaagttgttaagcaaaaattactaaccgctacttcggttaaccgaaaatttggttcggtcttcggtctaaaccgaggtgctcgaaccagaacgtgcgtcctcttcaatcttctcgtcttcttgctcctgaaaacctccatggctccacctcagtcacatgggacggatatccactagcatggattgcatggtgacaagtgctggcgggacggaaggcgacgacgcggcagaaatcagccgcgcgacgcagacggcacgcgatggcacagcggccggcatgcggctgtgcagcaggatcagcaagccagcagcctgtggccttgttatggcttccacgtgaccacacgattgcatgcgacactgcggcgacgccggcgagtagcagcatgcggcagtactgcagaagacagcggcgcggaaggaaggagacatgcgcgtgggctaactagggttaggagtgcttcggtcaatcgaatggtggggtcatagggattgggtcattgacgtggatttgggcctcaccttgttgttgggctgttttggtccatgggatggtcacgttgtctgtttagtgattggtattgatttggtttcttcggtcctcggtttcttcggtcctcggtttcttcgggtagtattgcacgatgaccgaatctttcgaagtttgttcggtctttcagatgtcacacccgaacaaatgaccgatgcccgagagttcggtcttttcgggtttggtttcggttttttcgggtccggtcttcggttatcggttttaatgcccacccctagcaacgagcgtgcaccagatggaaggcacctcctctgccaatggggatactcgtacaggaatagtagatgggggtaggggaacctacaggggtgaattacctaaagattgttgaactggaccaggccactggccgtctcccaatctatctccaccgcacggctgcaatcatactgattctgactggtttattatttgcaaacaacacataatacctatctatacgtcagaatatcagcattcggtataaaaaaagtatgataaatacttttattctgtttataccaagatacataaaatttgagcaaatgtgcaggtagtaattacaattagagccattttacggtccttgaggaggtactatgagataccactttttctattgtaaattgatacctcgtggtacctaggtactacgaggtaccatgaggtaccaaattttacactaaatttttggtacctcatggtacctcctcaaggaccgtagaattgctcttacaattagctgtgcagtcagaagcacagcgttgcccgctgttctgcccatttgtgttggcactaatttggcattgttgttttagatgcacacgctacatgtcatgctaatcgccttcaatagcacacgcctctgctttgaagatcataagcaaaagcggtataacgttctgtcctattagagatcttcacgtacgggcagtaacaggatatcgaagatcaccttgtaccatctctgactcattgtgggtgggaggagtatcagtattcccaatgccttccacttctatttcttatcgcgcatacttgaaaataaaaacctcttgaactttgatggtgttgtccattgcttgcaaaaatatccgtcctcttctatgcatgggcatccactacttgacatatatagcagtttcaccattaataaccaaattattagccaagactaaatgtacacacattaaaaaaaataacatcactttagatgtagtaattcctgcacatggtatacatatagcaattacttcctctgtttcatattataagactttctagcattgcccacattcatatatatgttaatgaatctagatatatatgtgtgcctagattcattagcatctatataaatatgggcaatgctaaaaagacttataacctgaaacggaggtagtagtaaagagtaccgtttgtacttgccgaatggaaaaaccaaaaaaagatatgaagcccaaaaatcctttgaatgaaacaaagccggcaagtatgtgcacaagaaaagtctgaagcccaaattaaaatctagaatttatatttaagatgacaactaatgatatatagttttctaataatagttaacatcaccacaaaaattctatctcatccaatctccagaatgttttggccgaccctgtcatacattttcccatcgtcggcatcatgacctaacctcttctgcccctagagcaaaagactagtccccctcccgtcgcgctgtcctttcatgtcccatttgggcgcctacttcgcagtgctattggttttcccaataacttccaaccctatttgcatttgtctatcattctatgtgatatgccttaaacttcactagatggcctgactggtgccatgcatcagcagcaacaacactacaacagtaccacatcctcgagaagcatcagcgcaacactagctagcttcatatatgatgtgcccaatttatgagttgggcattgcaaaaggtgaaaagaaaatatatcactccccacatcactgtaactcttgcacatggtgcaatttaatcaagtgtacaattgtacttggtgaaagtaaaacaaacagagaagctgtaccgaaatgagtgaatgcaattctggtttgaaatttcagtaatttcggaacaccccaaccaccccctccaccaaagcaagtcattatctcagtcgaaattttcgggttttcataaatttttgttgaattatttagtcatattcagttaaattgggttaaaaattaaaaaaaaaggtccaaaagtaccaaaaaatcatgaaattgcaggaattttggttctactgaaatggcctaaattttcggtgaaatcgaaagtgaaaaccctgggcaaaatggtgaataggaacatgactttaatttgagtcaaaatagccccacaacggctagcttattaaggctgaagtggacatgaaaaaccagaagtttaaatgatatgctgttgtagctaacacaattttattatatcacaatactatgacacagatttcgtaattgttttcgtcatcgcttcttagtctataaggcttggacaaatttagtactagcatcaatcctcaaagagcacgatggttccaacttgcctaagctaacttaagctgcttccaagatcaccaaagccctgatggtggaactctcctggattgtttcacaactagtatgggttttcctggatgccttccatccctattatgtctatttttcaggtaaaagacaggagcatgaggtctgttcagtgctatacttatagcaactatttatacaacaccattctcatagtcgggcaacactttcaatgttaaagtttatgtcaaatatgtgtatgtatatagtcggttatagtttaggacttgaagttgaaacatgtatatgatagagttaggtttggactttatcctatgctctctcttaaatagagaggcacatctattgtaaactcgtgatgacttggtataggcgcgagggagcgtctgccggcaatgactggctgagggtcgttgtaaatctaatacattgtaattatgatggaccaaggaggagtatccgtaatcagtgttatgtatatataggctacggctgaaatctgttattaagtatcgtgtctcggtatcatcaccgtgtttggatcttctatgacgtttatttcgcgtttggtttcaatggtgatttcggacgagttttacaacatccaatttactaacggaccatttgattgcataccgaaaagaaaattgcacaatgaaaagaaaaaaaatattgatatcagaatgacgagtacaatttcagggattttagaaaatttcggtacaaaattatttaacaatttttttaagataatgaaaatctaataaagttatgactgaatttgaataaattttgaccaaattaaaattttgaaaaatacaaaaattgtggataagatagtttatggctgggggttcaaaattaccaaaattgaccaaaatttcatccctactggtaagacgactagatgagatagcctcgatcggaatggaatgattcttgtgctcctttgtcatccttgaccaacaattttgaccatctatcctcaagctagaattcataccaatgcttatttgacttagtttttcttcggcagcagctaaaaaggttgtacaagcattttcttgtcaaagaaatcaccatgtttattctttgcttcaacctctgtgaattgtgttgatcatccaatctcaccatgctactgtatggaaaaaaatttccttgtctaaggagcaccaaacttggttgccggtgcgttcaatccatatcggtcatcaactgctaactgaaggcgttgtacatgttcttagtgactgacgccctcgtggttccctcaaaccacctctaacagatgttaccttgcaggagtattagtttacccaatgctttccacttctatttctataatatatatgactctaaaaaatattgaatctctactggtgaactgcggttgtaactataatagtacaacactaccttcttccccgtgcaactatcacttcatatatcatatatgttcatgatatctgatctattgtgacgacttcttccttgtgcagcctaccagtaagacagtaacacagcttttcaagaaacgactcccacactgagggatttgctctgcaatagttctcacctgcatgttttgactagtactacagttcttccatgtctttcactcctataaaattcacacacatataaatatattggcatacaaagtttttgcgcattcaaaaaaaaaaaacttcattctctgccatgagtgagttcacacatttatatgctcaaccttgatgttcatttattagaatggccagtgtactgaacagtacttcctctatatttgctgaaaagaaaaaaaaacagtagaaaataatttggccaaaaatgtgaatctgagtgtaagaaaaacaaatcgagttaaaaagcactactggcattcattaggcaaacatacccataagtattaattttattcgagaaatcaacgtctggaagtttagtactcgagcttgatcaatggtgcctagaagtgtttagtgcaaaaaaaaatgtaaatagaatcaaagagaaaacatgtgtgccattccattgtaggctcagaatttcaactgaaatcacgtgtgtggacgtgctacaggatcgaggtggaagggttcgaaatttcataaacccctcacaaaactagttcacctgaaaattttcactttttaagccaacaaattttattcaaattcagtcaaaatgtgtgtgtgtttttttttgttctaggtctttgtatttgcattgccaaaatttgttagttttataaataaaacatattactttcatcattgtatatacatttataattccaaaacatccactcgcagaaccacatcgaaataaaaatttggtaaggtgtcaacgatgttattggccaagcaaaaatttagctttaccaacaaggcaacatatcaggtggacgatttgagatggagtttgtgcatgtgtgcacgatttgctttgtattcacctgatgtgttgcctaccaacaaatggtaagttttattttagcaacgaattgaacatgtccagaatgttgttattttaaattgtttatacctgaacatagatggctatttatttttttttaaaaaaaaagaaggctcgattgttgcatttcaattcagcatgggcataattagatggaactgcacgagaagaagtagaacaaaaagatgaagctatggcttagcagtatactagtctgaagggaactcttgtagctagctcagaccaatgcagccagtaaacttaacaaaatggcagatcgaactcgttaaaatgtcatcctgtactttgtgcactattattgttttccctgatgtcttccactcctattttatctatgcgtcgcgcgccagcaatctccacgaggcacttcacacatacgctcaaccttaattaaataaagttctatcagcttggcatttgcaaaagaaatatttgtatcactctatatcgcaatagctacagtttttgcacatgagatcggtgtactgaacttataatcatgcacaagctagattctatttacattagtatcccaaggtacctataatcatgcacaagctagattgcccgcaccattaattaatgttgtgtgatacatgtcatctttttatttgcacaggattgtgtgagattgcatgtttttttatagtaaaagaaatactaaatgcatacgctcctaccaatactgtactgccaaaacggagtaaatacattacgaagttataaaccaattgacagtaatatttttactaagaacgaaaagtaactatattactggaaagaatgatgagtaattattttattggagcaatatttatatttgcatagaccctaacaaagtggaaacaaccaccgttagtaacttttttgttcggctaccactgatagtaattcttttactggatatagatggtgggagttagtaaaaggaagtaatttcggcagtagggagggaggcgatccagcttggttgcgctatggaaaaggtggtgaaaagaacaagaaaacacgtaaaaggtggggataggaccacagatctcttctttctataaagttaatgccactaaacacctaaagctaaacatataaacataatatttattagcactcgtaaaacctacatgtaaacatgccacatcaaaactcaacatgcaaacatatactaattatatcacaatttatttcattcaaaaactaaacatctatatgctaaatcatcattctcaaatcattttcataatatttcaatccaaatcatttcatcatttctcaactatctaacgtatatctcacagcaaattgcggggcatcatcttagtgatttaaaaaagggaaaactagaggagaaggagcttggaggcacgccattggattcctagcacgctacatgtcgtgtagcataaccgtatatataatgaaattagcgaaaagtgataaggtacaaatgaggaagtgtacaagttttttttcctgtattgagatgtcactatcaagtactaatacaattcgaatgactcgctgccctgttctaaactactctgttaactttggaaaaagaaaacatcgcttccattgcttctgaataagctacaaattttgcatgactttttgttgtttcactagtttcattctgatctcctctgcctcttgtcccatatcaccgctggttctttttagcccagccatactcattcagctcattgttcttgagggtacaagtcaccatcttctgctgtggcattctctaccctatgcacctatcaccaaagcagcttcctaaaagtgttctgtctctcttggcgatcatctccctgcagcctcggatgcatgagaaacactacagtacattgaccatcattaccaacacaaacaacacggcttggctgggtggaggagccaaaactattcgtgcactccaatatggtcaagggcaggagtagtacaagtaattatcctgacgcctcccacttccatctctacactgtctgtgcccagaaaatttaattttgaatttcatttgaaactgtgtcaaagtgcaacacattactgctggtaacaacattacaacatcatccccctttgccaggcacatatctccttacgtatgtagtgtcctcaccctcgaggccttgatgtgaacatatgttagccagacaatgaatatgcatcgtaacaaaaatatataaatatcaatgttgctgtgacgtttaattgcacatggtgtacgttgtgaagagtaccattatagtacttgattaaaatatataaatactagtaaaaaaataaaatatacttcgtttagtcatgtcagaaaatgttaagactaggcgttcaatgtttcttcggaattaagtcagtgcaatatgaaaataaaatattacttttgagtccaaattaatatatagatctaccaaagctcgttaatcaagaggagatgatgcataattaaagcctgaagtggagatgaaatatatgaagataagtgtaagaaaaaacaacgaataagacagtaggcgagattgttacgattttgcagttgtggaattggcattcgtaccgctgagttgagcttagtagcatgccaaattgcttggctgttgcattggtaagaccatcgaaccatatataaatcttaagcatatatatgttaacaaattataattgcacttcttaaggagcagaatggattagctgattgtgtaggatcgaacaggaagaactaagccaaccagagaggtgaatggttgtaataccccaaaatcaaaacttttaccagaattaaaagttatcctcgaatcgatgtcaatcagtctaaccgaagttgatccgctggtctgaccaagccgatgtcgtcggtctgacaggagtagaccacccggtctaacctccctaaagaagtcgtagtcgcctgatctgccatcggtctaactgccgctctcccgctgatctgaccggtgcgttgccgccggtctgaacgctggtatcccgttggttgaactgccgaactcgagcaaacacaaatcgaagatctctcaaagtagatgacaactttattacttctctctgggtttataaagtacaacaacaacactcctcacgaaaatctcgactaaactcgaaatcctaactattctctcaactcaatgctctctaaagcggtaccgggaggccacaccttccctctctctatatacctgaggtaggcagcctaaagccacgaactaaacttgtacaagaagtcctaataccctaggaaaccttcccgtccaagaaactaactttacaaactccaattgtaccaaatttggaattcttccaaattcaactccgcatcctatacgcacataatacctccatcatatgccatatggaatcttcaccaaccacatgcattgatctttagtgtaagtatcccgcataatatgtaaccatccggacgtcatcttatcctcaagttgactctcgatccatcactggcaacactctcccgaggcaacaagacaacctacacatgcatcaaccaataaaacatattccgagcacaagctatctccaacttgactccttcattagcaaacaacagtattacatacacaaatttcactgttaacaaagtcataaacacaaattatcaacagatatccaatgaaacaacctgataccgaaactgatatagagtcggccggtcagaccgtgggctgaccagtctgaccactcaaagcacgtcggtctgaccggcaactactgcccggtctgaccggacccgacaatcagcagtccttgttcatcacctgtaaatccaatcatctccaaaaccacttcgccaataatctccaaatatcaaaaccaataatctcatttgccaattgttcatcacagaataaaaatcaaacacactttgattttacagattggtggtaacttttcctagctaggacattcctgcatggcttaacatccaaaggctctgttcggagttcattgttaatggagctgagtaattgtattggatgttgcactacaagcaacacgattttagatgtcccaagtactattcttatgtttcaggactaactgacagttgaggaaagccccagcatttatctgcaacccacaaaataggagctaaaatataaacatatggcactgtcgtcgagattccagggaattcgcattagatcatgtcctgattagttccaatcctataaaacttatacataccaatcattaaagatacattcatggagttccttactctcaatcagtactcaactttttaattttgtcgaatgtttcatgctaaacactattggaatactatggctgcagttgcgcagtttcacacactgaatggcaaggggaaaacaatatgcaaattgtctcaactgcatcttcagagctgagtatatatgagtagctagctcctctaaaggtacatagtgaactaagatgcttattatgtgcattgtttggggagtgtctccggatcgagggaagccagcctccgaagggctgcggcactccggagaaccatcctcccaaggagatgactgtgggtcgtgtaggatcgaatagcaagaactaagccaaccagaggggggtgaatgattggtatacccaaaaacttttagcggaaataaaagttaccctcgaattcgacagatcgcggtatgaccgaagtgaatgcgccggtctgaccgcttgatgaacgtcggtctgaccaagatctaactccggtcgaaccaccgagatcgcctgccgcagactcctgtcgacgccggtctgaccgccgtattcccgccggtttgaccgccgcgatgccgcctgtctaaccgccggtatgtagccggttggaccgccgaaacccggtgaaacacaaatcgaagaactcttaaagtagatgacgactttattacttctctctgtgtttacaaagtgcaccaacagcactccttacaaaaatttcgactaaactcgaaaccctaactcaaaactcaactcaattgctctcaaaagcaataccaggaagcctcacgctccccctctatttatacccgaggtaggcagcctaaagccacgaaccaaactcatactaggagtcctaaacaccttaggaaaccctctagtacaagaaagaaactttacataaccaatcgtaccaaatttggactccttccaaattcgactccgcatcccatacgcacacaataactccatcgtataccatatggaatctccatcaaccacgtgcatcaactctagcctaagtatcctgcatgatctttgaccaccacggtcgtcgtcttaccaccaagccgactcccggtccatcaccgcaaatactctcccgaggcatcaagtcacctacacatgaaataaacaaagaaaccatattccgagaccaagcaatctccaacttgactcattagtagcaaacaacagtattacatacgtatagtatccatctagaagtcataatcatgtaataattacggatatccaaataaacaacccgaaaccgaaactgacatagcatcggccggtcagaccgcgggctgcgccggtctgaccgcgcaatacacgccggtttgaccggctaccagagcccggtctgactggtcacataaaatgatagatcctgcgattcacctgtaaatccaatcctctccaaaaccacttcgtgagtaaattcgaaataataaaaccaataatctccaatgcccaattgttcatcacagaataataatcaaaacacctttgattttacaggtcaaggccatgtcggtccctggccgaggtggccgctccgaaggcctccagggatcctagagaatcggatcccgcggacggcgagtgcgatagagcctggaagggcttcggagatcggcggaagggctccgggattgctccaggaggccatagcacccatgggccctagagccccagaaggcatctcgagctccagagcgtgaagggcttttggagcccggcaagggagctccggaggctgccagaggcttcggagcttgggaggcccccagagttcaagaggccgcccggagcgattcaagcacttgatgtgcttccactggctaaagtcaggaaccaggcgcgagtgggctggaataaatgcgcactacgcgccccaactgcctctgacaccattaatgacgaccaagcggagcacgctattacccggggcatgcctttatccgtgtaataacaggttccctcgggaaccagcgctgcctcccctatgggcgcttcctccctctcacctgtaagattaccaataggtccgagggtggcccactggccagccactcagattcctcataggactaggggcattaaagccatttccccttgtatactcctgtataaatatgtaaaaaccgctctcatttggggcagatcgaatacagaaggaatattgatacacttgttgagcttttgcaacaacatgcagtacagtatgtgacttcctcaactatgtgagttaaatgatcagttggatttctcacaatcagaagaagcaatcacattgtaacaaaatacttaaagcagaaattgagttctgctcgaattctactggaaccagagcaattttgtaattgtaaaggtaaaaacatacaaaagtttaatgtctccaaattctggaaaatgctatcccacaactgaaaattgtgaactgtactgcaaaatatatattaataataattcaagtatagctagactctcttaaattaatatttgatcataatctgactaacattagtagctcatgatatctggtattttattttacaattactgctgtctgaaagatttagcaaaaaaagggatgagatatcaatgaaagtatgttctgaattaattattttgttagcaaggtcagcaaacagagaaagtaccgggttttctttgttgctgtcgtattctcatactaatgcaattgccaagactcactaccctgttttcaactgctctgttcacttgataaaaaaatacatcgtttaatttcgacttcctttgcttttgaaaattccagcgaattatgcatgcatgacttcttttattattatttcacttgtttcatttcaatcttctatgccttgtcacacaatgagctagatcacgtgtttccgcagtgtagaaacaaagtaccatgttttgtagtagttggtaattaattcctaaacgaggagcacaataatggtttagcgagattagctaccaagaaaaagagtagggcttggatgggaggaggagccaaaaatatcataattctaagctataatgtaagattgcatcctactacaccaatgagaaaaatccgttccatcgataacatgaggcttagttgaaaacttattagaagtagccatggcaaaaactcaagattgataaagatcgaaaagagcaaacgtggctctcataccacttgtagggtcgaatcacaagaactaagccaaccagaggggggtgaatggttggtatacccaaaaaccaaaaacttttagcggaaataaaagttaccctcgaaatcgatggatcacggtctgaccgaagtagtagcgccggtctgaccgcctggatatcgtcggtctaaccgaggttgtaacaccggtcgaaccgccgagatcaatcgccagctcctgtcgccgccgccggtctgaccaccaataggtctgaccgccggtgagatgccggttagaccgccaaaacccggtgaaacacaaatcgaagaactcttaaagtagatgacaaatttattgcttctctctgtgtttaaaaagtgcaccgacagcactccttataaaaatctcgactaaactcgaaaccctagctaaactagcaactcaattgctctcaaaagcgatacaaaagcgataccgggaagactcacgctccccctctatttatacatgaggtaggcagcctaaagccacaaaccaaactcatactaagagtcctatacaccttagactccttccaatcatactaaatttggactccttccaaatttgactccgcatcccatacgcacacaatacctccatcgtatgccatatggaatctccatcaaccacatgcatcaactctagccttagtatcccacatgatatctgactaccacggacgtcgtcttaccaccaagccgacttccggtccatcaccgtaaatactctcccgaggcatcgagtcacctatggatgaaacaaacaaagaaactatattccgagaccaagctatcaccaacttgactcattagtagcaaacaacagtattacatacgtataatatccatctagaagccataaccatgaaacaatcacggatatccaaagaaacaacccgaaaccgaagccgacacagcgtcggccggtcagactgcgggccggccggtctgaccgctcgatcaccgccggtctgaccggcatacacaacccggtcggaccggtcacataaaataacagtaaatccgatcatctccaaaaccactttgacgataatctccaaatatcaaaaccaataatcacagatgctaattgtttatcacggaataagaatcaaaacacacattgatcttacagatcctacaagtaatttgtattggatgttgcactacaagcaacacgattttagatgctccaagtacagttcttatgtttcaggactaactgacaattgaggaaagcccaagcatttatctgcaacccacaaataggagctaaaatacaaacacacatggcactgtcgtcgagattccagggaattcatattagatcatgtcatagtctcaatcctgattgcttccaatcctttaaaacttatacataccaagcattaaagatacattcatggagttccttactctcaaaaagtactcaactttttaattttgtcgaaagttcatgctaaacactattggaatactatggctacagttgcgcagtttcacccactgattggcaaggggaaaacaatatgcaaattgtctcaactgcattttctgagctgagtatgtatgagtagctagctcctctaaaggatagtgaactaagatgcttatgtgcagtacagtatgtgacttcctcaactatgtgagttaaatgatcagttggatttctcacaatcagaagaagcaatcacattgtgacaaaatacttcaagcagaaattgagttctgctcgaattgtactggaaccagagcagttttgtaataaaggtaaaaacaaacaaaagtttaatttctccaaattctggaaaatgctatctcacaactgaaaattgtgaactgtactgcaaaatatatattaataataattcaagtatagctagactctcttaaattaatatttgatcataatctgactaacattagtagctcatgatatctggtattttattttacaattattgctgtgtgaaagatttagcaaaaaagggatgagatatcaatgaaagtatgttctgaattaattattttgttagcaaggtcagcaaacagagaaagtaccgggttttctttgttgctgtcgtattctcatactaatgcaattgccaagactcactaccctgttttcaactgctctgttcacttgataaaaaaaatacatcgtttaatttcgacttccattgctttcgaaaattccagcgaattatgcatgcatgacttttttttattattatttcacttgtttcatttcaatcttctatgccttgtcgcaaaatgagctataatggtttagcgagattagctaccaagaaaaagagtaggccttggatgggaggagccaaaaattcatgcactccaacatgtccaagaaacaggagtagcagtaatttccctgatgccttccacttccaattgtaagctgtctgtgcaaagtacatttaaacatgaatttcgaaactgttgagtggtatgcgttttccaaggttgggtctcctcatgtatgtgggtacagaagtagcagcaattttcaccccggaggcaatatatatgtaatatagacaaacagagcgtgcatcgcaacaagaattattcatatcacttgatatatatcactgtagttgtggtgtttaattggagaaaaacagagcgagatgcgaaggctaggcattcgatggttcttcaagagtcaatggaaggctttcaataggtagttggttctgttgattaattaagcacttgggctaccaatttaaaactacgggtgtgtttagtccacgctaaaattggaagtttggttgaaattgaaacgatgtgatggaaaagttggaagtttatgtgtgtagaaaagttttaatgtaatggaaaagttgaaagtttgaagaaaaagtttggaacaactctattgggactttgcatgtataaggatttaagaggacaactctattgggactttgcagaacctcttgcgttggaggacacaactcttaaataaggcgctagattattttctctctatgtacattgcaataacattgtcgcactactgtcttattaaatgggaaacacttcacatatgctcagtctccacatcccattagttagctaggcactgcgaaagaaaatatacaacttgatatcactgcagctgcgactttgaacacggtatatcaatacccaatttacttggtaaaacaaacaaagagagaagagctgtgccataaaaaaaaaatcaaacattacttttgagtcctatatatagatagagctgccaggaattgttttgtgaaaggttagataagtaatttgctccaaaactcaattcaaaaggataagagcaaatcattatgttttttggttaccaccattgcaatgcgcgattatcattcacttgtttaattggctaaatggcaaagcgaccaggacagggtttgtaattttggttgccaccgaaatttcggtggttgccgaaaatttaaaaaattcatgattgccgggttattttggactgaaattatttgaatttttaatatattttgactgaatttgaataaattttaaccaaatttacaaatatttgataaaaactaaaaattttggggagatttgcgcttgctggtggggccgaaatttcagaaaattccaaaccatggatcaggatgatgcattattcttcatcttcagtaatctgagttttttttttgcaagggcagtaatcggattaatcgatttgtgaggattcttatgtacacccacgacttaccaactccaacataagttaatttccggatcctaataatctgcatcacccaattacttgtatttcgtactgatgataataattctcacatcaaatgaacatatagtccatacatgaaagagaaaagaatagataaaattatataccaataaggaccaagaagataggaattaggacaaacaacaccgaatagttgcagcaaggctaacgcgacgcaatgatgcctgatgcaaattaaggcccctttgatttaaaggaaatttataggaattagctctttgaatcaaaggaatgaaccctataaaatcctatgaaatctatctatctattatataataaaagtccattaaacttcctacaaatgctcccaaactgccacgtgtaccctacaaacgctcccaagctgccacttggcactatgataaattatagaaattcttaaaattctaaaaaaaagacaatacccaaccgttgattttcatttaatctggtcgacccgatatttttaaccattagatcaatctataaagaaaaaataatcctccaatccctatcagtattgtacctacgtggagtcgtagtaggtatacgtacgtacttggacccgtatgcctcctctcttcctcctctgttccctctcttatttcttattcctattcttatgcaatattaggtagaaagcacaataggtgagcacaattgacaattaaacaaatataacatctaaactgcttatatttaatctttcaaaaagaatgtcatgttttggttacaatttctgacttttacgtgccatttaaataattccaaaatattatgaaaaaataacgatatagattttatcatcaaacataattacacaataattaaattagaaaataaattactccccggtaagtcaaaataatataattatacgtgtcttatattatattatatactataaacgcttataaattgccacatgactctttaataaattagaaaaattcctacaaattctaagaaaaaaagaaaaatatctttagcattgattttcatttaaaatgttagaccaattaattttaaccattagatctatataaaataatataatggtgtggaccatgcgtacatcgatctaatgtaaaggatatgagaatggttatagcttccttcgtacacttatggaagaagaaaacattatatagtagtctaaaaaatcgagattcatttttctttctgaaacttaaaaaaatactaaaagtccattatacttccaataaacattatcaagccaccacatgcatattctacaaatgctcctaaatcatcactttacgctataataaattaggtaaaatcctataaattctaaaaaaaagaaaaatatcttaccaacggttttcattcaaatcggtggacctattaattttaaccattagatatatataaattaatggtgtgggccatatacattgatctaacgcaaaggaaaagagatcggttatagcttcgttcgtacatatagagtacaagacattggatagtagtctaaaaaattgagattcatttttttttcttgaactgaaaaaaattaagactttgatcggtcacaattttgcccccatcgacattactcaggacactgtcagcgtgagggggcaaattagcttgggactacatgtatgtatcatgcatgaccgagctaaaagctttatctaccaattattttagaaacttaaaagttaaaaactatttagtatttaaactacaatggttgtataaatggctaattctttcaaacaacaaagataaaataggataagcattgtaggcttcatatttaggattatgcaatataaacataatccataaaggcctaatgcatgttagctaaataaaatcacaaagtgattgtttgcattatgtaaaatcctaatgtttaatcataaattttagagttaaaaatatttaaatcatgacaacaatcataccacactacataataatcacacatgcggagttatttttcgcaatgaaaattatgttcctgctaagctacatggagtctcacacactctacacgaaacaataaactatctcctacgctgcaaaatcaatttagactcgagaaggctttttatttgaaatatatattgtgtcacatggaccgaaggcatccattaataaacaatgagacaatcaagtatacagagaaaaaaaagcaagtgcatctcagcaaaggatacagtaagttgtaaaatatgtagccaatttgctacataccaaaaggaacaccaaaagtaactatcaagttcgttgattgttggcaaacaatgatatcggcacaaagatttatatataccattattttcataaccaatcaatgtgaaatgacaactttaagccacttttctaacgtttttaattgaatatacaattatgttcatcacattctaaacaaatgatttccgcgagaatattgttctcatgttcctcaaatgtgcagcctcctatgtgatgagccttttgcctcggactcatgggctacctttagaaataacttttgtaatgtgtttacatataactactttagtggagtacttaacccagaaggtagagttgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctg

SEQ ID NO: 73679 - DNA, 3439 bp, Oryza sativa
ttgtgggtctttttactaacgttcattttatttaaaattattttataataattatttttatttttattagatgataaaatataaatagtattttatatatgacttgttttttatttttaattatgttttaaaatgaaatggacgattaaacgtttaacataaacttggaatgagacggatgagtaatatactgcgagtttaggcgcacgggcggcgggggtgggcatccgatgcggtggggttgggggtggggggcaagcaaagactggggcaagtacagtggtgtggcgccgctccggaaattcgcttcgcttcgcggcgcggcggctgaggatcagcgtcagccggatgggaatcccaggcgtggaagcgcgatttttaatttgggcggcccccgaggcggtatccgatgatctccttgtcggctacccgcgtcaaacacactggtatagtgcggctaggtacccaacttttctgctgttttacacaacggtccttcctctatttgactatgcctacccgtatggtagcaacttatttcctcctattgtagtaattcttaacattttcaataatgatactgtctctaaaatatatctttaacaaattttctattattacagtactttgtaaaataaatttatatgttgttctagtacctttcaactatatatttttcaaagttatttatagtaaagttataaaattttaacctcaactttgggtgtgtttagttcacgtaaaaattggaagtttgattgaaattgaaacgatgtgacggaaaaattaaaagtttatgtgtgtaggaaaattttgatggtcagaaaagttgaaagtttgaagaaaaagttaggaactaaaccaggcctttgtataaaacatcaagaattatagatttggagggagtactccatatccgttttatattgtgaaaaattttgggtttcatgctgtgaaacacttcaaaatgttgatgcatttcttttattgaacttggacaagaccaaaataacttatataatatactagaatagagtgaaaactgtttctacgcaaacattattaggtaccaagatgtgtacaatgtggaaagctatggtatgtattaataattcatccatttcatatgtaattatcgcttttccgtgattatctttcatgcaactttttttgttattatgtggaaagttagctttaagggcctgttcactttgatgtcattttcaaccttaccaaatttcggtaaagttaccaaaaagagtggctacatttagtttgttgttaaattttggtaactatgtaagaaatcctgcccaaattttggtaaggtattttttttattaaagtgaacaggccttaaaagaaaaaaggcttgcttatatcttggaacaaatttatactccagcaaagtcaaatacacatggatcgacctagctagccttttcatactgtgcactcaaaaccatacctttagtgtggagataacatagtatcccactacaattccactgctataaaacccctagtttattgaaataacaaaacaaagttctacaattagcaagccttaactagggaaggcaatgaaaacaaaaatcaaactacattagactaggtcaaaatgcacccacaaccacaacggttatgtgctcgagccagtatctcatactaccaatactacaccaacaccaacactacatactactactagcggcactgtacatacaaggggaataatacaagctaaaataaagctactccactcctagagaaggaggacctaaacgcaataaccaagtcaattaaacacggttggtacaaaaaggacacccgcccaatacaaaaacgccactacaaatgcaaccgcaaatgcacggccctttcccccaaaacccccactgcattcccccccaaacccacaaaccccgccgctggatcaacaccacctcaagctcgaagtgagccactgtcccaagcaaccttccttcttctccccacctcgttttctccaaatcgccattcacaacccatacacactctgtgcgcgtgtgtgtctctatgatgtcggcgtcgccggagttctacaagccggcgccggtgttctcgccgtgcagctcgccgctgcggctgctgcagcagcagcacggggaggatcatcaggaggagtacggctacggcagcagcggcggctgctgcaggacgccgacgggaggggagagcaacctgaaggcgccagggacgtgcccgccggcgccgaggaagccgcgcgcgcccgccgcgccgtgccggaagcggctgttcgaggtcgaggtgttaagcctccgcctcgaggagctcgagcgcctcttctggcgccctccgccgccgccgccgacgacgcagccgcagccgcagccgcagcagccgccgcagaagcgccggagggtggccaagctcggcagctagctagctcgccggagtagcacacgtgtgcgtggatggccataagtggtgttggttgggttagttactagagctaaagctagagtagttcggagttggtaggatttaggcgtactggcgtttttactgctgtacttgcactatatttctactgctcaaattatctccatggctagtatagctggttgtacactttgtactatacctgcctagctaaggttgctactactactactgtagcgtatcagtgcagtttatactagtatctgtgtatgtgatggcattgggggtgtgtactcctggtacgtattagcaatcaataggagcttagcttgaatttgcttccatgcatatatggcagttgcagtgcagcctgtgaagtaatgacaagttgtatgatccgtgtatacatccatcaatgtatcagtgaatcaatccttgcaacgaatacaatgagaagcagctcaatcctcatatgttctactattgcttccgtcctaaaatatagctacttcctattacatgttttctctactttgtgcaacagataggagtagttctcgaaagtatggagatactgatccatctgcgtagcaactggcaagaacgcaagatggatggattcagtttcagagtgagctgcacctcccaggcacagcacgcagctgggctgcaggaggtgcagggggagaggaatcattcaggaatgtgagacgagagcagaaggccaaagcatcgagtggtagtagcaagcagtaatgatgtgtgtcgctgctgtggctggctttgtagtagtagtagtaccgaaaatttttctgcaggcttggcacccggcaaggctgcagcaggggagcctgtgctggaggtacgagaaggaataattttggccaccggtgccagtaaatgtgaggacgtgtggtgttgggggtcttggttggggatccgagtccatctatcatcacaggagcatcgcaagcagcagctgtccatgtgttct

SEQ ID NO: 73680 - DNA, 29392 bp, Oryza sativa
aatgcgcgggctaccttcctagtttataagaaatgtctcttcacatgcaagttttgaaagaaatttaacatgaggtatatcctcatggaaaaaatctttttgagtctttatctctccttaaattcctgtgtcttttctatggcccaatcaaatgatcattcttatgtttttcatgtgttttaaaattctctgttttacacttatatttctatcagaatactatgtttttcctatccgtccactttttaaaagattgtcttcggttagaatgctatttttttaatatcaaccaaataaaaactttaactctcggtgggatcttaaacttccatatctcttttgaaatctaaaaccagtgttctgtacgatcagagttcaatagaaagatttaactgtaaaaatcccattcattgtatgtttccagattaattgatctggttcatctgtcataacaatgttctgacactgcttattcaagcttccccagtttttttcattttcgtacatagcaaagccaaacggatgctgaaacgatataagctactactccctccatcccaaaatatttaacgccattaacttttttaaacatgtttgtctgttcgtcttattaaaaaaatttaaataattattaattcttttcctatcatttgattcattgttaaatatatttttatatatacatatagttttacatatttcataaaagtttttgaataaaacgaacggtcaaacatatttaaaaaagtcaacatttagggaacgagggagtagcatggaatttctcgcctcagccatgtatccaaaaccgttacctgctcatgtcctcgatgccgatttgataattgatactgtaggtcctcaagttttatgtctccacggctatgtctgtcgcagctcttgctgagcaatgaattgtgtcatatatacttgcactggaatcttggatacctggacaaatgaagcctgtaatttgtagaagatggtcaattgattcccttaatctctcgaatctgcgtgttgtatttctcctggtaccttccactcctatatttgtatagtgttagtgtatgactaaaaggggcgagaccgtgactgatgctatgtgctgccggcaaaaaatgttagacatgcctggagtgtcagttcactcatatatatgctcacctacagtgtccaaatttattagctgcccatttgtaacaagcagattttttttatgggacatcgtaggggggagaactgtctacctgaatatatattacgtcaagaggtaccatgagataccattttttctattgtaaaggtacctagatattataagatacctttttttaataaatttttgatatctctctaagaaccgtaaaattgctcttacgtcaaacgggcatacacatggagagctttgatcgtgtaaaaggaggataatcagaggattacattggagattgcagagaggtgaaaactaagcggatcacatcatctgaagtgtgcaatccgtagagagtacatgagtactacgtatctcaggtacttctgagcatgcaccaccattatatcacgatttatttcattctaaaactaaacatatacatactaaaccatcattctcaaatcattttcataatatctcaatccaaatcatctcatcatttctccattatctaacgtatatcccgcaggcattatctagtgatttaaaaagggaaaaatcagaggagaaggagctcggaggcacgccactggattcctagcacgctgtgtgccgtgtagcgtaaccgtacatgcaatgaaattagcgaagtgacaagataccaatgaggaagtgtacaagtttttttttttcctgtattgatctcaccatcaagtactaatacaattggaatgactcgctgccctgttttaacctaccgttagctagcttagaaacaaaaaaacatcgcttccattgcttctgaataagctacaaattttgcatgactttttgttatttcacttatttcattttgatctcctctgcctctttagcccagctgtacacattcagctcattgttcttgaggtacaagtcaccatcttctgctgtggcattctctaccttatgcacctatcaccaagcagcctcctaaaagtgttctatgatggctgttcattcgctccctgcagacttgggtgcatgaaaaatgtactagagtatagtgttcttcattaccaagactaacaggacggcttggctgggtggaggagccaaaaatattcgtgcactccaatatgatcaagggcaggagtagtacaactaattctcctgacgcctcccacttccatctctacattgtctgtgcccagaaaatttaattttgaatttaatttgacattgtgtaaagtgcaacatgttgctggtaacaacattacaacatcacccccctttgccaggcacttatctccttacgtatgtagtgtcctcaccctcgaggccttgatgtgaacatatgttagccagacaatgaacatgcatcgtaacaaaaatatataaatatcactgttgctgtgatgtttaattgcacatggtgtacgttgtgaagagtaccattttagtactggattaaaatgtataaatactagtaaaaacaatgaaaatatactccctccgtccccaatataacaacttttagcccttaggatttatccaaaaatataacaatttctccatcaatatttttttcccaaccaatcacgatcctccactattcatttttcccacctacctccactactcattcagtcacaactcactaacattcacttttatctactttcttaataaccatgttaaactctaaaacttcttatatatattctcggatggagggagtagcttttagtcatgccagaaaatgtttaagactaggctttcaatgtttcttcggaagtcagtgctaaaaaaaatcaaagctcggtaatcaagcggagatgaaaatcaaatattacttttgagtccaatagtactaccaaatgctcgttaatcatacgaagatgaaaatctgagacatgcatgcatgaataaagcctgaagcggagatgaaaaatattcggcaatttatttagtagactagaaaagatgcccatgtgttgtaataggtagagctaatttaatttgtacatattttgtagataaataattacaacccattatttcgtttattcatgtccttatccaaatcacttattagcaaataaaatactatttatgtgcaaatcttttatatacatgttcttagcgactcaaaagcaaatgctgtaaaataagataaagtatgacaaaaaaccaaaaagtcgaattcaaaattaatttctaaaattttaaatttggcttgtaggaataattataagcaactccaaaaacacgagatcgatttatcctccagctttatctcaagtaagacagctgaaattgatgaaagatggaatcagcaatttcgatcatcctttatttcaattgccatgttcttttcgaaactaaaaccgatttttatggataatccctggtagcacgtacgatagtacgagtatgcgtggagactgacttgaaatcatgctaatatgtcataggaatcgtacagtgtaatacgaatagaatcgtatgaactgggcaatgatgtacgtgatatccacacggactctgcgagtttcatttgcttggtatccacattgcacggactctcttttgtagttcgctcgcgagtcgtgacttctaaataaatgttacgtgtaatgggaatcggatacggatgacgtaccatagttttgacaaaaacatcttcatttttcaaatcgcgggtgaggatgacgcagtcccaatcagacatgcggcaagggcaaatcgcgcgcatatcggatagaaaggacatgattttacaagaatataaaattaaaatcaatacataaaattaaaactgattcaaacacggatgacgtatcaaaattctagcggaaacatcttcaatttttggaatagtaaagattttgagggttgtatacatccactatatattcttctattaaattcacagtttaggaggttttatagtttaacagcatacaaccctcaaaatatactaaataaattgccgaatatagaattatcttctatattctctggtttgatttcgatctcctatcacattttccaagtgggatagcaaccgcctgcccacatgtgtatgtaaaattaagaatttttgtaggcgagcatcacaaccgtgtgaaaaaaggattttcgcaagctagaaaggaatgcagctcctgtgcccggggttcgtcatcatcatgctccctatctagcaaccgctgccatcgtcatcatcgatgtcatccccggcctcccatcgttgccgctggcggatcggcccctcccatcgccgccgccggctgatcggtgcacaagggagcttgtaaaaaaggcggcaggatcccggccagccggatgcatgcacgaggagggtaggcgacaggatccgcacgggagggggagagcccacggcacctctcctatctccccaaaccttgtttcactctccggcggagagcgaggaggccaaggccatggtggaagcgaggaggtcggcgcttcagatccggtggcaccgtggtgaagctgcattcgatgacagcgtagtgaagcgtgcgacggcatggatcgggcggcgggggcaaatgagctcggtggaggggccttggtggtggagccctatggcgaggtaaggaagccagtggctgctgttgcctcatcgcttcagattgggcaatctcgctgctcgttcaaggaggcattggctcgacagtggcctcgggggatggtgtgttcttgctactagatggtggcggctcctccccgagctccacgggtatcacagattcaaaacttcttctgcctagatttttcttatttcaaagattgtagtgccggttctggtgtgggtgggcaactaggcaaaggtggcctcaaatttgtaccggttagaaaaccggcatctatataggaaggcctatagtcgtgtcacctactatgatatatacgtcgtgttctacgtgttgttgtatgcagggccggccctaggcctatgcagacgaggcaatcaccagggggccatgatggtgagtgggtccaacacctaatactagtagtctagtaactgcctatggcctacctagaagaagaaacgcgcgaaagacgagaggagttgcaacgtcgtcggcaactcggcagacggcatcgcatcacacagggtatagccgcacaggcgcacaacatcgtcgactcgtctgcaacacagcaactcggcatcgcatcgcacagcacaagtcaacacttagccgcctgcctgcatggcgtcagcccgccggctgccaatcggcagcagcctcccgcctggagccctggacgcaatcacgcaagacagcaactcggcaagagtgcaagactagccgtccaggcatccagctgaaagaattctcttaactatacctgtgatggtagcttcaactgaaagaagtttctcaaaattgaagttgttgaataactatttgagatcaactatgttgcaagaaatgttaaatgatttggctacatgctctatcgagaaggatatcttagacactattgatcttaataacgctcttgatgattttgcatcaagaaatatccaaagaagtatcttcattaaggtagtgatattagttccaaggtacaaatatattgatattttggtcgactttatttctcaataattaccagacatgtatttgttttcattttgtaaataaaattagcgtctatatatcataaaattttatatatcgtttagagggcccatcacgatgagttcatctagggtacgatgtagtgaactcaataaccaagcaagaccgtgcttccgggttgggaggaggagctgaacatttctggactccaataaatcaaagagcagcggttttatgcactttcctgatgtcttccacttctattttctaaaccatgaatgcttacaaaaggcactacatcttaaccaatgttacaacatcttccatgggcatatatatacattgcctcacacatgcttatgcccatgaggccttgagaagggtacttataagcccatattagttggaccagaggtatgtttttcgtctggtcagctagctccgtttttgttcgtgctctcactccttcagtcagcccaacacacacctggtaagacgagttgacgataatgctttgcaattgggatactatcgctgcagataggcatatttgcacacattaattattttcttattaagattgcttcaattactgggtaataatgccccctgtcaaattaaaaccgaatgcctgtgtaatatgaaatggaataaattgtttgtctgtaatttctgtatggcataatgttttgccctttttttttcttcgtgtttatgtacctcaaaatatatctgtagtctagaaaaagaaatcacatgaacttcggttttgaaccataatctcatacagactgtttgcctccacaatagcttggctatgtttagactgtgcactgtacatgtagttgatgttctcatactgggaactacctggtcttgatcaagatcttcacggactctgccaaaatgcttgtgatcaccttgaaccatctctgccacatattagttagtaggagtactattagttttcccaatacctcccacttctactactctatattgtctgtctacagaaaacacaaatcttattcaccggtgatatgtttttgcttgcaataacattacaacaccatcctcatcctcagggaatgcatctcttcacatacgctcacctttcttttccaatttatcaacaaagcattgattgttttctgcaaaacaaatatatatactgcccttctccggatataaatgaacattgcacatggtgtaagagtatattcacgtagttgtatattctgcagtgaaaaaagcgtgaaggaaagctcaaattgatggaactgctaagtaagggagacaaccaaaacaagaacggcaaacagggcaacattagaaggtgaaaataaaaatgacaaattgatgaagacatgttggcgcgatatccgtgtaagacatgttgcaggcttgcagctcggatatcggcatatcgttgtacttaagcagcatagatgcagcaatactgaattggtcggtgaccatcgaactaaatatgattgttaaacaaaggcacatgttagagtttatgcactacgatatgaaatgatttttcaggacgatatgctctttaagttgcagacgggctataactgctctcgcctgcaaaatcactcccccaatcacggttcaacaactacatgcgaaaatcaattttcgtaggcgggcctcttaagtggcttgcatccgaaaatacccctccctctgtccacatgttttttcctcccctcctctcgcttttcccactaagtccaactcgacactcccagtaagtctaacagttctctcaaactcctccaactctcccactctcgaagaagcgatggcgagcgaaggtgccgggctcgggtgagagcggttgtggcggatacggcagtgttgagcaaggcggtggcggatccagtggcgggggaggagggctcgacagcgggtgagggctctggcatggggtgcagatcagccacggccaacctcctcccctgacgaagcgacggcgagcgggggccgtggtgagaaggatgtccgctgccggcatcaattggaggggtggatgcccgacgcctccttcccctccaacgcggatcctgccgcccctccgtccccacacgtgtggatccgtcggcggcttcgagcgatgacgatgaccaggatgccagcggtagattcaagcgacaacgacgacgacagcaatgacaaggacagcggcgacggcttatggattctagggttagggtttagggattttcaaatttttattttatttttttccttttcgtcgtcgtttggctgaagcgtctgcttgcaaaaatccagatttttgcatgtggctgctctacccacttgcaaaagtctaattttcacggactattaggtgcatgcaggctgcccaaccgtctgagaaaatcgtttctgacaacatgcaaaaatcatttatgtaatagtgatggttgatggaactatggatttgagcactattagcaaaaacagcttcagattctccatggttaattgaccggaggacccaacgttgattatccatggttaattggccgctcacaactaaacatacaacacaatctgcgattatgtgtaatgtgaatcacgtcgagtcgttgaaatcatagagttccttctttactgccgtctcactcaattctcaattgtactatttttgaacttcactgatgtcccaaggggttaaaaaaagagattttttacgatccaacggtaccgtcggcaccaaatcctggtcgttagatctggcccgatccaatgattggtagtgtttggtaccacgaggtaccaaatatgtccctgttttggtacctcccgtagaagagaggtgaaagggcaaaaatgtaacttcgcgtgcaatagatgggaggaatagatgggcggaaccaattttatcgcattttacatcctcttctacgttgccgtcatgtttctctccccctccccccctcccaccgctgccgtattcctcttccacccagccaccaccattttcctcttatgctgccgtcgtgttccacctccagcgccgcaacttcgatctgggccctagcgccgaagcgagattgattgcggcgtgtagggttgtgccctctctactccgggattcgtggtcttccgccaatcgtcgcctagatcgacaccatcaatcgccactgcctagacgtcaactccgccaccgctgggatcgaccgccgcctcctcctagatcaacgccgccacctcctggacgtcaactccgccgccgccactaggaatgacgacttggacaccgctgccactgggaacaacgactcgaacgccacatccacctttgctcatcttttctctctttatcctacccttcctggattcaacggttagatgtgttttagttctgagctgtaccagtaacgaccggtacaacctgctggaccatgaagacgatcttcaaaaaaacatggcaattatttcttctgcatcctcagacttgagagaatatatcaatagctagttctttctgtgagtaggtgaaagtgaaaatttcactatattctctgaaaaggggttattatttcgctacttctacttgtcaggagaagaaacatcaatgaaacatagagatgctgactacaagacccatactttcatgatctctcgtcttgtaggaagaagttgtatggtcatttctgacggtctcaactttgtgatttatctatcgatacatcatgctccatgccgaaatgtacatattgattcccactacatttcgtgaagtgtggcttttagtttgaggtactgtaagtacttactaaatttttggagtgtgcatggatgtgtttactgaatttatcgaaatcacaatagcttatgtgtttggaaaaaaaaactaattttcatagatgattcttacaaggggaacttgaaattagctagtgcacactgcacagactgacactgtagattggcatatgcccgcagaagtcttgagtatcacagactggcactgaagactgacagtgcatgagtgtagtagcaatgcatgacagataaatgtcactcttttgctggtgtgcaatgcaacaccctgcagttgtttgttcactctgacgattgacacattttgacgattttgctcattatctatttaacaaggtcactcaaaagttgtagtcgatgttgtggtctaaacttttctcgatgaattacgcaatgaacgaactctctttcactgaagaaatgttatgccttggttcctgatgacttccattcatattatatcaggaaggaatcaacatggatcggatatgatagatggtgttgccaagattgatcgatcgatgctagcttcagcaccatatatatactcctcaagatccaccttatttaatttcatgatctatgggtgaagacttacttttgagtgacatagctaacatatttcctactccctccgtcttaaaaaactcaatctaaataaggatgtgatccttcctattacaacgaatctgtatatctagagattgttcagatttgttaaccaggaagagtcacatctctgtctaggcagaggttttttttaggatggagagagttcgattgacagagagcaccaacatcgatcaaactttatgcagaactaaaatcggcgtagctcagatgtagccctggttgaaatattgctgggtacgatttttgctgtttgtgccgtactgttccataacatctagcctgttttgattgagctagaatgaaaattaattgatggccttgtttagattcttttggattggccaaaatcctgagacatccacccatacgcgctaggattatattcctaggaggcagtacataaattagtgcatatcgcatataattaaacactgattgcaaaacttggagcaacaagttctaagtaattttgtagttcttgataggtaaaattttaatgtaaattttagcaccttctagtaccctatactactagagaatatggtatctcgtgataccttgtcaaggtttgtaaaatgactgtcactccaacgatactcgtgtccattgcttaattttcagtccttttgacagtcgccgatttgccatcgccttatttcagtaataatctgcagtgttcagtagttgattcttaatcttagagcatgcccaacagcttccttttccaattccctattctatgatttagggaattttgatcaagaaacagatccaacagattctctaactgatatcccaatatctctggttcctcagtccggatatatcgttcctcacaaacagggagcgattttgttcccaatatttcctcgtcggtctctctcgcgcgcaaagggaaaatgttcccgcgcacttctccgcgccctcgctcctcggcggctgcaccttcttcctcggtcgcggcaccctcttcctcggcggcggcgtcctcttcatcggcggcagctcccttttcccttttgcaaggcacggggtgtggtgtcccgatgacggccggaggtatgccgtttccgcagtacggcgagttctggcccggcggccatgcgcgccccccaccgccgcccgccggccatgcgcgccctccacaacgctactccggtttttaggcatccgaggccatggagaagctgacatctagcgagccactggatcccctctcacacgaagcttctatcggcagttcctccagagtatggactgtaggtgacgaagaattcctccacatgagcaatttcggtaagtccaatcctgatttgttcagtgtttagtttacatgctctgaattccttcacatctgaagctttcttaattgtgctttcttttttttcttcaatctggatagtattgtcttatttatactatctgatagaggttgcattttcagaaattttcatcatgttcttttgtgtatgcttgcaattgtagcaaaattgcctgacttgaacaagggtatgtctgctgtatgtgctgatgtacttcactgtggtgtatatcctgcatttatgtccagaagtatatagggtatgtacagcatgcaggaaagaatactcagtggtgttgtgctggaatttcagtttgacactatgtagtgagtataatatgctatcaaatttatgctctgagtttgacacagtggaaattcagtatgtactgagtttcatatacgatgctctgaaatttgacctgttgaacagttatctgaaccttgtcgctgtcaggatcgatataggaacatttctatgaaccttgtcattttcagtatccaaattagcaacatttgtgtgctctctccatgcgaatgcacagcttttgattaatattatgtgtacacaaagttgtcaccatccaatacatgtgaaatttcaaataacagaatgcattttttgtccagaaattatcacttgtttgtgttttgttagtctttttttttctcaagtacaaggttatgattttttatctatggacagatgatatggagcgagagcgatattacacaaacttgatcaatgatgagagcaaccattttggctcgagtgagatgggaagccagtatgatgatgaacaagaaccagttgtgaatgaaaatgttgctgtgagaccgaaccaaaaaagatcaaaaaatttcagtttggaggaggacaaccttttggtgtcggcgtggataaatgtttctttcgatccggttcaagggatggatcaatctcacggtacatattggggacgtattcatgactactttcatcagaacaaggaattcgaatcagatcgctcccaaagttcacttgtacattgttggtccactatacaagaacatgtcaataagtattgtggtttcttaagtcagattcagaatcgaaatcagagtggtgtcaatcatgaggacatgataatatattgcttgtgttgcttattttccaatcgtctcctttatgtttctgacttcagttcatttatttgcagcatgtgcaagcaagcctgatgtacaagaagaaagaggaaaagaagtttcagttcatgcattgctacaacgttttaaagaatctgccaaagtggaatgataagcggaatcagctggcagctagtaaaacttcaagcaagaagcagaagaagaccgccaatgattctcctgcgatatctactcctgcatgtaatgttgatgagaattgggctgctgatcctgagaatacagtaggtgagggaagacccatggggaggaagaaggcgaaacaacagatgtgcgaacgctcggatctatcacggaaagagtccttagactatctatgggataagaagaaagaggccgatgcggaggagcgaaagtttgaggagaggtaccaaatcgcttttgcacttgagcaaaagcggattgatttggagagagacaagttcgagttcaagagaatgataaaagaagataagcttttgaggactgatactagtgcaatgagcatcgaggagcaggagtactataaaaatgtgaagaatcaaattctaagtcatcgttcagctcaagcataaattagtcttattactcatcaattagcattcaaaatttgttagatctttagctatagagcctacttaatggactagtaaattgtactatcttgttttggtactgttttatgtagccggagcatttgctactactacaaaattgctggaaattgtttttttgttgaaaattgctggaaattgttgttgatggaattgcttcttcatctcaaatggccctgttactgatagtgtgcattttcagttcatgttgtccactagtgctgaaataacccggttgttacagagccattcaggcatcaattttacaagggttgaaataagtttcagtccattaaagtaactgtcagaactagtagcaatgttcgatgatgattggcatgtaaaaccttcagttcatggacttgcatatgtagcaaaaatgccagaatttatcatcggcttgcatatgtagcagtgcatattctgatgtacacccttgtggtgtatatcctgtatatatatccagtcctgaaaaaggatatgcactgctgtccttttcagtctattgtactgtatcgaattcaacaataaatcacattgtcaataaataattactataagctcaatatgtactaatttaaaaacaagctgtgaatctccaattattacaatctatgacattatctataagaatatataatgtaaaattaatatcggtctgcatgatgattccacaaatgttcgatgaggtcttcccttagttggttgtgaacttccttgtcttgaattttttcgtactgactaataaaatcattaaagttggtcgtacgttcatgggaaccacccacctgttctcccatctcatcataaactaaatcaaaatcaccatcgcgctcgtcctccacaatcatgttattcatgattatacaagctctcattatctgattcagagtaagtgctttccaaaaacgagctggtccacggactatagaaaagcgagcttgaagcactccaaatgcttgttcaacatccttcctagcagcttcttgtgctttgctaaaatattttctcttatttccttgtggcagcttaatgctcttcacaagtgttgcccatgaaggataaataccatctgcaagatagtaccccatagtgtagtcgtgcccgttaatactataattaactttaggagccttcccttcagctagctttgcaaacagcggtgagcgttgaaggacattaatatcattgtgagatccaggtgaaccgaagaacgcatgccaaaaccgtcggtcacgtgaggcaacagcttctaaaactatagtaggaactccctctttccctttatactggccttgccatgcagtcgggcagttcttccactgccaatgaatacaatctaaagaacccaacattcctgggaaccctctttcttccccctgagcaagtaatctagctatgtcgttctcgtttggtgttctcaaatactcctctcccaaaaacttcatcaatagccaccacaaacctgttaaaactctcaataacggtactacctccaatacgaacatactcatcaactgcatctgccgctattccataacttaacatacgtgacactgctattaccttttgcaaacatgacagtccaagcacaaaatattcatcatgtgcttctatagcattcattatgcgtaaaaacagaggtcgtctcattctaaacctgcatagtaattaacgatattaattatctttaatatcaattttgcaaacaaatattgtcaaaacaaagcactgctaaaaacctgcgtctaaactgaacatcgaggtacgtaggttcttcagaaaaataatcattatataatctccgatgtccagccaatctttcccgattaattactgcatgacctataacagatccaccacgctttggaacttcatcatcgtcgaactcatcgtacactatatcaaccgccgaagaaataaattcttcgtagccatccaataaagactcctcatccaatagcatttggaggagggtacttcgacgactcatcttctcttttttattgccacagggttggagcgtttaccacagggatgaagtgcaatggagagaaccgatggcaggaatacaacaataatcaatctataaaattaattattagatcaaacttaatattttccaacaatagatatccacataaccaaatagagacagatattgactagggcacaagagatcaataggatttgctagggattacctccttgatgacacgaatagctatggcatatccttggtattccgtttttgtagaaaccgcagcactcaggacactggttggctggtgatgatgcgatttactcagatggcggcgctggtgtgggagggagaaggtgctgggagggagaagtctcggcgctggtgcgaggagggagacgattgatcggtaccgaactaggcccaccttgcttatgtggcaaactaacaaatgatagggaattaatttttgggcctctcttggaggagggggtgattgttgggcctaattcttattttggaattcctaattcagattttttgggaatcaaatattgagtgactgttgggcatgctcttaggaaagcatatttatatctatagtgcttatgcataattgaatgctagcaaaaactacactacttaaagatgctgtatatgtcaaaatctcggcacagtagctagctgctgaagcaattcaaggacatttgtattgccgtacttatccgtattttttttttttggaaacctacttatccgtaattgaatactagcaaaaacaacactactcaaaagctttaattgcatatgtcaaaatctcagaacaaaatgacatataaggaaattcagtaactgtttttttccgtcaaaatacattgaaatttgatcaaatgtgcagatttgaagttttagtttgttgggtgccacagtgagagtcttgaggtcgtcgatcgtgccaaaacatatctgaaataggcgccttgtctttctatctgtcttaactcaagttaatgagtaatttgtagtctataaagagttatttgtaaaacatctcgatggggccatggcccagtttgattagtctccacagtctggactgaacgaacgaggatcctattagttaaacaatttcagatgcaactctcatgacggttttactcattttcccgatgccttccatttcttcagtagagattaggagaacaccatcgatcattcggtcatctcatcatcctatcctatattgcacccaaaagaactttaggtaaattttccttagtctaagaatttcgaacttggctaccagttaagcggtgagctatgtatgctttgcaaggtaaaggtccatcagttcacatatatatatatctatgctcacccatcgtctatttgtctctaattaatatgttgaatgtgcttggaatgttcattgagtacaaaatgggtataactctgaggccctaggccctgtttagatcccaccataacatttttcaccatgtcacatggaacgtttgaataactgcatgaagtattaaatataggctaaaaataactaatttcatagattgcaactaatttgcgtaacgaatcttttaagcctaattgctccatgatttgacaatgtggtgctacagtaaacttttactaatgatggattaattaggcttaataaatttgtctcgctatttattgacggattctgtaattaatttggtaccaatgttccaaagtaatctaaccataggacaatcaaagaacaggtgttgaattgtttcctctctatcacaaaattgacaattcgtaccccctttcctccaacaaacagccaaataaaaactttgatcttcaatgtttttttttctgtggaaagtttacttgttccattttcatagcactataaaaggacttcacagtgaatctgccttcttttgtcaagttccaccaaatcttatccctatcattttcattcagctgcagatcacccatctatttttaattttgttccagtctctgagtttctcacaatacaaacatctcctgaactttacggaatcaatccccttctgtttcaaagttgcaatagttaccttctttgtcactgccacattatataactcaggaaatcggtcattcaggggtctacccccaaccatcttcccagaataaagtgttcctaccatcacctacaattttattacaaaatttgtaaaagctctctttcacctccaagatttcttgccagaagtgtgagttgccaaatttatcctcatatctgaattaggcgccttgtctttctatctgtcttatataaagttaatgagtaatttgtagtcgacaggaagttattcgtaaaacatctccatggggtcgtgcatggcccagtttaattagtctccacagtcaggacgcggcgatcgaggatcctcttagtcgaacaatttcagatgcaactctgatgattgttttactagtcttcccgatgcctttcacttctattgtagagattaggagaataccatagatcattcggtcatctcaacaagctatcctatattgcacccaaaagaactttaggtaaattttgctagtctaataattgtgaacttgcatttggccattggctaccggttaattacgcggtgaactatgctttgcaagggaaaggtctatcagttcacatatatatatctatgctcacccttcattgctaatatgttgaatgtgcgtcgaatgttcattgaatacaaaatcacttgatatcaggattcagaaatgcgtgtacttcttttgtacatggtgtacaagtggcggacctaggatttgaacccagggtaggcctagcgaaaaaaatctaaatgcaatacatcatgattcgatataaaacctagtaaatgatacaagtatataactctaaatggttcaatacaagtggataataacaaaaaagtttaaaacttacctaaatgacaatgtaaattgccccttcatcaacaagatctgtaggtggaggtggttcttgttcttcacatgccccttcatcaactagaattggagcatcatctacagcaggaacagatgacccttcatccacaggtgggattggtagatcacaagatgcaactttttttcttcatgcttctgaaaaagaaatacaatgcttgacttcttcattcctcaatctcctgacaaccatcacaccatgcaaaaatgtcatatgaggttcattgtggcgcacaattttgtggtaatctatacaaattactatatctccaattggggaatcatggatataaagaacttattgacggaggtagtactacctgctgactattggaagggggagagcagagggactgagggagaggagagccggacagccggagaagcagtggcgcaatgctcaccggagggggagggccgccagatgcgggatgccggccgggcggcggccgccggccgccggggcgggacgcgcgcgccgacgcgcgtcggggaggccggaggcggtgcaaccgcaacggcgtgagtcgggactcgggaaggcgggcaggccggccgctggtgtgaggggaagagagccgtggcggcgctgtcgggactcgggaagggggcaggcctgccaccggcacgaggggcagagcgccgtcgcgccgtcgcggcctcacgggatgcgggagcggtggcggctgcatcgggcgtcggagcgacggcgcgtgcacgtgcgactaggagtagggatggcaatttctccgacgggggcgggtacccgccggggacccgtccctatggggccggggtcggggctatatttggccccgcgcgtgcagcagggcggggccccgaaaatatgcggggacgggggcgggtctagatttccacccgcgggtgacccatggggagctgaaaatattgtacatacgtagatggcccattaaaaatgtggcacaagcaagcccatgttgtgaaataacttttcctatccaatcttatctaccccagccatacagtcacggagccacccatccagatcgagtcaatgacctttcaaaaaaaaaaaaaaagaaacatagagtcaatgggtagcgactgcatcggcgctaccgcagttgttgcaagcgatagtgactccgcatggctgctgcgcctcgtcagctccttgcgaggctgcgcctctgaccaggacggctgctgcgcttccgtctaggccgcgggtcgccggccgctgcactttcgctgcgtctccggctgctgcaactttgccgcgtgtcgccggctgttgtgccttcgtcgcacgtcgccggctgcttcgcctttgttttcatcgcgcgtcgccggcttctgcacctccgccaaatctccgcgacgctggcctcctcgatgagccaccgcgtcttggctgctacagtcctggtttgccctctttctctacagctttgcagggccccggtctgggtcggggaccagtaggggccggggccgggggataaagtcaggggtcgaggacggggccgttcctgtccaacccggccccgccgcgccccgttgccatccctaactgggaggccgggaggaggctagtaggaaagttagagtttttttttgttgggccaggatttgtttatgggccatgaaaaaaaaatacatgctcctttctgggccaaatcctagggcaattctgggcctacctggactaccctctgggtacgtccctgtggtgtactgctagaaaaataatttgtcatcacgaaaaaaatcatggcatcaatactaaaattgtgacgatagatacatattgccacaattttaaaatcattgctagccgtgataataaatagcgtggtaataggttatttcaacattttttattcggtggtaataaattttgatgttgccatagaatggatgtggcaaaaaatcatattgcaacacttcacatcattgcaataaataattattgccaccactccatatgtgacattagttttacataccaaattaaaagtttaaatattaataactaattttgttctacatcctaactatttattatttgataccttgtcttcgctagattcgaacacaagacctatcctttaggtgtgctctcatttaccaactcacctactcatcaattctgttagaaaagtgtatcgtttcatttgagcatatctaactgagatttaaatcacggatttaaatatctaaaagatttcaaatgaaaaagttatcacctataaaattgttgatcttatcgagagctataactttcatataaattttgtcccaatccatgtccatatgaaaaaattaagttaaattataagatgacatttttttcattgcaacgaatttgttgatcgtggtaacagaaaatagtgaaaagtaacataccacagccatgtactatgcaaaatgccaaaaaaaaattaaaattgtgatgatagaacatgtttttttgcaagcgtaatggtttttggcaatatcttattttctattgcaacaaaaatactaaataaaacaacgattgaattggatgaataattaagtagcttcttgatcaaacggttgttatctttgtactaatatgatctaatggcttaaaattattgctgatgtggcttcttgcatgtcttactttataggagtaaataccatactcgtctagtgcacgcacctcccaacgcggcgggcattgttttggtggattgaccagatcaaggtaacatgtgattcaatagggaagttaagatagatcagagcccagttgccattgatacagccaaacatgccattgatgccatccaacagggaagttaagatagatccagcagaatattacaatgttgtgtacctggtgccattgatgtgttgctatatactacagcggcagtacaagcaggatagacccatcacccatgtgctattcttgcccaaaagtgtgaacagaaacaatcaaataatagttccagggtaaaaagagagagaataaacaacatactacccgaggagcaaactttacctcttttatttttcaccagcagatcgacaaccccgagatagagcaactatctatctcatatttttcattagattaaaatttcatgaacgacacatttggatgtttagcccaaccctgtgaaaggcagataagaagtatcataaaaattgtagctagttgaaaaggaaattcattttgacaaattgacttgagacgtcagatcagctcaatttttgtatccagtgactaaggccgtgtttagttcgtgtgtcaattttttttaagtatacgggcacacatttaaagtattaaacgtagactaataaagcaaattacagattctgcctgtaaactgtgaggcaaatttattaaccctaattaatccatcgtcatcacattgttaaatcatggcgtaattaggctcaaaagaatcatctcgcaatttacatgcaaactgtgcaattggttttttgtctatatttaatgctccatgtatgtgtccaaacatttgatgtgacaggattttttgaagtttgaagggaactaaacactgcctaaattattagtgcctaccacatattgttggaacatagaaatttgacttgcagaaatgctaaggtcctctttgtttaggcttataagccaacttataatctgaaaagtctaagtctaaacaaacgaacaacttattcgtttggcttttttgaagccataagccactctaatactattaatccaaaagctaggttggagaaacttttatgtatgactccagcactaaccttaggacattaaatccaccagcttataagtcaataagtcaataagctgacttaaaagtctaaaccaataaacctaaacctaaactataatacttgattagctgtatactcctgttcttgaacttgtaaagagcattcatagggtacataaggccaaaaaagctaacacttctcatcttcagattattcttgctcttcaaatttatctctacctccaaagaaaaactgaagcaacaaagcaggtattgatttatggggcctagaagcttaagtatccatttcctataagctagctcatatccaacttgttggcataatttcaataacacattaacacaatagcttataatatgatacctcaataggccaaacatgccatttagtcctgttggatccttaggtgtttattccctgattgactagccgaccccatgcttctgtggtagtttctgtctccgccaactatttaggtaactataatgtttccatgtaattctgattctactatcttttgttcatgaaggtcataaaatcgttataaactttaagtgtctgtttaatacagttatagctctagccaaacagtttcagctacacttaaaatagaagcgaagttatagactttaagtgcttgtttgacacagctccagccaaacagtttcagctccacctaaaacaggagtgaaactgggtggagtgttcttacaaaataaatcacagaggcagagctgggtttatgtttaattatctacaactccactccagacaaaacttctaaagctaaatttaggagttggagttctacccgcagaccctaagatcatatagggtacttctataacataattgatgacgtgtaagatatcatgttctttagatggttctttcatatctctatttggagatctgaccaacaatgctagcgaggtcccacacttttgagttttgtgaatggtgcggtctggattagcgtaataagcatgtctaagtgaaccggtacttataaggttgtacggatgtggagttttgtggtactgtatattcctgacataactggataaccagtgatattcctgacaatgaccaacacactagtttctttcaattaacatgcacatctaacatgaagatgatgactctggaataggaatagcgcagcaaaaatcgtaatgagaatcattccaatctaccgaagtccaagattccgaagcaaacatataattctgaagcgcacacatatactccctccgtttcgaaatgtttgacgccgttgacttttttaaatatgtttgatcgttcgtcttattcaaaaaatttaagtaattattaattcttttcctatcatttgattcattgttaaatatatttttatgtaggtatataattttatatattttacaaaagtttttgaataaaacgaacggtaaaacatgtgctaaaaagtcaatggtgtcaaacatttcgaaacggagggagataagttcagaaatgcaatgtttgacatattacagtactagcaaacatctcacaatcgcacaccgacatcaccttacagatctagctcttacaggtggccatgcctacgcgaggactcaaattttcaccttattttcagcacgatttccctccgggttaccctcgaaacgtccaatcctgaaatacccaagctccactccggcctccgccgccgtcttggcctcgccgtccatggccatctcggcgaggatcctcccgactgcaggtcccatcttgaagccatggccggagaacccggcgccgacaaccacatcctttccaaactccccaccaacgaagtcgatgatgaaatcctcatcaggggtcatggagtacatgcacgactgccggatgaccggcccaccggcggtgtcgacgtggccgggcatgagctcgtcgatccaccgcgccaccgggtccgccagggcgtcgccgccagcgcaccagtcccgcctatccgggtcgcacggcgcaccgccgtgcgcgcacaccttgatcaggcctgggaactccatggacggcgtggagtagatgcaggtgtcaccgtagctggcgaacgtcgggaagccggactccggcgtgagctcatgctcgcggccggggcgggccttccagtagcagatgagcgtgtgcagcggctgcactggcaggtcgacgccggcgaccgacttgacaagcttgctcgcccacgcgcccactgtgatgatgcacttggcgccgtggaactcctccccgctcgacgtcttcaccaagatcgatccatctcctaaagataaaacgttagatttttattaaataattactcgctcggcctcaaaatatgttcattttgacccatctaacctatacaaatgcaaagctataaagactataatatgctcgttttatctgaactcaattcaattatttctcattttatctactctatttacaattactttctaatttcacaaactacaatatagtcataacacaaaagtaaacttattttgggataaacggaaggagaaaacaaatgaatttattctaaaatgaagggagcagtagttaattaatttcatggattttactatgcaggcaaatacgattccagattatagtgaacaggtaaagatgtaaatatgatttcgttgattgatctgttaccttgcttggcgatgtcgatcacctccgtcctgtccctgagcacggcgccgttcttggcggcgagcgactggaacatggcaaccgccttggtggccttgatgacgccgccgagctcgctgctcgccgccgtccacccctcgggcaggcggaacaccgcggaccacagccacgacgccgccgaatcgtccgaggcgccgacgacctcggcggcgccgccgttctggatggcggcgcggagggccgggtcggcgcgcgggcccatgtcgaggtgcggcgtcggggtgagcacgcggtagcccgcctcggcctcggcgttgccccagagccgcgcggcgaggcgcaccatgggcgggtaccgcgcctgcgggtacgtggcgcggatgccgcgggactcgccgtgcgacgagccgcggtggtggagcaggtcgaacctctccaggagcagcacgcgcgcgccgccgcagcgggacgccgacgacgacgccgcggcgtacgccgcgcagctgcccatgatgccgccgcccaccacgatcacgtcgaagccgccgttggtcgccgccgccgccgccgccatgatcgcgcttctgggattttggtgtgggagatgaaggggggagtttgatcgaaagggtagccgatcggaggggataattaaaggcggctggatacggacacgtggcggatgcctattcgttctacatttactggttggaggcccacaaattactggccccaaaaacggcaaccaaggttaatcagactaattagcaccatcccggatacgattttgctatatatttgtcgacaaattttcttccaaaaatttgacagatgtaattacagtataatcgtagtgtaattacactgtaacttgcatgtaattacactgtaactatagtgtaacttgtatgtaactttcaaaaatctctatgtaatatgttatttcggtaaaatggaggttgtgggacaaatccttacacatgtgtgtgctgtgatttttttcttcctcaccaaaacaaatcttgtaatagatttaacgattcaaaattacgtgaaacttatatacaacttacactgtagttatatgcaagttacagtgtaatgacactacggttgtactataattatatctgtcaaatttttaggagaaaatttgtcgataaatgtataggtgatcccgtagcccctccgtattttcttcttcgggcgtgtttagttcacaccaaaattggaagtttaattgaaattggaacgatgtgatgaaaaagttggaagtttgtgtgtagaaaaattttaatgtaatggaaaagttagaagtttgaagaaaaagttgggaactaaactagccttcgtatcaatgcagaggatcacaatacgtgtgcgtgggtgtcagtaaaattatgttctagaaacccatcagcatctgtgtcaatgagatattttccgtagaatgtttttcgggtgtactacgcttcctcgcatagcaaaactaaaaagtcaaacaaagaaacaatttcagcatcttcagtacgccttcatgtgtaaacatcagtagcagtagtccatcaaaagatcacgaaattgttcttctttttgaaacatcgtcacatcccaatgatcctttcgttcctgatgtcttccattcatatcatcatatgggagagaaatcaaaacgagtcgcatatgatggattattgatggttgccattgttaacctatggaagcatcaccatcatcgatcctctccctcacctccaccacagaacattttggcctctatttatcgataagtgatgatatgtgtgcctttacatcattgttcaaaaaatacacagctaccataataagtactatctcctaaatataagatattttggttggatgtgacatattctgatactacgaattgagagtatgtccacatttatagtactagaatacatcccatccacccataatcccttaaggagtatgtcttaccattgccagagagcaccaacatcagacttaattattatctgtagaaaattgaactttcatagtcatatatattccatttgttgttccaatctaaaatattttttttctaaaaaatgcaataaacaaaatcatttttatgagttcttgacaaatattaatgattaacctatattttacccagattaattttaccatgatttctccagtaatatactatagtatctaatctatgctttctataaagttatagccactaagtcgtaagctcaacatttaaccgtgccacatcgtcagtagtaataattacgtatttaatctcatgcaaacatacaacattatatacaatttatttaattctacaaatcaacatgcaagcatatccaatcatcacccctcaaatcatttgcacaatattttaattaatctatctatcatttttatattttttaacatatacttatcaatatgttttacaataaagcgagtgtatcatttgtttgttatatgataagtattgattaacccgatgttttatttttattttttgctcctagcttggttgtcaaaagaaatatattgagaatcgctttgtaattcctataacaaaacgcggggaatcacgtacttaacatttacagttgaagcctcagtgcacagtgtagtgcatggtcatgctgaacctgattgtactcaaatgagagtttggcaatggtgacaatattcttcaagtaaaaaggcatgaagacaattaattggacttgcgatatattttggcaaagattgaaacagttgacggtgtaattttataacagcagaattttttaaggcagcccctaactgatgtactaatgaaaccttagagcttggaataagcgcttctaaaccacagatagctagcttggatccatctgcagctgtactaatgttcacaataaaatgtactgctagctcactctgccggcgacgatatatgccgttgccgtctttcagcttttcatagacatagttgtaccataataccactagattgttttttcttttcagaatgacaactaaacactgttgtgctttcgttcctgatgacttccattcatatcgtatcatagagagcttaagaaaacggcatcagttgaatggttcccgtgcttgatagatggaagctagaaagcctcaatatcaaccttcccttcattaattatatttctcagctcaagtaatgacgatgatatgatggattgattgtaggatcgaatcacacgaactaagccaacagggagggtgaatggttggtatacccaaaaaccgaaaacttttagcggaaataaaagttaccctcgaaatcgacggagatcggtctgaccgaagttgccttgccggtctgaccgctcggatgccgtcggtctgaccggtatagatcaaccggtctgaccgccgtgctcccgccggtctgactgccggtagatcgttggttagaccgccgaaacccagtaaacacaaatcgaagaactcttaaagtggatgacgactttattgattctctctgtgtttacaaagtgcaccaacagcactccatacaaaaatttcgactaaactctaaaccctaactcaaaactcaactcaattgctctctaaagcgataccgggaagcctcacgctccccctctatttatacatgagataggcagcctaaagccataaaccaaactcatactaggagtcctaaacaccttaggaaacccactagtacaagaaagaaactttacataaccaatcgtaccaaatttggactccttccaaattcgactccgcatcccatacgcacataataactccatcgtatgccatatagactctccatcaaccacgtgcatcaactctagtcttagtatcccgcatgatctctgaccacaacggacgtcgtcttatccccaagccgactcccggtccatcaccgcaaatactctcccgagacatcgagtcacctacacatggaacaaataaagaaaccatattctgagatcaagctatctccaacttgactcattagcagcaaacaatagtattacatacgtatagtatccatttagaagtcataatcatgaaataaactcggatatccaaataaacaacccgaaaccaaaactgacacagtgtcggccgattagaccgcgggctgcgccggtctgaccgcgcaatacacgccggtctgaccggctaccagagcccggtctgtccagtcacatagaatgacaatcctgcgattcacctgtaaatgcaatcatctccaaaaaccacttcgtgaataaattccaaataacaaaaccaataatctccaatgcccaattgttcatcacagaataataatcgaaaacacctttgattttacaatctcccccttgatgaacacattggcaaatccataaaaatgttttggtgtttggaaaaataaaaacaaaagtggtaaagagcacacttcgtacaaatgtacacatcgtgctcaaaaatcgaaaagaaaacttctccccctttttaaaagaaagaaattcccaattgaacaaaaaacatgctcttctcaacaactctccataaattcaccttgcttctccaaaaatctaaaaattttcacattacttctcccccttttgacaatgatttcatcaagcatag

SEQ ID NO: 73681 - DNA, 1695 bp, Oryza sativa
acttagggcccgatggagatatggaatgttatctcaatcgagtctaaactacggcccgacacagataggagtcatccttgacgggcctgagtattatgcctatctaacatgtctgtgcgaccatatctcaatggggtgcttttttggcccgattaagatgactttcttgtgacgcccagctaattccaggcatgttagaggacatcacggatggaaggttctgtattagtgaccctacccctatgagcaccttcggaagactgggccggcatatcttgggattgacgaagtcatcacgggcgtcttgctattgacggatacgtcgcctactatgaaagaataattagccgtatgtctaacaatagttgacacctaaaattgagtgaaaagtatatttaacatcgagattagcacaagtagcagtagcagtagattttgaggcgttttgagaaaaacacctactaatgacagtaatattgaaggaatgaattaaatttgcctggtaattaatattttttaagaaatggctccaacaagagatgccttcaaatctcatccatcctgtagtgacgtgggctcattggaagcatgccaaaagtatttcaggcccgagggggtgaaattatattatgcccaaatttgtagatgtatcagaatttcgggagaacatatcctatgcacattagctttccgtgcacaccaactaacaaatgtcatataaaattctagaaaaaattaggcacgtacttccaatagtatacaccaacgtgtgaaacgttatctttaaattcattatattttagccgtaacaaaaaaagacaaaattctgacatatttttaccctaaaaaatgtcaaatttttcaccgttttattacggctaaaatataataaatttgaatacaacaccttgcagatatgtctaatactattggaagcatgtgtccatttttttctagaattctctgtgatatttgctagctagttggtatgcatgaagtgtgcacaggaagcttgtatgcataggatatgttcccgaatttcggacccactggaattgatgctcacacatctgtttgtcagcccattaactcaaacaacgacgcccaattggccacacatgatgatgatgatcaaatggcaaattaaagtatgtttcttgttagtcgttatttcctcgttacttctgccatatgtacaacatgcatggattgatgcatgccatttcatcgttgaaaagcagtaacagaaagtgaagaacacagctagcatatgacacgatcactgttgtacaatgacgtcctttctccttcttttttcttttatgaaaaatacatattgccaagtgttggaattaatgaatgggccttagcccactcgaaaattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttt

SEQ ID NO: 73682 - DNA, 2405 bp, Oryza sativa
cgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagttcgaccagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactttggctggttttgccgatgcactgaggccggataaattcaccggtgtgcattttaagagatggcagatcagggtcactctgtggctgacagttatgaaatgcttctgggtgagtactggcaaacctgaaggagttcttactgctgaacagcagaagcaattcgaggaagccactactctctttgtgggatgcattcttagcgttcttggcgatcgtctggtcaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgttttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctgctgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgccgaggagagaaacttggcaccactggaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagatgacgcctccctattctcccgagtctaatgggattgctgaaaggaagaatcgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacga

SEQ ID NO: 73683 - DNA, 12190 bp, Oryza sativa
cacatgtgggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctatcttctttgagagctttttcccaatgaaggatacacatagtggttcgaaccaaccatctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcaacctcacatggtcttctcgttcatcaaatggacgttaagacagcttttcttaatggagagctggatgaggagatctatatggatcaacctgatgggtttgtaggtgaaggtcaagaaggcaaagtgtgcaaattgttgaagtctttgtatggtctaaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagattttgaatcgctttggctacattgatagtaagccttctccaacaccttataaacctagcttgttgcttcgcaagaacaagagaattgctaggaatcaactggaatactcccaaatcattggctcgttgatgtacctggctagtgcaactaggactgatatctcctttgctgtgagcaagttgagccgatttacctttaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatatgagttatactatggtggtaacccagtctatgtgatcggagatcccgtgaattagatcctgggaagaacaaaccattagtaaactagaggagagtatcaatatatataccctctccaagtgaagatgcatgtactctcctgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtggaggattgttggaattaatgaatgggccttagcccactcgaagattaattctttggaaaatcacaaaagcccacctcataggatggcatgcatgtggagtttagtaccaccttgcttattctaggagagggggaccttatgaaaagggaggatgccctcctagtcacttgaagcatgtgtggtggagagaagaggggaaacacacgcgcgcgctcgctcgcctcgcctcgcctggcctggcagggcaggcggcgcgcgtgcacgacgtacgcgtcgaaaggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgtgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgagagagcaggtctccgaaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagctggtcttttcgtcaccttggtacgtgttcaatatgttgcgcatatttgatctgttcatgttatactgtgtagtttacatgtgtagatctaatgatgcgttcatgctagtttttatttataatgtcatgatttatttatggaatagattaaattattatatgtctataatctcaacaccaagtacgtaggtcttggggcatttaattttgatcgctatgaacaaccagctgcaaggctgcaaccaccctttttattattctgtttttaactatttcctgaaaaaaaaatgaattcttggaccaaccattatgaaatgacattataacagctgctataaatggaggctaaaacagatcaccagtggtgctgaggtacggttcggttgattgatgagagagcgatgcatcatgcatgttgcagcttccatcgagatcttgtatcaaccgtggcaaaccaatcatatatgtgtaatctgactcgacttgatctctttctgatgccatctacgaatggaaatggaagccatcaggaaccaaagcacaataggattccaatcaaccagatcgtcgcccacagatggcggtagagaacgcagtttgctatggtacttatgcatcagtgggaggatgttcggtttagcagcaatgctctcactgagatgctcttccccactctgcacttcatctgctctattcaagctcgttcgatttctagtatttttagttatgcatggccagcttggcagtttaggagatgtgataaaattatgccggtaacttataaattctctcgttacaaaacatgtttaaaccctgtattgagttgagtcaaatttaccacgagaactgcattatgctctgctgcttgaaatttgaaactataatattcgagaaattgacataaatatctagttaaagtcataaatattgtctggaactcgtcagaatgagttttgtgttattcatcaaaaagcttagaccggaacatccaatacaaattaaccaattgaccatcgatatccaggcctatttaaacactcctggcctctctcttatccaggcctatttaatgaatgtgaattgagggagttgagaactccgtaactttactcttattgcgcgtatatgggattagaagctgttgggattcaaatgacgagcaaatcaacaaaagaccatagcaagtgagagataaacaggtgaccaaacttcccttgacagcaaaagcaaggcacaaaagattgaaacaaaaccagacaaagaatcaacgcccactcgaaagttgccaaatttttagaagcaatgggagctgaaatatttttttatttgtaataaacacagcaccacatcatatgatgcatgaccctctgttctcatgtcctttcttagagttaacgaacacaccttgcacatgatttatgcactaacctttttttcttctttcactacgttggcccagggtatttgttatgggccaagactctcagctgtgacgggaggccctcgtcatagataagtggtaactaatgagtttgagttatctgtgtcagttgaagacctgtcacagaggaaagagtttgcttggatgggccgtaaccaaaacccgtcacagttaatataacattcatctgtgacgggtagtcattttaacctatcattgatgacctttatctatgatggacacactttttaactaacttgtatttgtgatgtgacataattttgggacctatcacagacatgaaaattgtaaaagaattaaaaaaatgctgcctgcaaaccttcatctgggcattcacaaatcacggaaatgtttacaatatcacaattactttcacattcatctgggcacagaacaacatcacaaccacattcacattcatctttgcacaaaacagaatcacaaaaataatctggacactagaatcgaaaactcttgccattgatggacttcgttgctgtactggtgcatcgatctcttttgccatgctcgacactagtggaggagtgggccgaaaaggggcaaacaaaaatgcatagccacattactaaaagacgtacccaagtttaacttttgattaattctgccttttccgagcagttcacagtgtatattgaaagcagaactcatcccaaatcagctacttaattccagctatatataacactgtagctcttaatgcattgcccatgtgtgttgtcgaacgaaaactgcgtcacgtcgaagaacgtggaacttggatggaggctttgagcagtaaagtagtattgacttcatagaatttttgtggatccccccatttcatggtcctagggggctatttataaccctagtacatactaatatcctctagggttgagttattacgaggaaaattacatggttacccttatgatagggacattacagtgggtatacaaggtcttgttttacattcgtgggctctgagatggtcttcctgggccggcctattaggtggcgaagggccccccatggaccaccgagctcctcgagccctatgaccgaaggccttcttcattcggggcttcggcttcatggaatgcttgacgtccttcgcccttggtgagcctttgtccggttgttgggctttgtggcgaacctcttgatcaggcttcgcctggtgctcgatggtgaatcccttggtcttcgtccttcggcttcgcacataggacttggccgatgttccgatagcctagatggcttgggtgggttggctggatgccctcatgacatacctccaacaatgtgcaatgcagaagtgatcatcaatcagctcagctaatgtatctcactgatcatgtgcattgactagaggagagatcaccggtgctgaggtgaagttgaaggagatatgtagtgcatatacaccatgtcaccatatattccatcaagcatggctaccatccgactaactttgatttctttccaataggaatggaagtcattaggaaccaaagctgaacagccttaggttcacatgtcacacagtttagtcatgatggattgcagcagctggagcatctctggaagtgggaactagtacacattatggttgaggagacaagatgctacactggtatagcagcatggacagcttgggtctacagcacctgatcacgacttttcgaccgtcgtctgcatttcgttctctctttcaagttcttccatatattcctacagtccgagaaaggtcttggtaaatcactaattagagcttgcattaacattaactcgtttaccatgatagcagtgcaagcagaatatgcaatgtggaagttcagactatgattatttcagctaatcttaatttagcatgactactgcactatgagctgaagcttgaaggtcgatttcaaattcaaaacgattagtaaattgtgttcatggtacatgaacttgcatggtgggtgcaaatatatatacaactaacttattactcttttcgatacaatacttacctagtccaagcgaacctgagctaaaacaatctctacaagcaaaattgatctaatgtgacacatatcgacgagtaattttattatacatcaaaatttagaccgataaaatgtgcaattattatttgctagatattttaaagatttagattgacaaaaagtgagacaataaaatatgcacaaccatgaaaataaacttttaaaatatgttttcggtgaaacagagtatctgacaatgaaaattaaaataactgtacatataagcgtatctgagcatggccagaattttcttggtcctgacgtataagtgtacattataaaagttatatagtgttgaggaatgcagttccaatcctacgataagtattgataactctggatttggtagaatcttgacacattcaattgggtttccgatcaacacgatccaaaccctacattcatagcatcatgtcttctctggttatcaatcgttagctactcggttaacctcgccgagaaggctgctctctacaagcgaatcaaagaacacaaataagaagaaggtagattgtaatttgcatgtaaatgattaagcacttgaagttgggattccacgaaccatactaacgggaaaacatatataaataatctaagcaaagaccaactcttaatgattacgactacaaaaataatatgatttcgaatgtcctaggcactactacacaaaagattttccaggactagaacttcccattttcccgtgcggagctttttcgcatgcgtatgtaaaaatcggtctcctattttcatgtgtgggccttctattttcacgtgcggatccttaagaggcccacacacaaaaatcgattttcacatgcggccctctaaacagacccgcaaagaaaaatacacaattttcgcatacaggcctcctaatccactctcacaggaaaatatccattccctctcaacctattcgaaaaaattcaaatttccttctgtctctccccccggccccatatgtcctctctctccccttttaattatcttatcctcactttccctctctgtgtctcccctggcccccttctctcctctctctctcgcaccttctccttcttctgtggcgccgcatccttctccttctgctccggtgcgatgggagccgcgggctaggctgcgggctagttcggggcggtgggtgcgaccgggagcagtgggctgggtggctgcgaccgggctcgtggcggtgggtgcgtccgggagtggtggggtgggcagcgggtgaacaggagtggcaggctcagcgatgggtttgcagcggcgggcgactgcccccccacccggatccggtggcggcggccgtcccactcccggatccgtgcgcggtggcggcggcacgacggtggtggcggtgggtgggctcgacggctttggttgcggcggccgagagcggcgagctctggtggcggcggtcggctacggcgacgggcgtttctagggttagggttagggtttatttatttattcattattttttatgtttggatttttttgttgcgtgtgggcggtataatttgaccgcacgggataatcgtttatcccgtgcggtccacttaactcgaccgcacgagaagattattatcctgtgcggttgggccgtccgcacgtgaaaatatttattttcacaaacacttggctacagacggacaaaacctccacacggaaaaaatatttttttgaccgcatgaaaaaatccttcttgtagtagcgagggttgcaattacaatgctcaaggctcaaatcagactcggatcggactagatagggtatgtggcttgttttgttgatttctaccagcattgtagaaattttgacgtgggatcagaaccatttgaaagtagacttcataagttttccaacaagtattcatggccccgaattccttctagatcagcagctaggtttatttgaagttgatgctgttaggagacccgaatccaaatccaaaatgtgtagaacttcatctcatatcttctatggaccgaaagtgatgtggtgatgtaggaataggcttggggaagatcttggtttggttcccaatcaatttctttgatcatccaagcacttcgtgagcccgcactccttttgttcatccacgcaaatatttttgccaacgaaaagatagaaaactcatagcgcaataacgattgttcaaatatataataagtaaatgcaatatagaatatatgcacctttaccttgttgatgtgtaacataagcatgattatatccacatcctaaagagcataaaatttttccaagacatgaaataaattatgtcctatatatggaaaatgaacttttgcacatctggtagctcttttttggattccaaataagatctccaaaacatggtcatacatgtaagctaccttgccatcagtttgcgatgctacaacgattttatttgtattgataatttcggcatgattcgcatggactagcaagttactgcaccagaatgagcaatttgcaacttgttgtatgttttttcacccaccagcaagttcttgtactgtgaacgcaatttactcaagaactattaataatatcaacttagtgatgagaatatttttattaataattaagcaacacccagtaaacactttgcaacagaaacattaaaatcaaggctttactgattttgttaggtacggtcagaactcagaagtaaaggttccattttgcgatctgcaatgctcataattgctctgctaaaatgttatgccaatattcataccgatcgatagaaactataaattgaagaccagaccctagaaccacacatagccacaattgcccccatctagcaaagcacgccatctcccagtcattcaagtggtggtgtttacgtatataccattggaatagaagtcatctggaatgacagtgatactacgcagctttctctcggcaatcctgttgcagaggtgtttggtttaagaatttacattacatagcgcctttttagtactataaaattgtcatcttaattctgtgaatagtaacacttcagttctagctcttacatgtgagctatgtagctatatatccatagttataacgatcagtcatttctacctctacctcattcagaaattgtatttttttacaggtgtagacgcacagtaaagaagggcgcctaaatcatgcttcaccactgtctggatcacgagttaaaggagtgcaggtatatatgggccttgctgaacatgccccatgttacagtgcattaaagcccaactgaaacgtccgggctgaattttgggccgaagtatcagtcatgtgattgcgaaatcatcttcactaatgatcaactagaagatgcacattatgttgtaaacgtctgtgtttgtaatgtgttttaaaagaaaaaatagaaatgcgcatatgatgcacacaccacccttttagcacacgctcaacatattatggtatcactaaatttctttcaaatgtgcacctatatttgttaaaaggggcaaacaaatttgtagcccttacacgaagaacaagcaccatttctctggacaattgtttaacaataacaatttgtttggagagatgccgcatgaatgttataataaaatagtttagtggggttatggattaatcaatggcctctctggagcctgacttgaaggaggaactactctgttcaaaaaagacaaatctttgctacgaatctggacacatatttgttcatgcttgtagcgaggattgaattttttttggacggaggggtacactcgtaggtatttacgtgtttgattttgtggtgtgctcacgtgtccaacattatataactgcaaagaaaataattgttccctcttagagcaccaatcaacaataaggtggacatatttttttaaaaaatggattgaacatgcatgtttattagaggataatatttgatccaccctctatttctctgtgtttttggtgatgttaataatgtcattaatcaagtaattaattccagtgatatactcgctccattccaaaatatcaagcacaacccttaacccaaaggtcacgaaacaattattatcatcttctcatctggatcacctaataaatgaaatgtatgcatctaatagaattaatgatctcaggaatgaatgattttaaaaattaataatttagtgaggaggaggtgttagttaattcatgcatgcatgcatgccttgtataatgaaacatctagaaaggtagttgtgtcttatattttagaatgaagtacttcttccgtttcaaaatgtttgacactgttgactttttagcacatgtttgaccgttcatcttattcaaaaaattttatgaaatatataaaattatatgtgtacatgaaagtatatttaacaatgaatcaaatgatatgaaaagaataaataattacttaaattttttgaataagacgaatggtcaaacacgtactaaaaagtcaacggtgtcaaacattttgaaacggagggagtatataacatggtagctagctctgcaggcatgcattggccatgtagaaactagacatgatcattgagatggagttcgaggagaagataacattggaataaagagtgactgaaagagatcacttgtgctagggcttcaatcaaacatggtgttaaatatgtgatcgaattttaggcccacgatatattcggattagtttcctagtaggagtcctattaggtgtctttctattatcccctatatatactcttgtaagccgtacgggaaggggtgacgttcccattgtgattcccctacgtttgtaatcatctcctctatagtgatcattgccggtcggcgcccgtggttttttcccgcaagtgttttccacgtaaaaattcgtgtctccgttgtgcatctattttcataacaagtggtatcagagcattggagatcgatctactgcagtcccggctaccggcgatttttcccgatcgaagaaatcgatctaatcggtggcacgcgtcgtcgtgttcgtcgttccgtcgaatcaatttgttcggccccctacctgtcgactccgagtcggcctcgtcccacgcctgcgcgagaagaaaaggcagcaccgcagcagcagccgttcaggcgtcgtgagaggagtactacaagcagcgcacgcgtcacgaggattaaaataatcagccgagagcttggctgttctgttcaggctttttgccaaggaggaaattgctaagcgcaccaaagcttgtgtaccaggaaatctacatacttcgctttgtgcacacaggaagtgcaccgaggtttcgcgtttttgctagtttaccctaatttcttaccagcaaattcaggattaattcccatggcgagtttgaagtatgatctaccgcttttggaccgagacacaag

SEQ ID NO: 73684 - DNA, 4516 bp, Oryza sativa
cagtggtttttggatgttcactaataagcctgcactactaggatgggagaggctccctagtgtcgaaaacactcggtaacaatgccaggacgctaggtaactacttcaaacacccagtaataatgttgcagagtggtacagcacgcccgggagtgatacgaggttcccgtgctgtctttcggtgtgttttctgaaaaaacactccgtaacagttgggaggttacggagtgtctacaatacactctgcaaagttccactaacggcatgatgactatccaaacggagacactgagcttcccgagttttatatattgacacgtggacataacgggtatagccacgtcaacagcacgttacggtgtgttcttagctgccactctgtaatatcaaaaatcattaccgcgtgtccttttgcttgcaccactcgggaagcactaatagaaccattttttaaaaaatatatgcatttgctagttgagggacactaacagtgtgtagatgaaatcttaatcaacttgcaataaacctgttagagcataaatacattcaacaaggtaaagtattccatcagtatgttatattgattgacatgcaaatgtaataaaaagaagaaatattcaacatacatctcgatctaagcatgaaacaatgtactagtcctacagaatcctaagaaaaccgcaaaaaacagcttaagctcttcatagttgaagcaccatcctgaactctatcaagaatgcaacacacaagaatcatgatcaagttggcttgttggagtcttggagaccataacccactgagatccaagggcaatcacctaaaataatatataatggtaaagttgcatcaagtatcatatataaccaaccagcagtaactgcttataacctaatctaagaacaaaatggtatgtttcaaaatagacaataataagtaaccattattcatagtacaaggattaaagaacacgattgagaaatagggtggagtatcctaaatagttgtcactgtgtcaacaacaaacttcactatttattcatctaacgagaattgacaaacatgctgatgttatgatttggaacaatcttaaccagttaacggttgaacggttgagccagccaaccttgatttgtgctacttatagggtagatagcacaaaaagtgcaacacaacaaatattgaagttcagactttgagagatgtactaactaaaactttaagagatgttgtaaaactactaagttctctatacgttcttacctaaatttatccattggggaagctcccataagcctcacgttgatcatatctgaaatcatgagaagacacttaaaaatttgtgaccaggagaatggctagagtaaataaaactagtggaccataatgtttgttattgagagtagaggatttttttaacctcgcagcagtaaacatcatagaggatacacaatgacggagaatgcatcattacctttgaatttgtgaacaagttcagccctactaagtatagatatgcttgaacctacagaagtatgcttccaggagcaaactgctgcatcaacaatgaaatgcatatatttagcatgtacattagcatcagattattgtctaaagtttagagtttaaaccacataaaatacaacattcttaacaaattttaaattcccttgcataaggccttgttcactttggagggtactaaagatgattggagggaaataattccacaccccagtaggtgtggaataaatcccctcaaatccctccttgggattaactgaacaaggcctaaaatgagccaggattcttgctataaggccatgaaatactattattaatagcttttcaaccaaaatgagacataattcttgcttttgaataatttgcatataataattaaaatagctactcttcagggttacgataagttcatcctaaatgaacaatatcccttggtaccacgtttaagaatgatgtacaacaaccacttgaatgattttagattagcattgtaagtagggatagcattgtaagtagcgcactaggcatcagtcatatccactgcaagcacatgataatcacaggatgcagagtccgaaattatgtactcaccttgtttttcccaaatcactgcatcatcccagagctcaggctttggcaccaccctctgctgcacggctaagaatgctcggctactaccgtggatccacctgtctatgcaagcgcattaaagcttgtgcccaagccactaattgagtcaactaataatctccaataacctgtcaggtaaaaaaaaacatcacagaagtacatcataagaagtattttcttaattttattaggcagtcaacttataatacagggactatttgaagaccattatgaagcaatttcactacactacaagccatccagctcattgttgataccaatgtaagtagttagacaaattattttaatgtggcttgagatgccaaagaggactggtcgctaattgacttgctaagcaggtcttgctactgctggtggctaatgatgccgcagctataatgcaaatggcgggggaggaaaaggtcttaccttgcatggccaggaggcgaccatggcggatctcggttgggttgcttgatgagggggccggtcgcggtagatccatggcatccggcttgaggaggagccacggcggaggttcaggccatccgacttgacgaggggacggccgcgcaacagatctaggatcccaggttgagggaaaaggacgcggaccggtgctacaccggcgttggttggggaaaagaggaggaggcaccggcgtcgatgccggccacagctatagctcgagaaggtggcgtaggcgttggtcctcgttgcagcttgaggagcggcgagcgggaggaggctgcggtggttcgggagagcaggcgaatgggggtggcggctgagagtgggaggagaaaggggttggtgagggtgctagggttcggaatttatatatgaaagggcaagcaaatttagatcgttggatctccatccgatgtacacaattaactggcaggtgggccccggtttcttcacatgttcatatcgaatggttcccgagttcctttatatgatgagactcggtaagttttccctcaccgctagtcccactggtcaacgtgctgcatcggatggatggcgtctgacgttccctggtgtaactcaccaacacacggtaattctccttgttacggggtgcctacatggaacacccggtaagactgtagtgttacctagtgccgtccatttacacccggcaacttacctagtgtcatagaaagcactatgtaaccttggaagagactagggagagtctcccgatctagtagtgctacctgggagttgaagagatgtaataataaaattaggccggtaactaattaattcttgttataaaacatatggtcgagggcgaaacccagtgttcttaagtgtagaagtgcttccacatgttcaaactctggttggagttcaatcaaaatttgagtgagcactgcattttgaaccgatgcttgaaatttggaactgtaataccggagaattgacaggaaaattcagttaaaaatcataaatactggtctagatcgacctcatcaaaatgaatttgtttatagcacttctcatgaaagagttttagactggaatgaacaatacaaaatggccatggatgtcctggtgcaccgaaacatatgtgacacaacaagaattcgtcaaaacaatcctataccgaatctcttccgaataccacatccattttatacttttttgtaggataacatctccattcaatgctaatcaccatataaactcaaggctacaggcaacagatcttaacatatgaattgtgagagctaagaggcacttgatagtgcagtggtaatgggtatgtggtttcaactttgaggtcccgtgttcaatcccaacacgctcacaattcctcgaaatctctcttttttctttaatcgtgagagttgatcaagaatgtgcagaatcttgctaccagcaaagagcagcagctatctatgatgcatggaaacaaacacaaacagtgtgggcatggagggcatcaaaactactatacggtcaagctgtttacttcatcctgtgtgatatctgcccatctcccggatgtgtagagcttcccctatttgaatcatgaccaaagattagttgttgaattttatggaaattgatgtgattgacatctcagtacatctagtagttttatctttgcatatcctcaatttataggacatatatataagtatgtgcaattgccatcgctatcaaatgtaacttgaaaaaggacagatattttaagtaacttttatttgtgatggtcataattaggatccgtcacagacagtaaaatgagtaaaataaagatgtcgtctgcttagctagtcacggacctttatatgggcattcacaattaaaaaaatatatctaagcacagtcacattcatttgggcatgaa

SEQ ID NO: 73685 - DNA, 10150 bp, Oryza sativa
agaataggaataagaaataagagagggaacagaggaggaagagaggaggcatacgggtccaagtacgtacgtatacctactacgactccacgtaggtacaatactgatagggactggaggattattttttctttatagattgatctaatggttaaaaatatcgggtccaccagattaaatgaaaatcaatggttgggtgttgtctttttttttagaattttaagaatttctataatttatcatagtgccaagtggcagcttgggagcgtttgtagggtacacgtggcagtttgggagcatttgtaggaagtttaatggacttttattatataatagaagatagataatagatagataactacatctattgccagtaacaatgcaaatccatattaaaaaaaaatagtaacggcactttattccgttctagtcaatgctggctgtatttaccccacaatcccattctaacccatctatcatggacctgttgagttttggccccttctgtaaatttttgtaaataactctttttctttataaaagttatattgctcagcaaatgccatgcaacgcagtaattcatctaaaaaaacatggacctcgcaaaaacccagaatactgttctagccaagtacatttgtgagcccccttgtttctgttttggcctaacttggacatattatattggctggattatgtattatattgacatattataccggtatctcgaggtactttttgctgaaccggagcaaatctcttagaaaatactaattgtataataaatcagggttacatattatttataatacattgggatgagtctctattatcattgatttttgcttgatctctgcattgtcttccaacaatgacagaaaagctagcattagtagtccgatactcctttctttggctatgtcctgctatcaaacacgtaagaattgtttgaaactaacgacaactagagctatgtcaacaagcttaccaacgtaaataggtagtggcgttcatactaagtacaaggataatcgttgcaacaattctaactaaataaaaaaatggagtccttattgcctagaagcacattcacatcatcgtcacaaaataaagttctttgatataattatagttagcatagaacacttgtcaaatttaagaagaaatcaacttgttccaactaattcagtggagcagaaagactgaaatttgaataaaaaaaaggaatgtagaaatcctaaatttgaaaaaaaaattggggggcccaaatttttgggagccttgtgcgatcgcacagcaagcacatgcccagggaccctttcccttcctatggcaatcacactagctacaaagacaacagacacaagatatacggtagagctctctcttatactaggtaatatatgttaaacatgatagaaattatgtgttgagatattgtgaaaataatgcgatgaagatgattcgacatactggtatgttgagctctatttatattctagattatgtgtaatagttgcatgagatttaagatactctataaattgttagtggatatatcatacttgcatgttacgttttagcatgtaataattgctagtgggtaccaactatctataaggccattcccaatccaatgattaggatggtgtctatatcattaaataggctgccacctaggataaaaaatgatatggcaagtgaataaatgagaaaagagaaggaaaccatgtcttgcaatgagatataggttctacacaatattcaagacatcatgtgagataagtagcattaaatttaagtaaagatagtggtgtttgcattggaagagtagtgtctagtactaatttcttgatgacgtggagtttatggaaactatgtctagtgtcttgggttgggaatggcctaaggtatagatatggtcaaatattatggcatggctataaataaaggctaaaagagatcacctatgctgctgtctgctgaggtgaagttgaaggatggaggagagaatggtgccctttttacctagctttccataaatgacggcaaccttcctatcaactagcttgcttttatttctttcctatatatgaatgtatgaatggaagtcatcagaaatgaaagcataacatcttcgggatgtatgttgaaacaaattcatattgaagggaggttgcaaccagattgtcggctgcagaacaaatcacattccgcggtgcagaattcaagttgctatgctgcagcagctgcaggaagacgttcagtccagcagtgtgcagcagcttggtctctgtcgtcgtttgcatttcggcgtgcggccgtccttctgtttggggaattggcgatagaaacgatcgaccgtcctccttaattggccttgccaacgattacttaattaccctctcacctaaattatgcaaatgactaaaatgactgtagaaatcaacggtgagatttattcctactacactactatcacctcctagtgaaaggtacaggttgggacagactttctgtccattgattgatattttttttgaacgactcaccgccatcgccaccagctgtgaacgctgtcaccggtcaccatcccgccagatccaggctcagatctggtagtctcctccacggccgccacacctccacacgccacctgcagcaccgccagtcaccgccgccccaccgctcgaccccgctgccggctgcctccccaccagatccggccgggaggcacggatctgggagatttccgccaccccaagcagcacccctctgcccgagtgtggcgcgaagatgaagcctcaccgccgccgtccttgtggccgcgcggctttagggaacgtgcgccggcgggggcgtcgcctcccgtgtcgcctaagggggaggggcgatgcgagagtctagcagcagctggctggttatatatattcaccaatctgttatagtagccattgattgatatggtcagagataatatatcaacagcgcatgactttgcaaaaaggagctttattaattattaacaattcctcgaggtctcccatattgggtgaccttcccttgttacatccaatccaaatataggaatgtaaggcatcagctaaagttatagcagatgctgatgttagtcacgccgctccttctctgttctttagaggaaagaacattgaattggactgctgtagtctgggtccatgatctacttgttcattgcgcacaaagatattcgatcatggaggacaggttttttgtcatttgttttcactgcatgcatgctgtacatcttagttacaagacagttgtagtgtaaatacttagtaatatcattacatgtcttgtgccctctagaactctaaacggcagttctatggtcttgatttccagctaagttaggtatgggaggcatcaagaaattgagaatgaatggccactcaaggatgatgaataagaaccccccatactagtagtcagcttggtgcatgttttcggttgcaaacatcttacctgtagcttgcatgctggatgttgctatattggcctctttggtaggctgaatcactagcagaaatacatgaatataatggatgcatgcaagggaaatgttatttcctcactatgcaaatgagcgatgctcaagcaatgcaggtgttcacgtacaaacagtgagacacaatgcaggaacattctgggtcactctcctttccatatgcatctcccactttctccattccccttcttgccttctctttgttcacgatgtcaccaactagaaaacctattggttgtctgccttttggtagatgccggagatgtaaatcattttctatttttcattagataagtattaaggaactgttccattgatgtgattgacgcagcttgcaattggagagttagttttcctgcatgatcttacctacagtgtgcagtcacgcaaagtgagcttttgtccaatctggacataatctgattggttctaaaacattaaggcatgttgcagtacagaggttttctttggcaatcttccctgggtctcttgttttttatgtttcacattactggttctgataagcattctacctaaataaattggactccgtaagtcagaacatgtatatcagcatgtgggaagagcacccctgaccattgcctgatcctaccaatctaccatagccatcggaaagctcttctggtgtttaccatggaaatggaagacatgaggaattctcatcatacaaattggataagatcgtccgcatctgctaagggaagacaagagatctaaaacgctgcgatgattgtagcagtgcgagtagcagcgagcctgagactcgagaggatatctgctcctccattgctccatcgccttatttccaaaatggattggttcacttgtgcatcttgttgctccttggttcttcctccatttttttttgctacagaatggttcattgtttttcttcctattattagtttactacaagatgttgcttatcacaggttgtatggagtaacttatttttcttttgaagaaggaagtaactttatttccaagaggtcaattttgtgctgagatgccttgggaggaagatgatcagctggaatttgactgggttgaaagggcatcctcttgtacctttgactgagttgcatgtgcaaccggcttgttagcactccgaataagtcattgcacaatagagtacactaatcgagcaaatcttaaaattatgttatcaaaccatatgcagctgtagacaaacatagcgccgctgtagatgaacaataataggacagaactgagaagtaaatgttcaacctttggaatctctaatagttgctctgattcgacttttggtagcatacattttgactaaaattataaattagagatcacaagaactaagagaacttcacatagactacagcccatagctatcaaatgcatatcagccccaatcatgcgaggggtgatgtttactgtacaatagaaagtaggaacataagtcaaacgcgcacacgcttcgcttgtgttccaaaaaaaggaacacacacacgcgcgaatgcctcgctcgcttggctcgggctggagtggcatgcgtacgcaatttgtgcgtgaatggtttgtaaaaattggctcctcatgcttgcataaatgcagcttccttttacagttttattttgttgcaaaatttggtgctcatttttggaaacacaccaagtcatctggtgcgtggagcggtgtggagtccggttaggttacatgcgatctctctagttcggttacacgttatggagaacgtctaggcgtcttgaatcacattttctattatttctatataaaccgagccaccttcttctagcatcacacacgaaaacaatctagggtttgcctcctcctccgaaatgtgccatcactcgtagtccactctatccagctagacagcatgcactcgcgatcacgagagcaggtctccagaaactttgccttcgacgtcctacatcgggagaagatgctaataaggttttcggaaagcactttgcaggactggtcactggtcttccacaacggctcatcttcctctatgtttaagggctacacgtagacaacaaaaccctgcacctcgcgttgttcttgcggtgcgggctgctccccgtcaagtcgatcctattctgcattcaccatgtgctacaaagccaatctgttcatgttcttctgtttagtttatatgtttaaatcacatgatatggttatgtttatttacatgttcaatgtcatgatttattgaataaattaaatctacacgtgcttatattttcatcagtgtcgtcgttatccctactgcataatggtgtctacgatatctgtgtctaaaaatcaaggttcgatcattgccggcagctgttctaatgatcaccattcataattaatggagaaagcactctaactgtccaaaagcttgattcagtacaaacgctttaagcatcctgtatttctcagctgaattcaatttcaaataatatattaatggcatatgtgctacaagtacaacaataagaaagacaatatgaagaaaaattaagccatcttagattgatcactaaagtagagttaggtaggacaatttggcctcttcagatggccaccatgtgcaaaagaaaaaaaattgagaaatacataatgcacaagcagtgaagcatagcccatgcttatttgtaaaatttgtatgtgtctcagaccactagtaaaaaggtaggtcaggaaaaaaaaagtgaaacaacatacaggggtcagtataaaaagtgatggaagaaagatctcgggctctcatgttctgtaaaacacaacacaatgaaacggtaccctagattcatcgctttcggttatgtatgatataggaatgattggaatcaggaatactgcttgaatttggttatcaatttatgcatgtttatcaaagattaccctgcctagcgagtataatctcccttgctcaacttcttccaagaggatatgatctcccttcttggatttctgcgtctttggacgatgcgtcaagaaggctagcatgcttactttatgtgcctgtccagctgattacccaacgaagatgtttagatgttggacattagtgtcaatttattgtaattgtaagcgttaactactcttttccttggggagttaagagaaatactaccgcctctgaatatactttcttttacacaagcgttttgctgcgccaattgaagagttatttttctatagcctggtgttaaattgcagtgcagtcgatcagagtctgcttctgttcactttggatagaactaataagcacatgatgaaacatcaaggcataagtacagacatgtttgacagtattggcacttgatatgaatattattacattaatgttgcagtatacagaggttcctttcacaaccttccttctgcctaaggctgagggtcttatttaaaaagttttgtgaaatatataaaactatatgcatacatgaaaatatatttaacaatgaatcaaatgatagaaaaataattaataattacctaattttttttaataagacgaatggtcaaacatgtgctaaaaagtcaatggtgtcaaacatttcgaaacggagggagtatgtgtgtgtgtgtatatatattcagtttgatttataattaaactgtacaaaaaatttgacaatttgacccttgaggaaacttgtttcaaaaatgcaccacgagtaaaactttttttaaaaaatgaatcgggaattcagcgtggtgttgagattagaccgctcggagccaggtcaactggcgctgaatgatgtgtcctcgtggtgcggatgctaactcagcctaccgacgtggcaaaggtcagctcaacctgccacagtgctgatgggcccgccatcagcgctaggcttgttgtcgccgatgtaggaaacttttatccccaccctacaatctttcgtatagcaatatgagcaaagagaaccctacatcccaaatcaatagtattaagaaaaattaacatcattgagaaagtatctccaagaaatccacacaaaatctgtgcaacagataggaaatacttttgcaacaggaattcagatacctttgcaaccacatttgaaattcagatatttcgctatcaaaaccatgttcataattagtgttgtagatctcataattgctctggctattgtttttgccaatatacattcagaaagaaatcacaaattggacaccagaactgagaacttcacatagacagaaattgcctccatctagcaaagtacatgagccccctgtcattcaagaggtgatgtttacagtaggaatagaagtcatctggaatgctagcgatgcatctgaagtctgaaccatttccaagcaatcctattattcaggtgccttgatttaaacattcagtggaaaagagtttttactataaaacagtcagttaattcttccatgaataataacggttcagttctaaatcttggatatgaacttacatatatatctatccaaaaattaaacaacccggtcttttctacctatatctcatgcagaacttgatctatttcaggtgtatcgaaccagcgtggagcagagtgcctcaatcctggctcacaactctagctgtgaaggttattaatgatcaagagaataaacatttggcaagatattagaagcactagaagactaaataagttttgataactgttgaacacagtcacttaaaaccaatttatacagggatcagaacgtaatttaatttgctatgacaagcatagtaagtttcaatagtctgagactttgagtagacagttcaatgcagtcttctttttctttctttgtgacaaattggaccgaatatcttgttttcagtaactgcaatgatttgcagggacattcatggagcaactggtgtgtaatatagatgaatgaattcacagtatatggaatgttcaaaaggccgaggtcattggtggatgaactgggaagcggttgaccaactcaactaggatggtagtgcctgatggaaaaggctatactactttttttctcgcaaaactcttattaccactgggccaaattatttcaggactgaattcctttttcattccacatgactgttgtagatatcaaattcatttgcttcaaaatgtgccgcataaacatagaaataaaacatttttgttaattccccttcaacacatgctatggtgccacagacaggaaggtaggtctgcattattcattatgctgaaagtagaagctaataaattccagtgttatatatataacatggtagcttttgtcaaccagattcgctaatactccctccgtttcgaaatgtttgacaccgttgactatctagtacatgtttgaccgttcgtcttatttaaaaacttttgtgaaatatgtaaaattatatgcctacatgaaaatatatttaacaatgaatcaaatgataggaaaagaattaataattatttaaatttttgaataagacgaacggttaaatatgtgctaaaaagtcaacggcgtcaaacatttcgaaacggagggagtatattctattgacagataacatgactagaaatagaggccaaaagagatatcacttgctgagagttgcagttgaagttggaggagaggattccatcatgcatgtatcagatcaaagttatcaagtagtagcatatatacacccaatttgccgtggtttctttccagtcggacatacgaatggaagtcatcagaaacaattctattgcacacagggtcactgacagaaagagcgttggtttagcagcatctgcgttggtcaactgcacagacgtttcatctcctcttccatttccagagatttcctccgtggattcccaaagctataaaatcttggccaacttcgtattaagggagaggttaagctcacaatgtcagggatttgaggggctctgcatgcagtcaatactcaatactgatgtagccatatcacaacaggcaaaagtgtttgttgcataggaatttcatggtctaactatagtttcataccctagctagttagatcaaaattttacgctcacagctcattgaagatagtgagcaccagatcgatcagtgccacggttggtcttcagttcttcaaaaatacgaacagaaggagcacctatcctttttagtaatgggaataatttcataaataattgctcagctaaaattttacggcaatttacattcagatagaaattataaaatggagactagaagagggatctttcacataggcacaatgcaatttcccccatctagcagcgcacgtcatcccccgatcattcatgtggtggtgtttaccgtaggaataaaagtcatctggaatgataggtcatacttcacagctcttcattgctgaggtgtatgatttaagaattcaaattgcatataacctttttactgtaaaatagtaatcttaattctgtgagtagtaacacttcggtgcttgctctgacatgagttcaatcttaatgtagcatgaccactgcattacgcaacgaagcttgaagtctgaatttcaattcaaaactgtaatatcggagatatcggcaggaaagttcatgtgcatcatcaatt

SEQ ID NO: 73686 - DNA, 1779 bp, Oryza sativa
caataacattcgagcccaatgcatatgggtctccatgctgctattaaggcccaactgagatatatatgggccaaaatatttaagacgtgtgcggtggattcgttatgggtcttgtaggtccaaatgtaaagacttttgtctttgtcctatccaataaaagatagttcagatggtacattaatacttgttttctcaaaacacaaaaaatgatacatactaaaacaattttttacccttgaacactagtgcaacaaatacaagttaggacatgttacctcttcaatttccatgtggaaagcaggacacaccataatttaattctagttatattgctagacatatgctctttaaagcaaaagtgaataagtgatcagtgatcagctaatataaattcaactggtaaataattaaacaacatggctataaatactgcaacatatcctatgcacacacttatccttgtgcactcatgcactcgatcactctagaccataggatctcaaagaggtcatctctactgctgaagagaagttgaaggatcaaagagtagatgcatgcttcagcttccatcaatcaatcactacaaccatcttcaccaacaggctgttcatttctttcctatgtgatataccactactatagaaatggtttttgcagacagccaaaaacggtcttcatatgcgaaaaggtctgcgaaaatcgagtttttcgcatgcggatcctacgaatggtagtcattaggaaggaaagcacaacatatggagtatgatggggtaaacaactgcgtcatggagggaggcatcagccagatcctcgccggcagcgcaaaccaaattccccgctgaagatttgaagttgctacgccccacaagtcaggaggagcttctgtttagcagcatgctttctccggctctcttccatcgattgcattattcatcaactcctccaagctcattgatacattccaagagggttaacaaaggtctcggaagattgtttagctagggccctctcaacagttcaggagatgtaataatatccgtatgaatataatttggaggcgatggatgtgattgtatgatctgtgggagtcggacaagaattaatgtgtgtgatcttgctcaggatttgcattttcgatttcggccaaaatttcggtgatttcggttggaccaaaatttacgaaatttcgtgatttttggcactttttggaccgaaattttttaaaatttaacaattttttactgtatttgaataaagtttggctaaattcaaaaaacatttgagaaattctgaaatttttggtcgatatattgatttgccggtggggtccgaaaattcaaaccgaaattacaatcactgatgttgctaccagaagagagcaaggttttttcagtattggcaccatattttttttttatagatccggctccttggtcggatgagttatgtctaacaatagttgacacctaaaatgggtgaaaatcatatttaacatcgagattagcacaagtagcagctgcagtagattttgaggcgttttgagaaaaacaccttctaatgacaataatattgaaggcatgaattaaatttgccttgtaattaattttttttaataaatggctccaacaatatgccttcaaaatctcatccatcctgtagtgacatgggctcattgtcagcatgccaaaagtatttgaggcctgagaggatgaaagtataatatattatgcccaaatttgtagatggatcagaatttcgaccggagcctctggaatt

SEQ ID NO: 73687 - DNA, 12678 bp, Oryza sativa
ggcccgggtttagaaaaggaattttttttcttgaaaattaatctaatagttgtaaataatgggtccaccaaatttaatgaaaatatgattattttagaattttaagaatatttcactaatttattagagcatcacatggtaacttagaagcgtttgtaggatgtcgtaggacgaattaggagtatttttggaagtttaatggacttttagacatctaatataatgttctaaaacatcaattgggtcccaatttaaatgaaaatcgacggtgatatttatgtaaagttatagagtacgatgttttaactttttctatatgtacgtgtaagtatatatatatatatatatatatatatatatatatatatatatatatatatatgtgtgtgtgtgtgtgtgtgtgttctttcggtgtttctctgatcatgtattaagtacgtataggagtatgttctttcgggtttatctgatcgtgctatactcacgtatgtactcgcatgtctttttttttcggttaaagagtagcttaataataggattagaaaaaggagggaaaccggggatcgatggaaggggaggttcaacgaaaaatttaatctaatggtgtaaagtatcgggtccaccaatttaagtgaaaatcaacggttagatttgacagagccacgtggcggcataggagcgtttgtaggagccccacgtggcggcttgagagcgtttataggaagttttatggacttttagtatataatagaagatagataaactttaattactgtccaggtgcttaaaattctaccgaagctccattatcttagattgacaaacttttttatagaggaaaaaaaagccaggagctcctatttactgaaaacaaaatcgcggtacacatgttagtgttacaatttgaacgtgttgggtggtaaaatattctgctatctttgaattaattgttatgtacaaagagaccccatgactacacaccattcctgctataaaaaggagccacatatgttagttctttgctttatcgtcattgcaagcaatgcatccaacaattctggaacttactttatgcagctggaggttaattataggaatggaagtcactaggaaatcctgcttgtaacgccacataccgtagttctctttatgggtctctgtaggttgtgtcatcaatcttattagtgtccgaaatccccttcttccgcagattggggagcatgcaaaatgctcctctctgcgatcgtgatctggtcctagagaaatgcccaagtcctcttttgctaatgagcgatatccgagcatggtagctagcggaaatttacatggacggtgcaaaatgaagagtacgaggaacatattttgttcaaacagttcctatatattttttaagtacgaattatccccctaaaccataaaaccagatattttacaccctcaagttttcataccgaacaaataaccctcctgagcactgttttgaacggttttggcttgagcttgtacacgtggtaccaatgtgacaatctagttagcaaagaaaataaaaaaattcccggggcccacatgtcatacatatcccaccgcaccatcttgcatgttctttctgtcgctcaggtagctggcagcaaaggtggacctcgctcgacgggcggtggcagcagcagagcaagctcgagtggccggagttggagacagaagtgaaggcggagctagctcgggtagtcgcagtggaggcgacgggctcaggcgaccccttgtgcacgcgcgcgctctctctctcactcaggtggcctgcggcagaggtggacctcgctcgggcgggcgatggtagcggcagagcgaacgccgccggcgacacgcagaggccgatgaggaagtagatgcttgggagctccaactcgaacgtcggcagcgtctcggtggtggaggtgaggaggaaggttagcgtgaaggcgaacagccccagccgcttgtgcgcgctggcctcgccgtagccggcgttgatgtagatggtctcgagcagtgtcctcacgagaacatactccaggaagttggtcagcagcagctgcttgcttcggtacaccaccttccacgcccgcttgtacaggaccaccacctcgtatatcctcgagcacggcgaggttgacgacgacgacttcgaggacgtgacggtggcgagctcctccgtcgtcttggtgttaggaaacgataagccaacaaacgataaaaaacaatagatcaattacaaaagacacgagatttaacgtggaaaaccctcctaaaacaggagagaaaaaccacgggtgtcagccagcaaaatatctccactctatctggggtgaggttacataacagtacccccagctaaaagatgtatataatggagaaaccatagaaaagatgatgatccgtttatatgaaagtttcagcccccgcacccgcgggcgtccccaggtgcacggcccaatgggccagcttcagcctccgctccactacggtagaagttggccttcattaagtgcaaatgaatttggatcacaactcaacaaactctaccttgagacaaattccttcttgtagcataaaacaatccttcaccctgaacacaacaaagaccaaaacactttcggcgccaaatagcctcttgggctaaaccattataccaactaagcttgagcaaggctcaaacttagcaacaggaacaggctttgtcatcatatcagcaggattatcttaagtacttatcttgcataccttcagcttaccttgcgcgactacatcgtgaacataatggtacttgatatcaatgtgctttgtcctctcatgaaacatctgatctttagtgaggcatatagcactttgactgtcacaaaacaagttaatgcaagaatcaactccacaaagctcagcaaacaatgctttcaaccaaactgattctttacatgcttcagcaatagccatgtaatctgcttcagtggtagactgggcaacaacaggatacaatgttgccttccaactcacaacacaactaccaatagtaaacacataacctgtgagtgaccttcttttatccaaatctgcagcaaaatcagaatccacatatccaacaagccccttatcagtcctgccaaacttcaagcaagcattagctgtgcctctgaggtacctaaaaatccactgaacagctttccagtgttctttactaggattagccatgtatctactaaccaaactcatagcatgagataaatctggacaggagcaaaccatggcatacatcaaagaaccaacaacactagaatatggaactctagacatgtattctacatcctcatcagtactagcacattgtaaagcttataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagcagcaccaagatcctccatatcaaactcactactcaactgtttcttcaatgtagtgatttgttccttgctcttggcagcaatcagcatgtcatcaacatataacagcaagtatataggtgatccattaacaaatttaatatacacacagctatcaaattcagacctcttaaagccatgtgacaacataaatgaatcaaaccttttataccattgacgaggagactgttttaaaccatacaatgatcttttcaacttgcaaacataatcctccttaccaggtactatgaacccttctagctggtcaatgtatatctcctcctcaagctctccatgtaaaaatgttgtcttcacacctaactgctcaagctcaagatcatgcatagcaacaatactgaagaatgtgcgaattaaactatgctttacaactggagagaacacatcattataatcaataccagcaatttgactgaaaccttttgctactaaccttgccttaaacctcggaggctcgctaggacataaaccctcctttctcttgaagatccatttacaacgaacatgctttttctgttttggcaagtgcacaagctcccatgtgccattcttctcaagagactgcatctcctcctgcatagctgagatcgacttctcacggtctccagaaacaatagcttcagtgtatgtggctggctcaagagtattctccacctgttcagcacaactaaaagcataataaaccatatcacatttctcaataaggcggactggagctccacaactcctctttgttctgcgatgtgcaataggttcatcttgtggtgcaaacaggaggtgagtgctgaacaatatcattaatatcgttaccaacaatttcagtttcctgatcatccacgtgctccacctgcacgctaacatattgctgttcctcatcagaaccacctggtatgacatctgtgggcaagctgtcattaaacataatagattcaatgtaaacaacactcctgctcatgaatgtcttattagtttgaggattccataacttatatccttttactcctgaaccataattaagaaacagacacttaatagctctaggctctaattttccattatcaacatgagcataagcagtgcatccaaaaactctccactgtgtataatcagcaggcataccagaccatacctcaatgggagttttcttattaagtgggatagaaggcgacctgttgatcaagtagcaggcggtgttagcagcctctgcccaaaaacgcttgttcatgcgagcattggacagcaaacaacgagcctcggagatgaggttctgttcatgcgcttagccacaccattctgctgtggagtgtacgggatggtgtgatgcctaaggatgccttccttcctgcagtaatcatcaaaagcatctgaacaaaattcaccaccattgtcagtgcgaagtacttttacctccttttaagtttgcctttctatcatgactttccactctttaaaagcagcaaatgtatcatctttatgtttcaggaaataaggccacacttttctagagtaatcatcaataatggtaagcatataacgagcaccaccaagagagggcttacgagaaggcccccacaaatcaacatgtatataatcaagtatacctttggtgcaatgaattgaggtattgaattttacccttttgtgcttaccaaaaacacagtgctcacagaacttcatgttaccctgagtgcagccatccagcaggttcctcttcatcaattctgctataccaagttcactcatatgtccaagacgcatatgccataggttagtcctactagcttcatctttagaaacagcagcagcggtaacagaaccatgtaatgtacttcctctcaggacatataagtttgtagaattcatatcaccaatcatataaacgagagaacctttcgatacctttacaactccactgaaccggagtatttgtatccttctgcatcaagtgtgctgagagagatgagatttctcgccatccctggtatgtgtctcacatatttcagcgtgcgtgtcatgccatcatgtgtcttgatctgaacggagccaatgcccatgatcacacgtgggttatcatctcccatgcgcacaacatctccattctgcacagacttgtaagaactaaaccaatctctgttaatgcagatatgaaacgaacatgcagtatcaagtatccattcatcatgattagcaacacaaccagcaaaaacgacaagacaatctcctgaatcagagttatcagcactggtaacaacagaggccttaccatcagatttccttttctccttattctgcagattccaacattcttcaatgaagtgatttttctttttgcaatacttacataattttttacctctactctggctcttgtcatgatcattgctgtcgttgtaggttctccgctcaaatctgcctctgacctgcaatgcttcgcccttagaggacgatgcatcagattgaaccatacctttcatcttctccctgttttggagcgcctcatagacttccgctagggttagttcatcatggcttaaaagtatggtgtcgcgaaaatttgcatatgaactaggcagtgagcataacagtaaaagacctaaatcttcatcatcaaactgtacctccatcgacactaggtcggcaacgatctccttgaagaccgatatgtggttcaatacagaaccactctcctacaacttgtgtgagaacaacttcatcttgatatgcatcttactggttagatctttagacatgcagatcgattccagtttgagccaaagttctgcagcagtcttttcctgcaacacttcttgcaaaatatcattagatagatgaagttggatcagcgacagagccttacgatctttccgcttctcctcagcggttcattaagtcgatttcttcttcccgaagctttccagcacctcatcaagatccaaagtttgcgccagaacagcccgcatcttgacttgccatagcgagaatctcgtcttgtagtctagcagcggtagatcatacttcatcgacaccatcgcgaaaccctaatgtgggaacaagctctgataccacttgttaggaaacgataagcgaacaaacgataaagaacaatagatcaatcatagaagacacgagatttaacgtggaaaaccctcctaaaacaggagagaaaaaaccacgggcgccagccagcaaaatatcttcactatatctggggtgaggttacatcgccgcacggcggcttacaagaggtatatatatggtggaaccctaaaagggatgacgacccgctacggtagaagctggccttcattaagtgcaaatgaatttggatcacaactcaacacttgggctcaggggaggaggccgaaaggtagggcagctggtcaagcacctagcggatttaactaggagaggagcacggcgtcgagggagtcaatggagcagtggtgcatgacggcccagcaggagaggaggaggaggagggagtccacggcggagaggaggcgcgagctcggctggtggatggagagcactaccgtcatgccacgcgcggctgcgatggcgcgcaggcagccgacgacgacgtgcggggggaggaggagacaaggagtcgaggccagaggtgggctcgacgaggactccgacgtgcaccacatccgcctcccaaacttccctgcgcggcgtggaggcgttcgagcagctggcggccaagttctgcaacggcgtcaagcttgacctcacgccgatcaccgctgcgccgctccgctgcgccgccgagcgcctcggcatgtccgatgaccactccgacaacaacctcatctccattctcccgcgccgacaggttcatgtcccacaccgtcctgaggaaccccagggacgccatccgtgccctttggtcatgtgagggcctccttcccctcgccgacgacctcggcctcgtgtcacgctgcgtcgacgccattgccgccaaggccgccgcgtccactcccaccgccctgttcggctggcccatcaccgatgccgctgccggcgaccgtcccgcgctgccgccgcctccgcatcctgcggcgccgcccaccgtcattcacagtgagagagagagaggtagagagaaaagagagagagagtggaaaaggagtacgataggtgggtcctacattttttttaaataaaatgctgactggattgccatgtgtacactacgtacgacagaaccgctttggattggatcgaggggggtaattttgtcaagtattgaaagtttagggtgaacgatgtctggttttcgggttcaggggtgtatttcggtcgaccgggatagttccgggggggggggggtaattcgtacttttctttttttttattacatcgaaggggacagcattttaattaccaacaaagatgttgaatatgctttgttttacacaagtcttatatatatgctgagtaatcggagagttaatttttcagcctaatcttacctgcagtgcagccgatctgtggatagagtgagataagcaccgaaacatcaaggcatgagtacagacaagtttgataatattgacacttatgtggtattattacattgatattattgtacaaaggatcctttcataatcttccatgtacgtaaggctgaggagctcttttttttttgtttcacaatattggagcaatatatatatgaattcaaacattcactttgaaattataaattggacagtcgaataacaaacttcggctagaagtatgagggacgagcgctctgtgttcatggcaattacctatcctagcgataggaatgatcttcacaaatttgtcatggaaatggaaggcatgaggaattcaatttcatcgtacaaacggagaagattgtccgcgtttgctacaggaaggggagtcacttaaaatcatggaatgattctagccaggtgggttcagatgtcttgcaagaggatgctcatccatggccaaatcatctcagatctgaaatgttttagttcgctcgcgcgccttcttgctcctagtttgctctttttctttcacaagatatcgtattaattagtgtactgtattctaattagcatcgcagattgtatgctatacggaacatctcgacacatttgtatttttcgatggattaactttatttctttggggttaaattcgatgctgaatttgccttaagaggaaaagtagctacaggaatttgactacatatataatgctgtcatgtttggagtgattaacacaggccaagttaaatccataggaagagataatgatcgtcagcaatattgttgccacaagcattgggaaaaaaaacgtgcataaatcatatgagcaactgagaagaaatattttgtctctctgaattgcttggaggaagcgctctcacatgcactcactattttatcttcactaagatgtttcttgattgtattcagagtcttaatgctctgtttttgactgacaaaatatgaacacatgcctcggacaatcttattatatcacgtctttgcttcaaaattttgttttcaattcaacaaaaaacactccaattctattttgtgtctgctcgacaagcccaagcggccaaacagggttgctgggcggtggatccatccctgactatatgggtacccaatagtctgttataattcaactaaattagttcaaactcatatttttttttgttggaatacaaagtgaattgttcgcttttttcctcatcagcttaatcttttgggttgaactggtcggtgcacgcaactcaatatggtatcggagccgaaactctcgagttcgaatcctggctggcgtgcaattaaataaaaagtgcagccccttgaggtggcctcacgtgagggggagtgttggaatataaagtgaattgtccgactttccttatcagtttaaacatgttataaaaccagccccgaaatcacatcagaaaccaaaccgtggaagaaaacaccataggagatccaaacgcgatgacagcaccgaggcacgatatttgataaaggagttcagctgaggcctacatctccggggcactgattacggatgctcctccccgatccagcatattacagcgtctcagagttacaacgactgacgaccggacgctgccggcagtcgctccctctcgctatgctaagttgccatgcggttacaacaggcacatctctctatttatgagagatcataggacagagtccgaatcttactctagtcctaatacctattataactccaagttctaaactgtaaccgactacgtacacatattcgacacaaactcacacatatttgacacaaactctaacacgatcgttgtatctagcaatgcacatcctatccagctagatttaacaatcgaaaatgatttgttagcgtgttgtactggtatctcgaggttccttttagtgtaccggagcaaaatctcttataaattggacatcagaactcagaatttcacatagccacaattttgtctttgcaagcatagcacatcaggaacaatcattcaggtggtgatttaccataggaatagaagtcatcggaaatgctagcgatgctacacaaccacatccgagcaacccgattgtccaggtgctttgattaaattcaccatggcatagctaacgtttttattacaaatagtaagcttctgccgtgaataattttaataataacttaacttctctagatcttacagatgaactatctatccacaattaaacaatctgtcatttctaccattatctcacggagaagctctgtcttttttttttctataggatggcgcctcccagcagaattatgcctcatctgttttcaggttgggtcaggctacaactcagcaaatcgcccacccatcaaattggcctccaatcactcgatcatcgtctctaatatgcattgtgctcctatgtcgggatattgaccttcagcaaagaagtcaaattaatctcttataccgattcctaatctgatatctgaaacggatggttgggtctacaacattacaaagaaatacaagttctaatgccgagtttagttccaaaatttttcttcaaacttccaacatttccatcacatcaaaactttcctacacacacaaactttcagcttttccatcacatccttccaattttaaccaaactttcaattttgacgtgaactaaacacaccctaagttaaagattatgctctattttataacatgtagtagtagatttgttgtatcaatgcatgaaaaagtaccattttcaaacgaaaaatatacagatgaatagcaaaaataaagcaaaagaagatttaagcaccttatatagattcaagaggcctcctcactgtgctagattatcagtcacaaatcccaacgtaaaagtttggcatcaaacaaaacatcacatgacttttgtttctctcaaaattgtagcattacaatatggtagttaattgaaccaacggaaaatatttattagtaaaaaaaagggctaatcaacaaagaaaaaacaaatcaaatgaccatacaaaagaaattaaatcacaaatcaatatagaaaatatattttattataaattagatacacgatgttctgctctagctatgagctttggcattattaaatattggtgtggtagaaaccaaccaaaaagatttgtcgttacaaaaatgctcctagaataaataataataaaaaaaatcaaataacaatacaaacggaatttaatcagaaatcaatatagaaatcaaaatagaatgacggacttttacaatttacacagatggttgtgtgctctataagctgatccatgcctttgcgtgttctcaaatttctgtcatgccctaaacaatgttgacaaaaacaatggatttataattatctactaggggttaaaaaatatttaattttcttcagttacacaaacgggctaactaaaataaggcgcatcaaatgacacgccaattttctagttaaatctgaaattaaggtgagtaagtccaattatgtcttcaggaatagaaatgaaattaatatgttccaacatattcctaatgtggtacaacactgaaaagttgatagagatctactctggtccaacagtatgtatatcgagatactggtacctcacggtactaaatcgtttccgatcgttggatctagctgggtaggatatacattgttagatcaaaccttctgagcacaatgcgcaaatcttctttgtctcttcttgtctaatgatacggatagtccttatctatataaattaaaacaaagatttacgcaatttcaattcagcactagaattaatatgatggatgtgaatgaagcatattctcaaaatccaattagctcaacttgtgtagttaagggactcagaatgagagtgtgcttaagtgcagatcatcagaagccgtatttatgtgatcactgctctaacaatcacaatatttattgcatagctatttcaaggtctaactgtggtttcatagttatcaattgaggatttaactacattaattttgaagatagagtaggtatccgactgacccattttatctgcacccagtaccaggggaaggaacatttatctctgcacccagaatgggactgtccacatctacagactgtgcagtgtgcacccaaaatgctccctaggaataccaatgtcgtccatctttttgctaatgatcattgatatctaagcaacagatgatggattgatgtggtttcatgcatattccaggacttcaacctggtccccggctcctatttccattcatgtttatctccccgttaacattgtcacggccagataaactttacttggatgatgtaaaaatgaacatagagttgaaaatgcttctatggtgaacgaaacatagatgataaataaatgtcaatttcgatcagacacaactgttacatttgttcgatagcatccaaggaggtaacagtgtaccaacaaagatgtcgagatgttggatattaatgtcaataggtactaattgtaagctatagctactcttttccttgtggagttgaagacaagctacaggttctctgaatacactctgtatgtttgtaggtgttc

SEQ ID NO: 73688 - DNA, 8943 bp, Oryza sativa
aagaattcagttttcttttgtttcttttgagtcttctcatgttttttactttgccttctgtaattcaccttcttttcagctctttctctctttttaccttttatccttcttcttcccctgtactgtttccttcctctttctggtttgccaggtttatctggtattgaccaccattaatggttataaggtagagtctctctaccttttgcgtaaaaaaaaaatcatcatacgcttgaccagaacgagtgacctaaagaaccataggttacagggtgtcttgcaacaggattctgaaatctgaaatgcttggttcacttatgctccctgattctctgtatgaaaaatcatgaatatagggaaaatcatgggaagagataacaaccatcaagaatattgttattgtctcggttctatttgcaacaagcatttgtaaataaaattgcataatcgatatcagaaattggaaaatctttttttttaatcgattacatggaagaagagctctcacacaccacacacatacactgatacacacctccgagtatgtcatttaattaagacacgtacaaataggatgatgactgccctggatccatatacagcgtaaagtcctgcgagtatgcaagtttcagagctttgttattcttccatttggctgttttgcatggaattgtaattctccgctatgccttgcgcagaatttttgcgagttcttgccagtaattagtataggtaatagatcatctcgactgaattactatgaaattcagggcttgcagctcaaattcaagtggttcagtctcacttttatgatccgttggcatgataggcttcggaaatactagcagtacatgtagctttaatcgatccaccgaacttgagaaatcatggtaggttggaatggaacagagtgaatttctggatcctgctttgatggccatggatgatcatgaaccttctgagcactaatgtatgcccgaataatctgtctctcttcttgtggaatgatatggacagtccttatctatatcaaagtaaaacgaggacttacgcaattttagttttgcactactattataatatgatggatgtgaatgcagcatattcttgaaatccaacttgctcaacttatgtagttaagggactttgaatgatgagtgtggttaagtccagattatcagaagctgtatatatgtcatcactgctctaataatcacaacagggcagtagtacccagggcttaatatttcagtttcaggtttcctatcggtggtggccgaaataccgaaattatatgaatttttgaataaaacttgatcaaatctgaacaaaatattaccaaattcacgaaaaaaatgaaaattttttaataatttcggctgaaatttccaaattcactgtttcagccgaagtttataggaatattgcctataaatttcaaggcctctgcatgtggtttgattgttcttagctgagaatttaactacatttattttgaagatagagtgagcatgattttgtcacatgtgatcactcaatacaagcgaaggaatgtttacataggacagaactgagaggtaggggctcacttttggtaatctgcgaggttcataaagccgtctgcccgtatatctctaacaactgctctgtatcatattttaaccaacataattcagacagaaactataaattggaggtcatccaaactgagaacttcagatatcccattgtccctagctaacagaacaaattggctcacagtcatgcaagtggagttgtttactgtaggaataggagtcatctggattagtgatcaaggccggttaatctattcttgtagtgatgctgtaacgctttgcttttcgtgaggcgttaaaaactaattcggcgaaaccctaattgcgaaaatttcgttctttgtgtgcgagtctaagtcgtgccgtggatctcaattcaaatcctgttgttctctctcatcgaaatcaaaatcatcctcctcaaaatcatcatccttctcaattcaagtctccaaatcaaatttcgaaaattcaatccctctcttttgaatcctcgccaaataattgtccccgtcctaaaaatatcaaattccctttttgaatcctgttgtcgactcctccctctgatccaaatcccaattccgaaagtcaacctcttccttgaactcgttgccaactctttctctcgagttcgagagaattaatcctcatccgaatcatttccttgactccaccctatgttcccgagaacaaatacccaagttttccttttgaatcttttccttgacttctccttgagcctcccttgatacatccctaaacactcgagttcgaatatcaaatttgaattcgaatcgaaaccctaaatcctctccaaatcaatcccttcaccagaagtctattttacctccttcttggtcgattgggccgtttttcccttccctcggcccacttccccatcggtccacgccctggcacgtgagccgcgcgtgaccatcaaggaggagagcgccgttccttctctttctcccctgcgcgcgcgctctctctctcatcaccatcgtcaccacgagctctgccgttccatgccgcatgcatccaaacccgggagaccgagctcgcgtttccctctctctctctctctctctctctctctgtgtctctctctctctctcccgacgaactccccccggcgccgattcccgtcgccgccttttcgattttcgccgcgccctcgctcgtgcgtggccgaccgcccggttgccaccgcgtcagccctggccgcctgcaccgcgcagcagcccatgccgccctgccactcgctccaccagtgcgcgcgtgcgtccaagacgtggaggcagagcctcggctcccctctctcacgtgctctccctcctccctctgctcatccaaatcggcaaggagccgagctcctttcccctcccctttttgctttttccctctcagcccggccgcccgtgaccacctccactgctgccgcttggccgctagctctgagcacgaccgccagccgagctcccttgaccacctaagtcggtttcctcccccaaaactgacttcccgtgcctataaaacccaagccgagctcctcctcctctctatccctctcgtcatcgcctgccgtgccttgtcgccctgctcggctcgcaccgtcgccattcgtcgccaagcaccagggaggccagtgcatgagtggacgtgtgacgaggagctccgggcacctcttcttccccttccctggccgctcccggagagcttgctcccgcgccgccgccgctcgtcacggcgccctgtcccgacgcggtagccctccgttcctcttcctcactcgccctcctcctcctttaactcgcgtggtagctcggttagccttccggtggttcgtaggcgccgccccaagccccgccgccgctcgccatggccttgccaccgtcggcgcccgctcccggaggccgcctctcgtcgccggacctccacggcgcctccccaccacatccgatcctagaaacgaaacccttgagccccggagatgctcccatccctttgaatggaaccctcgtcgtctcgtcgtcgtttccccctttgctcgccaccggttgccgccgccgcgattcgccgtcaccggctaccctccggcgaatctgagccgttggctcactctctcttgtcctccttgtcgttccaatgtgctccccgtcgccctcgccgttgcatggtgtccaggtgaaagtgccgtcgtccgccgtccatctcgccctccccttcttcctcctcccgccggcccgcgtggctgccacgtaggcgccacgtcagcgccacctcaactttgaccgagccgagccggtcagccgcctcctccctccaccaccctcgcgcgcgcggtccacggtgcgccaaccggctgcgtgtgggcccgccgcatccctggtccatccggtgcacgcacgtgaaccgcgctcacccgaaaccctagcaccaccctcatgcgccgctcccacggtgagccgcgccaccgacaagcgggccccactcgggaccctggaaggtggactcggcccaccagccctctctctccctcactctccccgcgcccccttgggccgcctctccgggccggccggcccattagttcggccaagccgtgcctctcctctcgggccgtacccaagccgcccgaggaagtctaaatcatatccctccttcaatttctttccaaaaagggtttaataaattattaaatcctttttcctttagacagaaattccttattccttagaaaatccatatcttctcaaccgctcatccgattgaccccgttccacttctagtaattccgtaaaattgagatctatttaatggcactattatttagtctaaatagggtatttttctttgtcttttgtctaggttttcgattgtttgcgtatagttgcggttaccagatttccgtcaaccgcgggttttctcgaagattcgtgaagcttcgtgaagactttgagcaaggcaagtcaccctttgatcaattgctcctataattggaaaatcattattattttgtttgcaactcgcattattagaatcacatacttaacttgcttggcctcggtttgtgtgccaaaccgacggacctacccagtagtcacactaattcctgtaggctgtactaccctgattccttgtcgctccacccttgtggtacttcggtatccgtgctctctgagcgcgtatacctaatatcccacatacaccgttgattgtcgaaaacttgggaaatgggtttgtgaagccttcaaaacccgacatgtggtgtcggtgtgttcgaaaataaaataaattgtgaaaactcgcgatgcgggggttgtgcctatgtggcactgtcccgtatttgtatataaggaccgattcctgtgggaaactcatcgaacataatcaaagtgcaaccacaaggtggaatgggacaccctggctaattaactagtcggttcagggaaacctcgcatgccaatagttgggaacgccggggcggggtcggacaaaccgggttcctggtaaggcaaggacaataagcttgctcacttaccgatcaaggtggctggaattaatttgtgaatgcctaaaatggcctatagttacgtgaggatttgatccttctatgtggcatgaggtaaccctgggtcggcttgggaaaggctttgtcacgaacctctgacaccagccagtgtctagagtaagttcgtgtcttgtgggtaaagtgtacccctctgcagaggttaactaactattcgaacagccgtgcccacggtcatgggcggatgtgaggtggttcccgttgtgtagatttgtttgcctgtgctttgtgaaaagttattgtggattgggaatcgtaaccagaatcagcctatgtggcagatggatgacctgagtggtcagaaacgaacctgtgtgattcgggatgtctgcgggcatcatagactaggcttctcgagtggaagcagattgctttgctgctgggcagctggactatgggagtccgcaaaaatgaaaaaggctctgggagctgcctaatcaaatgaaaaaagctctgggagctacttaatcaagtgaaatggctctggaagccgataagtaatgatctgacccggggggtcggtacattaccatttgagttgttgaaaagcatctcttaagtcgaatcgagacgcaagtctccttttcgacccaaacttaaaaagaaataaatcacttagtgatttcaaaaatgatttcaaacaaaggatttgcaaaacaaccttgcctctcttccaagcttgcattaaacacctaagttcctgtgacttgctgagtacgaaagtactcacccttgctctatataaatatatgtagttcctccgtcctgaagctgaagatgaagtgaattgaagaatagggtttcgtcctggttcccagccgtcgcctgtggtgttgggtgttagaccgttggttccgctactgttgctgttgctggtgttttctcgtctgtgtcttcggttgtattctcaggttgtcctgagctgcaacctaagttaaggtaaataagtcatctatttattttaaggatttgcaatgattcatatttgtcaccgtgggtaccagcactatgtcctgggactggtactgagatcgcggtttcgtaggaagcggttcgcgccgttattcctacgacacgctcctgtcaggtgccgttgtacggcggtgccggattggggtgtgatagatgctcattccttaatactatgatttagggaatatcatccacaggtgatagacctgtagaacatatgggacaccagcagtcacgaagcggttttccggagtaggttgtaggagtgagtatgtatgcattgtgagcgcctgcctttatacctttcttctcaaagaaaaatgaaacagctttctggcgacggagaatgtagatggtagtcaagaatgaaaactagatttacatgtagtcaaatgttccatgtgaaatggacgattgaattgaaaattgaccaggttttagagaagcaacagaagattaattaagattttgtgacagctgaacaatcacgcttaaaacaagcagtcagtacagggatcaaaatgtaataacacggtgacaaagagtaataagagtagatttctgtaatttgagtatgtacggacttgtttgctatttattgttcatgaattatctctttcttcatgacatattctacttaatatcatcttttcagtaatcttacatgattttcagcgacattcatggtttcctggagcaacgagtgggtaacagaaatttacactagatgccatgtgcaaagggcccaggtcattgtgatccctcattcttatatattgcaggcatgaacaacatgatgtcgatacttttgcaacaaaaagttatgaaccatatttccagtcaagttagctatctcttagagtatactacatgaatgggagtcaccgggaatgctatgaatacaaaattaatttgtgttcctggcctggtcaaggacaaacttgtgtcttaattggacaaggagacatatgggacgatcaactaggtttttaggtgcccaatcgtcaatttggatgggtattttacaccttctgctcaagcattaatataggcatttgaccctaaaaaaatactagtatttgacttccgttctcaaataatcattcatggaccatatctctcgccaatcagagtcaataagtcagtagtgccgctggttggcttgccgccactggggaaccaatgctttacatgcaacatgaaggaatgagcacgccttgttcctgtatcatctgtggtgttggggagaaggattgcgaccttgcaccattcacccccgttggctccagggggcctccgccgggaggcctgccaccaacgcccggtggagtccatctccgtaggaaaggcccttatcggaggcctaggaagccgacggaagttcggagccaagcaaagtgccccggggacctcagagcccagtctagggccctgaaggccacggagctggctcaagggccccggaggattcggagctggctcaaggggctccaaagctcttaccaggagtttggggccggagcctagggaggacaccgggaatgagcatgggccgccattaaagcgcattacttatcctccaaccaccaccgatgtcacgacacgactggcgatgtgaaggccaatgctagctattgcctgggtaaaagctactactatgatggcaccataccggcccccttaatgggcgcagccgtctcccggtcaggcgaatggacccccgagccgttggccagcccacctatcagccacctcgaggtaactacagtgataggggtagatttgtaacttcctttgtatgtaacctagtataaatatgtaaatactaccctcagaaggggtacgagagaaatagacagaaacttgaacactcgtaagttctgttccaacatgttgattaatttcaattacgcatgcatgcagatcaaatttgattgtattaacaagaaacaacctttctcagggaagccaaaaaaagcaggagacatggttgccaaaatccaatcagggacggtcaatgaaacttgcaaatttatttaactctttagataatggaagctttattgaaactcagtcaactacatcgagataatacaaccaagctgagctcacttctggcctctgcataaagatacataaagccggaaggacaccaacagcaaacccataaagaggatagccattcttgtgctatcatccacaaacgagaacttcggaacactattgcagtggtctctcaatagttggaccatgtggtactggaattttttatcaggagcaattaaactatatgtttacggatgctctagttgatgctgctacttgttgagtataaatatgatgcctatgaatattgttgcctcccaagtttcattgttgtcctcatgttcactcaaatcgtcaatgacatatcatgtaggcttggtaagcattaggaacaccaaatctaaggtaactccacttgctcgcctttatttagttaagaatgttgcgagccctacacctacatagtatgtgctcgtttgcaggggacagggttagatccaaagaaccactgtcttcattttgcatcctgcctgagccatgtgttgtcatttccttatgaacaaatgcaaataaaacaaggatagaaatccaaattgtgcttgtaatttccggatgttttgcctgaacggcttgatgttttaggagttggacagtactgtaatttcagatccatgcaactctcatttgaacaaagtactgctagtcccatctcaattatacacgcttgtctagaccaccaaatgcttcccaaactggtgt

SEQ ID NO: 73689 - DNA, 2176 bp, Oryza sativa
aaatctatgcatactattccaagaacaaaagacatactttaagaactatcactccatagtcagcatttgcaaaactagcatgcagaattacacggtcaggcaccaaaaatagagacatgttggaatctgatttgcagatctaaaggttctgtaagataatctaagatacaaataaagatcagacacaaaacatatgtactttaaagacccatcaacattacattcgcatagaacgaatatcccaacttagacgcaaacatcaaatcatgacattcattaagaacatgtccaattaacaagttaacatcaataaaatagaacagcaagctgattcccggtactattggataaaaaagaatgtgtaattgagctgattcccgatactattggataaaaagaatgcgcaattgtgttaaaccatgtcctgtcattatgaccctaacaaagtttcccttacccctggctcaaaattacaactaagattacaacagcctcaattgaatcactatgcggaatgttacaagttacaacaagaagcaagctcataactaaattcaattagctaaacatctgcaggagctgacaccctatttggcagatatgtgataccactagatgacgagatcatagctgatataaaaattcaagtgttaataagggaaaatacaggcaagctcacattgaagagatgatggtggattagctggaatatctgacacaaattgctcaaaatttatagcattagaacaatccacattactcagtggaaggagtataccaaatactattgcttaaaaagaataagtataatcgtgttcaaccgtcactcagtcgttattccctagcaaaatttcgtttgccccctggctcatggtactactagaattacaacagatccaattgaatcactcatctgaaatcccaaaaatccatttgggcaatcaaatctatctgtgcctcagcgaatacgcacttaagatctagatcttaaaagcagaatgcaaacaaaaccttatgagctcgacttggctccatccaaagcaaccgcggccgtcgccgactcttgagaggcagcggcggcggcggcggcctcctcctcgagcttcttcttgttgcgctcgagcgcctcgccgacctccttgggcatgtacttctcgtcgtgcttggcgagcacctcggtggcgctgaagaagcactcgcagtcccgggccttgtccgagaccttcctccccgcggtgtctcggcggaggtcgtcggtgaacggcttgaggaagccctcgacgacgacggagtggccctcgcggaagaggtcgggtagcgcgccctcgtagcggacgaggacgtcggtgatgaggtcggtgacgacgaactcgatctcggaggaggaggcggaggggtgggcgacggagccctctaggacgagccccccgaggcggacgcgggacttggaccggtcggtggcgtagcgcgcgagcgcgtcggtcggggtgaggtagaagacgagctggtcctgaaacgtggcgagcacggtgaccacgaacccggccgcgcacccgaaggtgagcgcgtacgtccacagtcgcctgctctgcagctggcgcgcccgcgccccgatgtccgtcgcccgcggccgcgccggcccgcgccgcgccgcggaggagaagaaccgcgcgggccgccggaggaaggaagccaccggcgttcccccaacctctccggcggcggcggcggcggcgcgtgggattgggacggggctgggcgtgtggaggagggcggggaggaggcggcgggaggagaggaggcgcgaggacgccatgggtgggggatctggaaggtgcgggaagcggagcggaattggggaaagaggcgaggcgagggcgaggcgtgcgcctggtttggcggcggatcggcttgctgcccacgccacggccgcacgccggagcaagtggggggaggtcaaaccgtcaaagtgggctggctcttccgggctgcggcgtctctcagggtgggcccaacccaataagcgttgaccagggtctggtttgaactgcagtaatctgaacgaaattcgattgaaatgtttcagttccggtatagtttgactaagaccttgtttagttgggaaaaaatttaggtttggttgtcacattggatatacggacacacatttaaagta

SEQ ID NO: 73690 - DNA, 530 bp, Oryza sativa
tgtttggggagcttctagcaatagcagcttctagaaaaatctccagctaccagaagctcacccaaacaagtcccttattaggtgcatcaccaaacatgtacatcctctcgtactcgatcctcctcggattgacgacgaagcggtgactgaaaataacacaaacacgtgataccgagccagcatgcacggtaaggatgtaagtggatcgatccgtaaactcacttatagtacacaaatgaatgggtaaccgccgccggcggactgtacagaggcgtcgtcaaacgggcggcgcacatagtttccctggggcgtgcagacaccgaacgctccgacgacttgcacgctccatgcatcgccgggaaacctgtctctctctgacggctcacgagcaattcgcctgacaagtgaccacccctcatgctcaatgttctgcatcacaaactgacacggcaatacaacaattaatactggtgcttaagtttaaactgcttgcttgtgtccatcttgtattcattgtttgctggctaatt

SEQ ID NO: 73691 - DNA, 939 bp, Oryza sativa
aagatgtaaagagtttttagtaatcagtaataattcagtaccccgtggtgtgcctgacactacagtggggtagttaacttatgctatatctgatgaaattgtccacaaagtggcatttcagtccaatacactgtgacgaatgatctcatgaggcaaaatagaccaaattcagcattggagatcgactgccaacattgctgatcattcaggaagcgagtagagttacaactcaggttcttcaggtgagcatgtgcctttgcaaggggcatcagtgcaccggcaaacgggttgtcccgaaagctcccatccattgaacccacgttccagcaccatgatgttctttgttcctgattcttccttggtctcagatagatagtcggagaacatcttggcacacgatggacctcgcacctgcagcgtgatttgatctcactgtgtaagaaatatgcacttttgcatgttatctcaaataagaatatcaggcgggagagcacaacgatatgcttgattattatataataatgagctaaaaagagattagaaaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataatggatatcaatccggcctctacatccctaaaggacgtgaagcacatcaaacagaaattgaccccagaaaggtaagtctaagtca

SEQ ID NO: 73692 - DNA, 690 bp, Oryza sativa
agatgggactaatcacggtgaatctggtcgaccgcccataaccgcgggcacggctattcgaatagctttactctgatcagaggtgtacaactgtacccacaagacacagccccacaacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatctggaagcgacagaggccgtcgcagggcccgccccgctccatcacgcccacccttgcctggatgcgtcgactagaggaaagctacactacaagcccagccgttgtccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatactaaaaggtctaatacggtaattatcccatcaactgagctaatggtaattaagcatggctaagcatatagttctagctaggtcacataagtaacatgagctagtcgatttattacccaatgttgacaaag

SEQ ID NO: 73693 - DNA, 1775 bp, Oryza sativa
ccttgtgttggtatttaatgacattgctaaaagtattcattcccaacaatggcgcagaaatagtcctggtatatttattgttagatataccattgtagtatttcacccagaagtattccaaggtaacatatttgtttaattccaaaggaagattgtgaaagagagaaccttgccaagctatacatattacttgcattcattaaagtctaaacatggattaattcaatatgtgggtagagtgacacgaagtgaatcttatagaattcctcatgagaataattctaactaagtgagataagaaatagaaagaactcaattcctatacttttaatatacactcaaactttactctacatttgctagtatattatcatgtggtcaataccccataacagtgtcctcctgttgtttcgagagaccaccccgggttgccgagttccttacgacaacctgtcatgaccgtccaaccggggctaaatacggaggagtaccctccccaggaatttgtcttaggaatgtatactaacatggaggaatacccgtactgagctgtcaccatcaacggcccatctactatcctgcctgcagtatatatgcccaattaatgatatttactatcctaagcatcatgcttacattaataaatactactctacatctctgcagatgacacagagtaactgacgaattagacattaaacccacgccattgcatctctctggtaggctacccacacaattataccgatacgaatgtaaagtaagagcagaacttatactaaatagaataccgagaatataataagagtagtatttcattaattcggaaagtattacagaagagaatagaaaagctactagagccataccgaaactcttccgaggactcagagaactattctatactacttccacttagctctaaactactaatacaaagtatgagaggaatcttaaagcttacttgagtgtgttgagaagtgaagtgagctccttcttttatagggttggtataacggttgtagacaaggtgaaatgaccttcttgccccttaaccatcattgagagtgcatctggcgcgaacacgtggagggccaggctgattgggctccaccagggttccggcgaactcctagttcggacgaacctaggctagcccaacaggcctccagcttcggtacaatctctaacaggtgggtcctattgatggttttaacagttaaagcggtttccaggccggttacacctgacttgtgggccctcttatccataagcttgcttaggagtgagattttctttattttctctttattttattgctcaattcctacaacatgttattctctaagcacaagtggaactatattattctgaagtaaatacgcattgcaagcatagttaattctatattattttagctatattgacggttgaaatttgtatgtaatgaccgtcaacaccttgccactgccactgccatcctcctctctgcgcattcgcagccgcttcgccgcttgctccgccgcggctggccacgagctgagccgagcctcggttgggcaaggggttgaggttggccgccgcgccgtcccgttgattcccttgcacgatcaaacgatcgaacgatgaacgattgaacttaaccaaaacttgcgaatgaactcaaaccttggacgtaatcaactactccctccattcctaaatatttgacgccgttgacttttttaaacatgtttgactattcgtcttattcagaaaaatttaagtaattatta

SEQ ID NO: 73694 - DNA, 1194 bp, Oryza sativa
caaagtcagtggcaaatcgtagacgtgcgacaaagtcagtggcatatcatggattatctcaatttgaatttggtaacacggtgtaaccatccaagtaaaatgcagaaaaactcaatattaaattccaattccaaatgtccacgtatacaggccatatttgacaatacaagcacacagtcaaatatacagaatcaaattaaatgtccaaattatacagtcccattacaattacacagtccatttataaatgtacaatccatcgtaagtccaaattaaatacagagccaggataaatgtcccatttaacagttcaattacaattctaccgtccatgtacatgttcgaatacatatatcacccctattccaatccatgcaaattacaaaagctcctattacacttgggccattcctctctcttccaacccagcccattcctcacagcaagtctatgtttacgccctctacatgccagcccactccctctcttcttctcagcccaaaagtttactttgcgtccctcagccaacacagcatgcatgcacagtaggtgttcgatgaatgcttacaagccggcacacacattcgagtgagggtgttgctgccatcaagtgcctgggacccctcccaacaacattccaacaaccatccatgcacccctgctcccagcccatcaaaaacatccccagaacacaagccaacacatgcaacagtgagaagagagtccacatcgaatgaagaaccgagttcacagggatatgcccaccaaaggaagttgcatggcttgcctccagcagtcttagggatggcaacgggttgggtcgggcacgggcagagcgaaaccatgcccgacccgagatccacgtgccagtgcccgacccacgcccgcaaagcctatcgggcaaaaccccatacccgtgtccatgcccgacgggtactcatcggcggccatcgggcttgcttgccgtgcgccgccgtgtcgccaaccaccgccacgccggcagccgccgccgtgcacaatcgtgtcgccggcctccgctcgtgccgtcgtgtcgccaaccaccgcccctgccgtgcgccgacacgccaccggccgccgcttgtgcgccgccgcttcgctggcctccacccgcgctaatgcgccaatgtgtcgccagctgtcgagcgatggtggaggaggaggccggcggcgaca

SEQ ID NO: 73695 - DNA, 572 bp, Oryza sativa
tataaaaatctccgtctccatctcttttacctcagtctcgcgtataccctagtaccaacgatccccataccatgtaaataccagaatcgcgacatcaaatgtcgacagtggcgtaccaggtaggaggattttggtgcttcaggatttcaatgagatgggtttaagagatagattctccaacaataagctactcgacgactttggctatggggagatctaacctgaccggaatatgtctttcgacaagagcggaaccatagtcaccaattatttgatctctcgagatcaaccaagcttcgacgtgttgccatggtgtcggcatggtgtcggcatgatccaacattaaattctcgacgtgtgcgacatcaactggtgcaaggtatcggccggctgagtccaagtcgaacccgacaccgatccctaccaaccaaccaagcacgtcgaggagccaaaaatctaccgctggattagtactaccgtgttctaactaggacacgatttctagccacgatctactggtcgacagcctgacgtcaccctgcatgtccctttaccgagccaacacccatgtg

SEQ ID NO: 73696 - DNA, 739 bp, Oryza sativa
ctcaccaaccaggactaaagatctgggggtatatatattcccggtgcgcccttgtcttctccaccaacacttagacgtttttccatcgagatcaatctcggcttctccttcaccgccactacctagggcaaccccgcgccgacgccgccgtcgtctctcaccatcgcttggcagtccgcgccgcctccgccgtagacgccgccgcggcatctcttgggtgagagccaccgctgcctctctctctctcgatctcgatctctctctctctctctccaaaccgccgccggctagctcgttgccgagcgccactaccacgccgcggtcaatcgccaccgcagatgaccgacttcgccgcgccgccatgccaccggtccgccgacgccactgccgcgcgccccgacatcgccgaacgtgaacgaacgtgattgaaacatgaccaaacgcgaacgaacgtgaacgaacgcttaacgaacgtgaacgaacgcgaacgaacgtgaacgaacgtgaacgaaacgttaacgaacgcgaacgaacgtgaacggaacgcttacgaacgtgaatgcacttgtactaaaagtgtgagaacgaacgcgagcgaaacgtgtacgaacgagataattaaacgattattaaacttagcatacatatatgattatatatatatatgttaaaacgtgaaatacaatatatgtaacttggcccgtttagactaatacattttcctggtaatgttgcagag

SEQ ID NO: 73697 - DNA, 704 bp, Oryza sativa
attcctgcaccccctatataaggagggtccgtatgcctcttggggcacgattcttttttctcccaatcatacaatcaataacacactcggcggaatcatccccggacaggagtagggtattacttctttaataagaaggcttgaacctgtataaaattcattgtctccaaacccatccactttcctagcttgatagccacccccttttattattgccgaaatcttgtttcgatagttggctcgccaggtaggggaggcgtcaagttctcgccgactaagtacgatgggtttcgtttctggcatcgacgacttcgccttccctcccgggcaggcgttccgattcggcagcttcgacttcatcaccaacgacttcggcaagatctctctccttgactcggattcaaaccagtcggggagaaaccaggtccccgtgccgtttggtattccgaactcggccgaggcctactccaagatcatctctcctgagttggtttcaagccactcggatgagatccaatctgttcctccacgatccgatcaagacgatgggtcctatccctcaatcttgatgaaacttcctgacgacttggccgccgtcttcacagccaaaacatctcccactcggagatctaggcgagctctggcatcggccccgatccagtctagatccagggaggttggcgttatactccaacctcttggga

SEQ ID NO: 73698 - DNA, 879 bp, Oryza sativa
agcgtaatattaaaactctaataatcttatattaaaattgtaataatcatatatgctaagtctaacaattttatattaaatcgctactaatcttatattaaaattgtaataatcatatatatatatatatatatatatatatatatatatatatatatatatatatatatatatatgctaagtctaacaatcttatattaaatctctaataatataataatcttatattaaaactctaataatctaataatcttatattaaaactgtaataatcttatattaaatctctaacaaacacttctttacatcacttgcctgcgcgaattcctttgatggctagctaccacttcggcttgagggacgacgacgacgtcttctctgcaacattaccaggaaaatgtattagtctaaacgggccaagttacatatattgtatttcacgttttaacatatatatatataatcatatatgtatgctaagtttaataatcgtttaattatctcgttcgtacacgtttcgctcgcgttcgttctcacacttttagtacaagtgcattcacgttcgtaagcgttccgttcacgttcgttcgcgttcgttaacgtttcgttcacgttcgttcacgttcgttcgcgttcgttcacgttcgttaagcgttcgttcacgttcgttcgcgtttggtcatgtttcaatcacgttcgttcacgttcggcgatgtcggggcgcgcggcagtggcgtcggcggaccggtggcatggcggcgcggcggtggcgtctcgcggcggtgtcggggcgcggtccggcgccgtggtccggcccagcggcgtgggggcgcggcggcggcgtggcgtcgcggcagtggcgtcggtggagcggtggcg

SEQ ID NO: 73699 - DNA, 1133 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtgggccaaatacacggcc

SEQ ID NO: 73700 - DNA, 1566 bp, Oryza sativa
gaatgtgccagttcatgcattgatcagcatgcaccggatgttagcatgatacatcctatatgtatgtgtaatatcttgtttcatccagcatcttcttgtgccattgcacggcctgctgagccatggtccatgggcctaattgctccatcgatacatttgcgaagaagcttctggaataaactccatccggtggccggtgcacgcacgcatgcaagagcatttctagatcgctacacgcgcacgcgcaagatcgtttcgtcaagcctcttccgtgaaaccggtgtttccacgtggcaccattctccttgcgatcttttgcatcgaattcgtattataagatacaaaagtctatgaaacctccgttgtcttcctcggccgaacccgagtgattgattcctctataaaagtctatatagtgcccttcatctaaccttcgggaagagcccaccatcggcccccttgtccactaaagtctatgtaatgtccctctacaacccaaaccctctctaaaagactataacacctccccacccgaggagtttttcctcctcggtttataaatccttccaaacttcgaaaatccatatatctcaaaccgtacctctgattaactccgttcaactttcataatctctataaaatcgagatctatttactggcaccattagattgtattgaatattactttattttatttttacgattgtgtggggttattctttggccgtttattggacgttttggatattctggatatttatcaaacacgggtattctggttatttttagcgatgcagatttctcgaagatatcagcacctaaagcaaggcaagtcactacactcccttccttcaacatattgaacctatatttatatatgtgttgtgtgcaaataaaattgcatgctaattataaaactgcgtacctacacttgaatgaaaacccctccttgatcttgttgtcattatgtttacacaatcatccattgtgcctgagtctatttatttatacgtcgtcaattattgacatcgcttagcattgctattatagacaattgcacactccatagttcatcaaacgagtgcaattaaattattttatggtggttacgtaagcagttaagtatatttagcccagctgaacccaaaagcggtaagtaggttcagatgatgaagtggaaaaaggagctcacatgttgcaaggattagtcttctcgacgaggtcaactgggcaatgcacggttgataattagataagacgtggtgctgcgattgcagggttcacatcgtgttaatcgaaagctggatcgtgtgtatcaagtttccaccaaaccaagagttatcaatatgtatctaaagatcgggacctacttcatcatcacacgctccttgcagcgcacggcggcctgccctccctttggcagcatggcggcggcgacctcccctcgagaacatatggttgctgcgatgccccccaagctcaacgatgggatgaccagatccagccacaacgaccttggggcagtggcatccaccccctccgatgagcagtggcgtatacgttggc

SEQ ID NO: 73701 - DNA, 867 bp, Oryza sativa
tttgaataaaattttaagtaattattaacttttttatcatttgattcattgttaaatatacttttatatgtaaatatagttttacatattttacataaatttttgaataaaacgatagtcaaacatgcttaaaaagtcaacggcatcaaatatttaggttggagggagtaaaacgcaaactaaagttgaaaactaacctctatagaccttggtcaaacacttggcgtgcgagcacgaaccgcgagccgaccatcgacgcccgtcgaccacgcacggtgtgccgctacccggctgccgcaagatgcgcattccatccttcctcttcccttcccttattttcttcccttctctctgttcttgattttgctgtcatggcgcgatgccgccgtcgtgcgcaccgtcgtctcctccttgcgcggccggcgtctagccgacccgcgcactgctcttcctctggctccccctactccgtcgccccggccggcactgagccgagaacgcgcccgcgtcgcgcgtcgtctctgcctcggccgcgccgagccgtgcacccgcgtcggccctccattccactccaccgccgagtcctcctctcccccatccaccgttgccttcgttccttcctcgacccgacaccgcggcgcccggttaagccggctcgatgcgggcgccgacccgcggagctcgccgcccccttccatcccgcaccaatctctccacctcggcatcctcctccacaccgctgccatcctcctctccccaactgcggcagtctcctccgtcccccaccgcttctctcccggcgccgcgccaagccaccgccccgcgacacgcccggccgccgccgcccgtgccgatgcgcccggccac

SEQ ID NO: 73702 - DNA, 1298 bp, Oryza sativa
gttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcctgtcacttgaacatgttgatcctatattgcaaatgctctactgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggagtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgaggagtaggcttcgtccgtgccgtcgaggatgcctgtggagtggtgttcccgctgcagttcaagtcaag

SEQ ID NO: 73703 - DNA, 744 bp, Oryza sativa
ccaaatggcaataagtccaaagcataagagcaaataggagcaaatatccaatatgcaaaagaagcacccatggtgcactatctcaagccacattagagaagtctatgacatttaactcattactcaacttgcaaaagcgggttttatcaagaggcttggtaaaaatgtcggctagttgatccttggttcttatgtggctaatgactatgtcacacttggtaacatggtctcttaggaagtgatggcgaatgtcaatatgcttggttctagaatgttgaaccgggttattggctatttttataacactatcattatcacataggagtggggttttggtgaagaatatgccatagtccaacaaggtttgtttcatccaaagcaattgggcacaacaactacccgccgaaacatattccgccttggcggtagagagggctacggagttttgtttcttggatgaccatgacacaagggatctaccaagcatttggcaactaccggatgtgctctttctatccactttgcaaccggcataatccgaatcggaatagccaacaagcttaatttagcaccttttgggtatcacaagccaatagtagaggaatgctttaaatatcttagaatccttttcacggccactaagtgacactccttaggagcggcttgaaaccgtgcacacatgcaaacactaaacatgatatccggcctagatgcggtaaggtaaagcaagctgggctgcaggaa

SEQ ID NO: 73704 - DNA, 517 bp, Oryza sativa
  unsure (1)..(517): unsure at all n locations
catcatcacttatttccatctcatcaccctcaacattttccatattgtcatcatcactttgaacatactcatctccgcttgattcctcattctcactgacgggatcgggcgtgggctcacgacgaccatggcgagtgcggggaggcctanctgaaaaacaaggagcaaaggatggataagcaacaattttagaagccacatattgaagtgggagaaggaggagtgctgtctgtcaggggcggtcaaaccgaaagccaaggccggtcaaaccgcaagccccaagtcggtcagaccaacggctcacggccggtcagaccgacggtcctcggccggtcagaccgcaagctcttggccggtcagaccgccactgacagtagcacaaccgaatccttccacaatccacacaaatgattctaaaaaaattgctaggacaaagttgcccaagattggaacatgaatatcaaggtgtaggtctatttcataaagattgaaacaaagggggaaactacccttaacc

SEQ ID NO: 73705 - DNA, 1831 bp, Oryza sativa
ttttgcgaagagccctgactttgaaaactaaaaacttcgccgatcgatcaaaatagagtaacaacgatgcactttcatcccattaagatttggaacttaaccctcagttgctgataggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattgggggtgacttagctgtgctggtctgctaaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgctacatcaatatctggcacatccatcttccaatcttggctaaccagagcgaggtgctctgacttagctggtagcttgttgtcttgaactgatccactgactctgactgcaacacactactgctggagttatttccgctacatttgactaggtgtccaacctgcatctcccacatcgatacacccatcctctgatcttggacaccaaaagttgatcatgagcaggtttcatctggcattggggcaccttgcagctttcaactaacccttgatctgtggcttaaattgatcttatctctcacactgaccatctgctgccaggacgaaagagaggtggaagaaaggggtcgctaaagataaggtactaaaccacttgcctactgatatgttgttaatagatttttattgttcaagttgcttaagcaaacaacctagtatagtcgcatccccaccaatgatgcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcagctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggat

SEQ ID NO: 73706 - DNA, 715 bp, Oryza sativa
tacaccttttcaaaatacaaggcatattttgagtattaaatcaagggaaagatgggttgacttataaaagaaacggatggagttctttcttttggttgcttgcaatggctgaactcaacttattcgtgattgcaggcaacctgtgtattcggtcgcatttagccctggtggtgagtacttagcaagtggttcccttgatcaatgcctacacatatggtccgttaaagaagggaggatcttgaagacatacagagggagtggtggcatttttgaagtgtgctggaataaagaaggcagcaagattgcagcatgtttctcgaacaacacagtctgtctcatggatttcaggatgtagtttaaaccagtggatggatgaagtaatacaagcagatgcttggctatctgttcttccgtgatcagctggggagaacaggattattgccttaactctaggttttaggtacctttagtttgccagtgcttgtacagttatttccttgcggagaaactgaccataggatatagttatgtgtagagcgaaatctttccaacatcatgtcttcgcaatgctcatcgtatttagtactatattagtaacaattgtttattcgagattatctttgtcattaccataacaaatgcttaattgctatggtaccatttgactgagttgctatgatgtcatcgtcgtcagaatttccctgagggtatttgg

SEQ ID NO: 73707 - DNA, 677 bp, Oryza sativa
  unsure (1)..(677): unsure at all n locations
atgcacagtccgacttggaaatcaacttgattccacaccaaatccgctttgatctttcttctttttctccgaatctaatgcaaaatttcgttgttaatacatgcccccaattccgctgtattatataatacagtggaatttgctcttgttgaacccgcaaaaatttagggttttctgttttaacttttagctcataagtagaggcccattccttcaaaacacctttgtccggctatgtcctcgacaagctcttcattgtagaaatccctaatcctccggcaaccttctccggcgatccagctctccggtagcagattcctctgttcacaagcagcctgcgcagattcgcataaatggcgcacacggtaccaatccttgaggtatatttatcaatctttgttgacggtccttaaatcataatatttgaccgtcaatacctgcatataatgaaataaaacatggtatccaacttagtgatagggattattactaatcaattccactagtgttggtgaaatatgtgtatgcaggtattttaaggagaaaacacacctgtcatacgaggaaacacaccttttgcccatcaaacgcaagcacacggattggagggcccacaaattacgtggaacccgncatggaacaggtcataactaccataattgccataagtgcccacc

SEQ ID NO: 73708 - DNA, 661 bp, Oryza sativa
  unsure (1)..(661): unsure at all n locations
tccactttctctttattttatttgataaattcctacaacatgttattctccaagtacaagtggaaatatattatttggaaataaacatgcattgtaagcatagctacttctccaatattttagttatattgacggtcgaaatttgtcggcaacaaccgtcaacagtcggcagagtggggccagaggagggtgtcgacggtcgttatcgatcagtttcgccatcaatattactgaaataaaggagaactagttatgtttgcaatgcatcttcttgttaaaataatatatattccactagcactaggattactaacctcttgcagaaaataagcataagatggaggagaaccgacatcaaaatagacgatcaatcaatcgaacgatgtcgagaatcggacttatggaaagacgggccaagaactaagaattgacacgatcgaattgggccaaaattcacaagtctgaagatagaagaggtcaaggaggaagcctgccaggaacagctccgttggatccagggctttgagggaacggtggagattcactccctatgatggttggagggtattgttggtatttggtaacgacattactagaaatatcattcccagcaatggcgcaaaaatactcctggtatattatggntacagagttcatccgc

SEQ ID NO: 73709 - DNA, 806 bp, Oryza sativa
catgggtgtactcggaagacccagccgagtcctctagctccggcgacctcatggttcagagccatggccggcgatgatgtcatcgtgacatcataaatcttttttttagtttttctgtattagatgaaatctgattaaacttcagaaattcataactaaatcatcataactcggattcaagtggttcaaattgctaaattcatgtaaaatcgatatccacatgttaaaaatatccacatgtactgtttatgcttgttttttactgttttgttgattttatttatttgctttagtttcggacgttccggaggagagcgtttacgttgaggaaggttcagaagcgtttgaggaagctcaaggcaagtcacacagatcccaaataaccctttaagcaggttgaaccagtttaaagctaatgttttatttcaacttatgcattattttcgaatgtcatcgagttgtgagcctttcccatttaattatggccaacaatgactctattttcctatgagtaataaactaaatagcttgaaccttatatattggtttggtttagctaaatgctatatatataattgcttaaccatgcttagaaacattagcttattaatgggctgaatcaccttacattattacttatggttatatttaatggtagctcacgatgggtaatccggttatgatacttaattgataactagaggctggttaaaggtgggttgcgagcacatggatttgatggccttgctcatgacaattaaggaccggttcacgagctactgatgtgaaacattaaccgtgccaat

SEQ ID NO: 73710 - DNA, 1210 bp, Oryza sativa
acacagaagtcactcataaatcatgatatccgagataaacaaactgtgagtctgattagtcatcaacaacatcttccatatttagacatgttacaaaggcgattatgatcctactaagaatttgttgcaggtaggcttgtgtcttctttttgacaactattcgaatttcagaaagccatacataagtcagaacaactatattttcttgaatatatagtttttgcagtacaagtgtaatttaatgtaatttactccattttacatgtaggacagtgggaactaaaatgataaaatttgtactgctcttgctaaaaacataaaacaatatgcactttacttcatttgacaaatttcaaaggacataaaagctagagggtgagctatcaattatcaaccatcagatacccaatatgaatctaggtatagcttctagtatttaattataattaaaaatatagcttctaggtatttaattatttgcacaaattatttaccttgccaaaagcaactgttgattgggattatttgttcctggtcctgttgggctccatctaatagtgtatatttcctgcaaaatataattaagcatatgatagacagtagaacaggttctagggatcataaaaaatgagggtagatttctcaaaccttagtatgctccttaaaatcataaacacatttatcctgcttcatactccatatctgcaaaaaaaaagaaggcaacaaaagtgggaaaaggcttcacaatggacgatatagcaccagcacttcccaaggattgtaactgcaaacccatagcgttgtttaaaggagtaagttcattggccccctcaactatcggtttcatcaaattgtttttgacacattatcaactccacattactggtttttgttgttttatcaaaaaatcatctccaaggaagaagcatccatgatattatttccttgtccaacagattgccaaatgtctcagtgggaggaaagaaccccatgtcctactcaaattggatatctcaaaggcttttgattcagtttcttggtcttttcatgtggaggtcatgcagcagctgggttttcgtcattgttgttgtaaccttttgtgtttggtcctctctacttctactcgaatactggttaatggtgaagccagggaggtaatctttcatcgtcatatggtctccgacaaggtgaccccctctcccccatgtta

SEQ ID NO: 73711 - DNA, 2634 bp, Oryza sativa
atagggagtggcttctgatgcactggaacattaggtcaacctgggattgactttccaaccacatatcgagttcatcatagaatagtcatgactcatgtattgagaccacctactaggaagaataactgtgcaggctgaagtcctaatcctccaatctgcaccttcatacaactgcatggtggttcagaaccacatactgtccaaggatatcctactgtttgagaacctgctgaagcaaatagcaatgttgcaaagaggtgcaacatgggtgctgaaagcctgaaacaactgccagaaattttagccgtagctgattcttcttgtaggtgaacatgtcaaataatttgactggagggaatatctttttagaaccgttgggtttggcttactgattatttttctacaaaagaagagaatttcaaacaagaacatgttggttgattggttgtaaatacaggaaagcaaacattgttcacttgaaggcatttcttgaggatttatgtacctgactcgaatgattggtgccatgttcctcttaatgaactggcccgattgcaactgttcgttctatcccagcttgcagtgttgtatatgtattgaagcatgacctggtaatacaaatctagcgcaaagtttgattatgcttagtttttcttcgctttgggacagcaaggagtgaagtcattacttgggttagatctttgagcaaattctgcctgactaatgccagcattttaatttagcgtctaaaattttgtcttgattgcccctgcaggagcttattgttcactcgatcattttcttgagttaatcccttgctagataggctccatgtctctgtattttaaggctttctaaagcaatgctctaccttaaccttaagtaccgtattttgtaaaaatggattgtgtacacggggggagacaagggtggatcaattatagtcctaagcctaactatctaaattttcacattaaaactctattgatatatcatgaactatataaagatagtactaaaagcatagcctaactgcgaaccaaagaagcaacccttgctaccaacttgaacccaaccaagtgaaatggaaaaaaatgttcactttcgtctctcaactatacgtcgaattacattcttgttagagtatcctcggaaaatgcttgcggtttgacgtccgacgcagcaaagaaaatcggacgtgatctactcatggcctacatgcatgtctagctgttgtcttatctttactctctggggctactgcatggctgcacatctctcttcttgctttttttccttagtacttcactctaatatataagtatgcatgtctgtatataaaagctatgcatgtattagtaacttcaaactattttttatcctaaaatatttattaaatctacaatccgattacaatattatatccgttgaatttaatttttacaacaagatcttagttgattatattttgatcaaaaaataaataagaagaataaaacactgttaaatcctaattgaaacatttttattccatatatgaaacaacgagttacaagtgttgcaacaccgcacctatttattgaaacactcaaagaacaccgttgcaacatttacgttaaactagtgaaacattagaaaatacttattgaatcatctaaataatatcacgtgcaatatttataaagatctaccacatcataaaatttaaaatgtgcaattaatatatagtcaaactccaattgaaacatttatttctcgcacgtgaaacacccaagttttactgttgaaacatttgtattttttcattagaatataatgatgttatgtattgttatagagatttaattacaacaaatacaacagtgaactcggattgtaaatcagataaatggtttttgagaaaaaaaaacatttgaagcttgtcactatccctgtacctctttcatttggtactatgcatgcacggtaaacttttgtcgttgttgctcttctctgcatgcataggtaatagttttttaatcgaatggatgtggatccaacagtagaataggcgtccgacgaaacaatcacatcggatgtccgatccgtagtcgtctttgtatccctcaacatttaaaatcagcacaaattgagtcccttaacaatattgaggatggtttcggctaaagtggtgccttagtctttgtcccatgtggtgcctacgtggcactagaagaaaaaaaaagaagaaataataacaccaatgagacctgcatgatagcaaggacctagatagaaaaaataaaacaaatatgttaggtccacatactttggatggcgtgagggcaggtgtcggtgccttggtgggctagcagcggatactgtctttggtgtcctgatctggaaggcggcttggcagaggatctcatgcaggcaaccgtcagcatcctggtggcggatggcgtgccagcaatgatcggtgtcgtggagttggccatcgagcggcatcgacgtcgagcatgagtggcggtgtgccgactaccatagtgccacatgtgtggaggtggagtggtggataacaagatgggtggttgattaggtcttggggttaggacagggattagttggaaaatgctttgtgtcctgcgttcgaca

SEQ ID NO: 73712 - DNA, 660 bp, Oryza sativa
atatgaatgcaagaatgatacattgatggtttataatgagaagtgcctggaactaatgaaagagttttggctggttactttgaagcatgtatctcgagaacaaaatcttgaagctaatgatttggcccaaggggcatcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagctttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattataaggggtgtcaggattgtcagaagtttggagcaattcagcgagcaccggcgtcggctatgaatcctattattaaaccatggcaatttagagggtaagggattgacattattcgtatgataaacccccatcgagtaaagggcataaattatattgggtgccacttgatatttcacca

SEQ ID NO: 73713 - DNA, 659 bp, Oryza sativa
  unsure (1)..(659): unsure at all n locations
ggataaatatcggctagggttttaggtgtntgctagtcgtcgctagagttgaacatcatgacgactaggtttagtatcatttctagccgtgtcgatagacaacatatcggctagaagaatagaaggtgggtgcaggtttagtgggccgaaagtgttactccgacacccgtgagtggcggcggagcggcttggatcacacagagcccgagagctaactgtgcggcgtgcaatggaggtcgaggggatagtgaagctccgaccgctatacgcatcaaggcgtggggtgccaggagcagcacttcaaccttgggtttggtttatgccgagctttacaaccaacggtccgacgttgaggttcgtagaccgcgcaaacgtccccatggaaggcgtaaagttctaaccggcggctttttagtggctacagggtattttggaaataaaagaaaatatttggaaagcaaatataagtttaagttgtaaattcaattaaaagattaaatcaaattttattcaaatggcatttgaataaattaaagaaattcaaataaaatcttaaaatagcaaatttgatatcaaaatgaatagtttgaatttatatgaatttaggtccaaatttcactggaatcggatctacggtttaggagatataggcttctaaa

SEQ ID NO: 73714 - DNA, 30279 bp, Oryza sativa
ctcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatattgttattctggactgtattgttattctggacctacatgtggacatcgttatgctttgaaatgtgagattgatgattgttattgttgttataatgttatgaattattgtattgatttgaactccacaatatagagtaggtcatgccgaatttttctgttgtatagccacatcttaattaactaaaatactcacattttagtttttttctattatttttttcatttttcttatttcagttccaacatatcgcggttaccgtcctcttaccgcggttaccgtaccaaaccgtgcggttaccgtgtccataccgtggattttgaattcaaaaatttggaaacgaaatttgtgcggtttttcgcggtaaccgcacggttaccgcagtaaccaccataccgcggggggtcggtaagcccccccaaaacggtaaggtgaaccctggttggaacccattagggttgcgtcgagagggggttacacgaccctaaactctatatatcagtacccgccgccatctttaagtttttgggttttgcttaaattaatctgtcgagatcatttttgccgctagatcggtttgtaagaccccaactcgtgagcttaatcattcatctgcaattttggttattttctatctcgttcttgtttgtgttcttcgattggcaaatagggattagccttctcggcgaggtcatctgtgtttcggcacgggtgataaccagaggagacgtggtgctgcgattgcggggctcaagagcgtgcgcgttcaagaagcctgatcgatttatgtcgcgactccacccaaatcgttgtttatcagaacctttcggaagatcgggaaccctagtgcacatcagctaagtggaagaagaaatagaaagcactcaattcctatacttctagtatacattcaaatcctaatttacatctgctaatttacaatcatgtggccaatatcccctcacagtgtcctcctggtactacaagggaccaccccgggttgccaagtttcttacgacaacctatcatggccgtccaaccggggctaaatacggaggagtaccctccccaggaatttgtcttcggaatatatactaatatggaggaatactcgtactgagctgtcaccatcagcagcccacctctactgtcctgaagtatatatgtccaattaatgatactaaataatctaagcaccatgctcacattattaaatactactctatacccgcgcgcccgacatagagtaactgataaatcagacattaaacccgcaccattacacttctctggggtaggctacacacacaattaacataatgcagatataaagtaaggccagtactcaaactaagtaaagtagcgaagatatataaagaagagtatttcattaaatcgtaaagtattacggaagagattacaaaagctgctagggccataccgaaaactcttccgaagactccgaggacttccgaacactattctatgctactccacttagcactatactactaatactaatttatgaagaggaattgagcttgcttgagtgtgttaagaagtgaagtgagctcctccttttatagggccggtatgacggttactctcatgcgaaatgtacattttacccttgtaactgccatcagcaacgcatcttggacgtccacgtgtaagggggaacggagccggcttgcccctggttcggcctggctccaaccgacctcccctttggtacaatggctgacacatgggtcccattgttggttttgacagttaaggctattacggacggttacacctgacatgtgggcccccttatccaattgcttgcttaggagtaaggttttctccactttctctttattttatttgataaattcctacaacatgttattctccaagtacaagtggaaatatattatttggaaataaacatgcattgtaagcatagctacttctccaatattttagttatattgacggtcgaaatttgtcggcaacaaccgtcaacagtcggcagagtggggccagaggagggtgtcgacggtcgttatcgatcagtttcgccatcaatattactgaaataaaggagaactagttatgtttgcaatgcatcttcttgttaaaataatatatattccactagcactaggattactaacctcttgcagaaaataagcataagatggaggagaaccgacatcaaaatagacgatcaatcaatcgaacgatgtcgagaatcggacttatggaaagacgggccaagaactaagaattgacacgatcgaattgggccaaaattcacaagtctgaagatagaagaggtcaaggaggaagcctgccaggaacagctccgttggatccagggctttgagggaacggtggagattcactccctatgatggttggagggtattgttggtatttgttaacgacattactagaaatatcattcccagcaatggcgcagaaatactcctggtatattatggttacagagttcatccgcaaagcgcacggatataccattgtagcatttcacccgagagtattccaagggtatcgtatttatttaatcccgtgggaagatcatagtagagagaacctgactaataatttgtatgtttgtaacatacccgaaatttcaggacttaaaatttcttgtcaaaatagttagaggttaacttctccaattttgagagccaaaaatttccgttttaatttaggtgatgaccaacttaaaccattgcatgattgaaatttgagaacaaaataaaatcttttcattcccaatattagactagaaatatcatcaagcatttgagcatgcatgtgcataatgcatgcctaggcttgagtccattgtgtatttggtttttggtatcgcttttcataataggtctcatgagcataaactaaaagggttaaaattactaaacaaaactacagttaatatagggtgataacatgtggacttaatattaaattctaatatctttttcacagcccaaaagaagtttaatgtaatccttataataatattaggtgcagttatgaagtaggaacacatatacaaagaaaggttattcttattctttaaaataatttatgcaagatgaaatcatggaaaaatttatgtaaactatgtttagcataagcaattcattataatattggtgcaacttaataactaagtttaataccacaaattaatcagtcaaagcagaaaaactaaaagaaatcaaattaaattttaatcggctaaatccatacttcatccaaaagtacatttaactgcacataagtgaacatggaaaataatttattcaaatactagattatttatcatgcctaaatattatttttctagaattttcctcctctgtttaggcttcctaaaaattcaatctacctttctaatagcccatctttgtttaatttctgtgagcaatctatccattatttttaagtgcaaccaaagaaaatgaaatctaggtgtaatcatttacctccagtaaaatcaacactaattaatttggtccacacattaagttatgaatctacaaagttaggggagagaaaataatctaaaaattgaactaaaaccgtgttcacccagaatcttacccacacctctctcttccacctagagcacttcatcctgagcccacttggcagcctctccagctcgccctttctctgtgcctcaccctcagccgaccaagaacacagagagggagagatcgagcgagccgacgcgtggccacaacgtgtcgacgacctcgggctttccttttctcgctctcttctcctccagtctgagtcgccattcctcactcatcactcagagacgaagaagccgaggggagcaggtcctctgcctctccgtcaccaggtgacctcaccaccggccatggaggtgaagaccatcgccatctccgtttgagtcaaggtcacctctatctctttcgcgttcctatctctccacacaatgccgaaccacttctctgttgaccacctcccgttttgtgcatcacagccaccggaacgtgaccacgccaacaacgccctgaagcacgcactggagcgccaccgcttcgacatcattgtcgaccggccattctcgtccatctcgaagcaagccgctgtgccaagaatctcgcctcgactacctcttcaagacgcctcgagaaccccagccggagacgtgaaggacttggagaacgcatcttttcttcccggcgtcgatctaggatcgcctccgccatcatcgtcgattaccgctgcctcggtgagccattgttcgattcctcgcgcatacaccatctccataacctcacgaacctcttggacacgcatgcatggcaggtccttgagttgttcgagccgtcgccgttcacctgaggaggagcgccgccgtcgaacctttccaaccgaaaccgctgctatccaagcttcggtgatttcttcctacagcttggtgagcctcctggacctcttaggaaacacatgcatggatgcatctagcaaaatcaaagcccgtaggcaacatgcagtaacagctcatgtataccttccgctcaccctccaatgtctcctagccaagaaaactagaggaatggaatcgtgagagcattctcttcattttatattttgacctcattcccaatcgagccaccaatcgtcgccgacgaggtcgccaaagccatggccaagctcctagtccatcgggctgctggaggttgaagatgaggactttgtcctgtaaatgataaaaaacatagggttcaaactataaaacttcagtcgtttacatgtggacccacggacctaaatgcagttcatataaagcccagggacctttttgtatattggttcagccaccgattagtggacccatgtgtataaaaatctgaaaatgcaaaggaaaaataactaaaacattaaatgtttaacaggaaaacacccaaacttctaaaatccatataaaattaaatgtaactcattttgagatgattccagttgctgtagattcttaaagttatgaactctattttagaaatataaaacttgacactcactgtacaaataatgtctctaaaatttatctaagataggtcatacataaaacatgtacaaacttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagtttagataagctaaactttagaaattcatgtagaacccaatttagcttcaatttgagtaaacttaagttctgtaggatcatcaaaacatgtatttccatgttatgaaataagattatatacttattgtgtagtaaaagtctctaaatattcatataaggatttactaacatagagcaccctttaatttgtaaaacttgtagaaaattcatttttagtccaaatgaaatgaacaaagtttctatagaaccagcaaatagttagcttcaacatagtaaaataaaatttggcacctattgtagagaacatagatcaaaaccttaacttagtgaaataagaatttaaacatatagtgttgtttaagtaatacataaacatgtataagtatatatacactttaggtctaattaaacctaaataaaaacttgattgaccagtgaagccatatatagttccatttccatccactaaaacttagaagaacttagctcatataacaatttctaggttaatataatatattgctagtttagattagagcatctctagtttataaaatatgaaccatagtaataaagaccataaacatgtgaactaaaaatgttttagttaaccaaattattccttttattcaacttaaataggaagtagcatgttctgaacctacaacttgagagtcatgcagatataaaacactatatgcctaaaacacgttgcaacttgtaaaatctataagaaaatcattataactccaaaaattgtgaaaccaaatgtgttagtcttagaaaacacatctccacacccctgtgaagtctaatataataaaaatcactttacaaaagtattttataacactacctaagactatactactataaaccgataaaacttctaaaattcataactccctaatggaataagataaaataaaatttctttcacctaaattcattttagaccagtacctaatcactgtgcattaatcatgcattttagaacattttggattttcagctcttttggtgtttaattgcataacgtgcgtgtcctttatctagataattgcataatcggtgaaggagtggattaggtgctaacatttctctgatcaaggcaagttttctcctcccatactttgaacacattgaatcccatgatttgaggaatgaaaatatttgtttgcaaagttgcatgtgaacttagactatatcggtatttgaaattgggttaaggtagttatgacctatttgctgcatatcccaccttgaataatggatcctcttgctgtttgaacccctagaaatggttagagtacactctttatgctcaaatgggtttatatatgctctttgtgcaactacttgcttagccatgcttagaactatgcaaatgctcattccatctataattaaaatgtgattttgattcatgaacctttgcttgaataaaatgaatatgatgggtatttgtgaactaaaatgtgtaaaatgtgattttatacttgggcggcaagtggtgtgcatatggtgttagttgcataccgatagggggagtgtttgcccaagtccataaggaccgaacttgtgtcacccatttaaagttactaggtgaaaccccgcgcattgctgcgggaatttagtatgataacaataaaaaattaacatgtaagatagctagataatatcagattaagtaaattaatgtggtttatgataatttaaatttaaatagtatgtagaatggtgattcaaacgtaaaaagtaaggtggtatgactttatggaagaagaaaagtagggagataatttggaccgtagattaatcatctaaaggctaaaaacaattgatgtgatatgacttaattagaggaaaaaaaggagaaagataatttggaccatagattaatcatttaagcactaactaagtgaggatgaactatataagtatataggatatcataaaacataataaagatatacattgaaacattatgtgaattatgttggataataatttaatatgtttgtatttgaaaagctcttaaattataaaaactataaagatataagcatgtttgcatgatgtttaaatgtgatgattgttaatggaagatgatgtggcatctttgcatgttaagcttaaggagttagtgggggataactttatagtaagatatgattcgtacatccacatgtgctagtatgggatggcctaagctgattaatatatttaggactagccttgcattctggtaggccggtgtgtatgaattagtcgataattctgaggaattagtcgatgattcagaggagcttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagctgtgctcgcggttctaagtagtgttctaggcatattccaagtatgcctaggatggaggaacacgtatcgtgctggtggcaaggctaggttctaagtagtgtaaaggctccgttatgacctctagatcacattcaacatgaagagtgtggtggagtccttgcaaactcaaaacaaactagagagttcatatcatgtgggtaaagctgtacaaactctgcagagttttttaaactaatcgattagtcgtgctcacggtcatgagcgctttggtgatgtgtcatgagtatagactttatgttttaaaatgtgatcatgtgacattggtttgaaattgataaatgtgttgagttgtgtgtgtgaggtgatatattatgatttgttgtcaaaggatgacaacaagagattgattatgatggaattatgatgaacttaatattgaaacttaaaatttgttttgttaattgaagcatcaactcctttacaaaagaattacgaaacaaaatttgctttatactgaaattgaactacatattgccttcctttgaatatatgccttacatgtagtatggtaggattgacttgtgcttgccagtacattaacttgtttaatgtactgactcttgctgttgatataaccttttgtttgcaggtttagacttattctttgagtgatgcgggttccgattgcttcttctaggatgagaacttaatggggtaaacccctagtcggtgtgcttgtgattgggtagtcaagcttccgctgttctctaatatgtctatttggccagtcgacctatgtaattattaagttgttgaaagtcttaagtttctttcatcgtagttgtgtttgctatgtataatcatgcttaagatgaaagtgtggatctagtgcacatcctggaaactagattcacatgagtatgagttaggaatagttgagaggttttagatctttagccatttttgtcaagtcttctgaatgtgtaacacatctggtcgccgccttcgagtggtttgacgggcacatctcaggctgaagttgactggcaggctaagggcccagcaatgtctccaatattcctctctcgaggcatcagatgtttcattatacttgtttgatgacttaaattattcacttgatctctcaaatataatggaaggaccgaagagcctacgacaatgttacttgtaataatcatagtctaagcacgggttaagataatccaagggtagagtgacacacaagcagggagctactcattctcatataaattatctaagctaagtggaaagaaaagagaaagagaatctattcctatacttctaatatacaaagtatacatacatcctaattatctgatatactagtttataccctctatccgatgccctcctggtacttcaagaagccacccctgactgccgagttccttacggcagcccgtcatgaccatacaaccggggctaaatacgaaggagtacccgtactgagttgtcaccatcagcggcccacctctcatccgcagcatataaccccaaataatgatatcccgtaatctagacaccacgcctaaactaccagatactactctaatatcatcgtcatgacatagagtaattgtataagcaaacactatacccataccgatgcatctcctagataagctagcaatataatcagtataacatgaacataatgtaaaggttgcattcatatactcggaaagtattttaataccataaatgtataaagaagagtattctaataaaagtacaatgcttataaaagagaagagaagagctactagagccatacccgaactcttccgatggcttccggaccccaatttatactctattcctattccactagcttaagaacactaaactaaacttgagagaatatgagagagctttgcttgaggcatgtctagagagtgaggaggtgaattccttttatagcctcccaatgacggttatgacagttgaaatggtcggaaatgccctctaaccatcatttgggagcaatcctggacgtccacgccaaaccctacatccaacggagcagatgggggttcggccaaaccccctggttcgaccgaaccatgtgctggtccaatccagcccattttcggctggtggcctcctggacttctcctctttgcagacatgtgaattttggcccaattcatcgtgtcaattctaagttcatggccattcatacataagtctgattctcgacatcgtccgattgatttatcgtctgatttaatgtcgattctccttcactttatgattattctctgcaaaatgttagtgaaccaaatactagtggaatattattattctaatatgaatatgcattgcaagtataactagttctcctctatttttgtaatattgacggtctaaaataatcgctaacgaccgtcaacaggtatccctatgacagttggagggtattaccgacctttccaaccgtcataaccatcattctcaagctataaaaggccctcactccctccattttaagacacacctcaagcaagaagattcatacatttctcaagtttagtatagtctctagagtatagtggaatagaaatagaatataatcttcagtccttggagtcttcgaaagagttcgggtgtggctcttatagctttttcttcttttgtcagacttgtactatttatagaatattcttctcaatatatttacggtactttacttcactctgatcatttgagtaccgactttatgaaatattattcgagttataatttcatagttagcttactcgagagatgcaatggtgtgggtataatgttcatttgtatgaatgctctaagtcaggacggtgattgtagagtagtatttggtagcataagtgaggtgcttaacctattgaatatcattatttggggttatatgctgtggatacgtcgagttgggccgctgatggtgacatctcagtatgggtattcctccgcgcatgtattaatcctaagtacaatttcctaggaagggtactcctccgtatttagccccggttggatggccaagacgggttgtcgtaagaaactctaggggtggtctctcaaaacaccaggagggcatcataagggggattttggctatgttattatatagtagataatattaactaaggttgtatgtatgtactccctccgtccgctatataagggattttgacattttgcttacactgtttaaccactcgtcttattccaaaaatttgtgcaaatataaaaaacaaaaagttgtgcttaaagtactttggataataaagtaagtcacaaataaaataaataataattccaaatttttttgaataagacgaatggtcaaacagtgcaagcaaaatatcaaaatcccttatattaggggacggagggagtatattagaagtataggaaatgattctttctttattctttccacttagtatagaattagtatgtatgagaatattgaatgcttctgcttagtgtcactctacccttttaaatttcattaacccttgtttagactttgattattacaagtaacatataaattattagtatggttttctctattataatcttcccatgggattaaacaaatataatgcccttggaatactctcgggtgaaatgctataatggtatatccgtgcgcttgcggatgaactctgtaaccataatataccaagagtatttctgcgccattgttggggattatatttctagcaatgtctttaagaaataccaccatgcatttctgacgccgttgccgaggaagattcataaaagagattaccaagactaatactttatatttacctctgtataatcaatgtcctttgcaggctaaccttggttgttttccgcttttactgtggaaatagggtagtgtatgactggtttcaaattgccgaaaaatttcatagaaaatccagaagttttctttcggagcatcaagccgcgagtcgttgcgccgtagaaaactcatccgacaaagaaaccagccattctagtgccaccaaccttcaagactacggctaacaagaccatccgcaagttcgctgctccctcagctgacaacgtggccactgggccgcaaatcaacatgggagacgtggactttgatttgaagtccagcctcatcatgatggcgtaggctagcctgttccgtggcaagccaaacgaggatgccaatgcacatctgcagcagttcctggaaatctgcagcacgtacacaatgaagggcgtcagtcctgaccccgtcaggctccgactattcccattttctctctagggaaagctaagcagtggttctatgccaaccatgatatgatcaacacctaggacaaatgctcaatggcaatcctatcaaagttcttcccaatgggcaaaaccaacgccctacgcgggagaatttcaagtttacagcagacgagagatgagtctattcccgaggcgtgggaatcactacaggagtacatggccgcctgttctcatcatgggatggacaactggctgatcctgtagaacttctataatggactcactcccacatcccgtgaccacctggacgcggcagctgcaggagctttcttttctaagacggttaaaggagccgtcgatcttatagaaaagatggtctccaatttgggctggagcgaggaacgactccggacctgttagcgaggaatgcacaccgtcaaggagatgaaaatgctcgctgcaaagctagacctctgttaacaaccaaatttggtaattcaagtatcggagatgaagataaaaccgaagcgaaatccaagatggagatcgttctggaaacagagcaagaatcggctaaagtccgaatcggctacgattagaatcggcagagttcaaatcggacaaggttagccgattaagccggttccgacaatatgactcgatacatgacatcgggttaggttaaagtgcttcacatggattgccatgcacagattgagtcctgaaaaggcaattgtatctattaattaggatattttatgtaatttccttagagatatgttcgggcaaaagtctgcagtaaagacttatggtatcttagagtttgttagaaataagagtcgtgtccgatatggacatattatgtaatctcgggtataaatagaccccgagtcccatgtaatcgataacacatgttcaataacaatctcggcgcatcgccacccttttactttcgttttgtttcgacgagttcttgctttcgggttgagctgcatcggtttcgatcttcaactagaggaaaaacttgttatggcggcctgcgttctcgggattagtgcttccatctttatgatactctaatattggctatgtaagttgtcgagttatcatatattctatataatacctgacaatattgttatctaaccttcaatcggctaacatctatcattgaaaggtagccgattaggttaagtaacaacgttggcctagattatataggatatctaccactctatgaaacatccaacggtttgattgtccagatattgttcttcttttcatacttatagctgcatccgttgagtttgaccttataagtcgtgattagaaccatgatctctagcctgcttttggttgccgattagggtagtgtcggggtttcagccgatcttacctgatttagctttatatttcatgtgcttaattgatatgctagatctgccctttatgttaagatcttactacaacaaagtatgttaggcttctgtttgatatattttacttgctttaatatcttaaaacagagtggtatcggagtattagccgatacatgctagatctatctgatcggctatgctataaacgtttataatcctattgttaatatatatttcgatgtaagtgatttatactgtctcggcatggcgaccgatctatcccaatcacttgatttaagtatatatcgacatatggattacatactgttaatatctacagccgatcgaatagatttagttctttcttacttatttatatccgtcgatcgattcaaatatgacatcggctcaaagataaatgatatgtcatcggcgattggctgatcggctatcatttatggatttaactgctattttcctgtctttatttcttgttgattgcaggatctaatcaactggcacgctcacgaacctaaaggcaagatttttggacctacactggagttaagcagatctcccaggcctcgtgtttttcgcatcaacaacctcctcatgaaacgattggccttggactttagagtaccaagctccacatatcaactttagagtaggaatcaaaaaggaaaatttggtgaggaattcatattcatacactttgagagatcaagtgaatcatttaacataagcgatgtgcttaggctattgaatatcattatttggggttatatgctgcggatacgtagaggtgggccgctgatggtgacagctcagtacgggtattccttcgcgcgtgtatataatcctaattacaatttcctggggagggtactcctccatatttagccccggttggatggtcatggcgggttgtcgtaaggaactcggcaaccaggggtggtctctcgaaacaccaggagggcatcgtaagggggttttggctatgtgattatatagtagataatattgactaaggttgtatgtatgtatattagaagtataggaaatgattctttctttattctttccacttaggctagaattagtatgtatgagaatattgaatgcttctgcttagtgtcactctacccactttgaattgcattaaccccttcttagactttgattattacaagtaacatataaattattagtatggttctctctactacaatcttcccacgggattaaacaaatacgatacccttggaatactctcaggtgaaatgctacaatggtatatccgtacgcttgcggatgaaatctgtaaccataatataccaagagtatttctatgccatagctggggattatatttctagcaatgtcgttaagaaatacaaacagaggggagccgattcagacttggtttgggggagggacagcgggcggcaggagggggagtggagcggtggccgagtgggagggggagagcgggaggaaaaatagggatagggagaataggattaggactttcccaaattggaaaataaatgtggtgccattttaggcaaagaacgaaaacggaacctgcgaacgaaaacggacacggctcatcatgcaaaacgaaaccgcggacagagagaggagtgaatcgggaacgattcacggccaaaggcgggagagaaaaattattattaactcaaatattaacaatttaaattaacaagattaaatccgatgctctgaatattccactttatgtcctgttaatgattttagagcaaagagaattcaaaaaatattctcattgacatttccggttattaaatacattgttaatttgggttttctcctggttaacgaaagcaatttctatagatgatttattggtgaactagaaactacggaaaatgggaaacttcgagtggtgacacaacatcaacctcttcgcccataacttcattatccaagaaggcatcaacctctggatcaatatcagctagctcatcatcttgtgaggttttcttcttcttggctgatggtttttgatttgttttcttgcgcttgccagtatttctcttcttgggatctctatgatcggctcagtacttgaactatctagcaaagatgttacctttggggcattgaggccaattagaggaggaagcagtttggtccctgaaagtgatagtgcggggatatatacaatcggatgattgctcacacttactatgggggcaggctattctggagctgcagtgagacatatatggtgatgaggacatcactccttcagatatacacaacaatccttcgccggtgattcaagaaccaaccacaagagctcgcgcgtgacaattgaatttagatgtgagttcgttcctatgttcttctttatatgattttgagaatagattgctacctaatgattatattatgattaggaacaatggagaggacaaggagacacttaaagagggacttagaggcgtggaggaccagcaaaggcgtccaagtcaagatggaggcccaaaccaagtcgacttcgagtacgtttcggagtccaggactagtttgctctaaaacggacgcgcaggtcatatacgtgtttggattggggcattctttatatggatggaaagctaagaatataaaatttccaatggttctggtcccatgtccaaattctttccgagtcatcgggaatcgaccgaacaaattgacgtccagaatctgtttcggtgctgcgtcgccgtattttgccctttgggccgtgcatcgtgttggagcccattagggttgcgtcaaggggtgttgcacgaccctaagactctatatattagtagccgccacaatctttaaggtttgggttttgcttaaattaatctgtcaataacagttttgccgatccttcggtttgtgagaccccaacttgtgagcttaatcattcatatgcaatttggttgtattctttcttgttcttgtttgtgttcttcgactcgcaagcagtgattagccttctcgacgaggtcaaccgggtttcgacacagttgataacaggaggagacatggtgctgcgatcgcagggctcaagagcgtgtttgttcataagtcggatcgacttgtgtcgcgactccaccaaatcgaccgtttatcataacaaaagatagggaactcttatccacatcatatggtcgggttgataaggatgaaagaagatagaactaaagagaagatggtatcaacttacattaatcctgatcttttcgtccacaatggtaaggcagaagtttgatgacatggaaaaaaaggtgtttcttccattctacccaccattgatcaaatgacggatgcctaaaaaggtgaaggtggatttcattgcaagtaccaagaacaggtccttcaagtgttaaccatttttgcatgatcagagctgatggtactgtatctctagcttgaaccatcctgatgaagtacaaactgatgggaagttgtccaagtccaaattcgaaagatgatataggatgatagaattcgaaagatggcttggcagtttttccttgagaaatatcagttgggagtatgcaaggagttatggctgctataacgttttctctggatcttgggtcaattggatctttcaagtcatttaatctcaaatcggcaaccaaaccctggcagctaaggcaaatccaccataaaatcgataaaatcaatccttgaagccatcaactgactgattctctctggaatatactatagctgcttctccaaaggacatgcttcttctagtgcttatatgttcattatcggcataatcagttggcaaagccgatagagctagtgatggactgtcaagtgccaagatggtatgcatattgatccaaagttgcaagaaccaccaaggacctccataattgatcacttcatctttcacaatgttacaagcggcagagtgaagcatctgataaactgagcaagcagatactttcccaaaggaatgtgcttcttctggaccaggaactgagcgaaatgttgatagttgactgttggcccacaagttgaaccgcagaatacatctctctccaaccacttggccaagaatgcaacatgttccctttcagaaacagatcctgtgcctttatgttttgctatgtatcctttccaacctccatggatctgttttgtcttaagagtatgatcacacttgatgtctagctgaaagggatagatggaagtcgtgatgtccaggcatattagcatcttcacatctggcagagttggggtgataggaccttgccgaaacaagtagttgagggtattcgaccagaaatatgcagcaaccgatagcattggctcattcttcttgatatcggctaaagactaggacaagcactgagctattcccatttcctcccaatgattctgtttggcagccgatactctcttacaccaggttttgtatcctttaagaggagatggccatgacctgaatgttgacttccacttgaccaaatctggattggtctgcctgtatgggatcctatttgtttcggcattgataaactctattgggtcagggttacccatcggtccaaggaaaaagtttgtgggatcttgagaagaggggatatgaatctagcctttaagatgctggtgagaagattgataaaacaaggtcaaaatgctgaaaggattaaaaacgcaagagattaaaacgcagggacatggggaaagttgatcaggaagattgttggtatttcttacgaccacagataaatccgctagcgcacggaataccgctgtagcacttcaccttcgggtgaccccacaaggatatcgaactcagggaacgtgtgtaatctatctaaggctaagacaatccaaggacaacaactatgggtaggctggctcggctagagaggaatttctatgtgttttaattatctatgctaagcaaaggtaatttcttatctgttgcttcgggcaccgacccctactggtctgctagcgcggttccggctatagctctatgatgtatccgaacgttgaggattactaggatgggattcagggctgtcgccacctgccacctacctctgacaaatccgtgagatacacaacaaacaaaggtaatctctaacctagacatcacgtgtaagttattaattagtactttaatacatgcgcacgaacttactcctctatccagagtcctagtactagagcacttagtatgaatactaaacaatgaacccgcaaagaaggaaatctatcttacttacactaagtaattaaaaaacaaagaaaggatcccgaatgcttacttaatagaagaactttctccgaatccggagcagagtataccgatagctccggtactcctccagaactcctcctaaaaagctaaactcgtcgaggtagaagtcggatgagcgccaatcttccgggcactcctccagagcttcccctcactctccacctatttctaatgtacaaaagatacaatagagcatcttgtaattcagctcaaagttgtgtgtgagtgaagtgagggagaggagctctatttatagcctccatatgacggttacagctatgagaaacgaccaaaacgccctcaaccgtcattgggaatgcatcagtagcgtacacgtggaaggctaggatcaaaggagccggtggcggttcggccgaaccccctagttcggccgaaccctgggccccacctcctggcctctcctttggccaggagactgactggtgggcacttatggcaattatggtagttatgacctgttccatggcggttccacctaatttgtgggccctccaatccgtgtgcttgcgtttgattggccaaaggtgtgtttcctcgtatgacaggtgtgttttctccttaaaatacctgcatacacatatttcaccaacactagtggaattgattagtaataatccctatcactaagttggataccatgttttatttcattatatgcaggtattgacggtcaaatattatgatttaaggaccgtcaacaaagattgataaatatacctcaaggattggtaccgtgtgcgccatttatgcgaatctgcgcaggctgcttgtgaacagaggaatctgctaccggagagctggatcgccggagaaggttgccggaggattagggatttctacaatgaagagcttgtcgaggacatagccggacaaaggtgttttgaaggaatgggcctctacttatgagctaaaagttaaaacagaaaaccctaaatttttgcgggttcaacaagagcaaattccactgtattatataatacatgcctgctgggggaatgtatagtatcccccgaaattttgcattagattcggagaaaaagaagaaagatcaaagcggatttggtgtggaatcaagttgatttccaagtcggactgtgcatcgactgagtatcgtatcggctgaaaaccggacagaggcttgacttgatcaatatggcaagcagccgatatagtataacttgggctcgatatgggcctaaattaagataaccgtcactgtcaattagagatagagctcgaataaggcaattgtatctattaattaggatatttaagtcgattttgctagatttggcaagatacccccatatatggtcttgtttgtatgttatctttaggaaagtttgaattgtgaccataatggactaagtttgtactcggggtataaataagaaccctataccactgtaatacgggagacaatccaatacaactttggtgcatcacaacccttttttttcttcttttcggcaagttctctcgataagaggtaacccgtctcgatggtgtgtgccagggttgacgttaccactggtaaccgtgcggttaccaggcttaccgcgggggtacggtaatataaataccatggtaacctccttaaattcaaataaatttaaaaaataatttgaatttttgataaattttgcatggttttgtacggtttttcacggttactgcggtaaccgtgcttaccgccggggcgcggtaaccccggcctcggcggtttgggaaacactggtgtgtgctatctgggctatcatgtcgttttatatgttttagtccttttatcatgaccatctgttatcatatatgtcttagttaatctagccctagtatctcaatttagccctatcggctggttctcgttttagggttcctgctggtatcggctaaattgccttactagattagattaactaaggcatctaccatcttgaaaagctgttaattccttgattgcttagactttaggtttctctacttactttgagatgcatcatccctagtcttgtttagaaccctgaaaactaacctggaattaatcataattagagaaagtatcggagttttagccgatcttacctaatatacatgcttcttttctggttttatgtatatttgccacttatatagacagatcatcctatataatcgtatcaagtttgatcagtatcgtctcggctatttgaatttctaactgatcatgatttgatatgctcatatagattgatttgtttatataagtttgtactagagtattagctactactttatcgttatctacatattcagctctaaatatttttccattggctattttcataatattgtcttaaatcttctttcttaaacctaataggcagtgttacagccgatgaggcatgtttagggtcttttattccctgatctatcccgtccatagccgatttggtctaactacatcggctgagaccaccaatgatacgctatcggccatcgactgactaattatgcttttgtctttcttgttgattgcatgatcaaatcagctggcacgcctttgacacactcgaggctatccttggacctgcactggagttaagtagatctcccagtgtaacgccccgattttcgttcgggattaaaaatcatttaatatattcatagcatagccgatcagatagatctagcatgtatcggttaatactccgatactactttatataaagatgttaaagcaagtagaatataccaaacagaagcccaatatacttaaatgcaacaaaatcttaatgtaaagggcagatttaacatatcgatcaatgtgggacacccaatttaggcttggtgccccgaaaatccactcgtgatcgtctaggatttcgatcacgtacaaattgatatacagaacagctttcgattaattatacaaatttggttatacaagctaattatacaattgttaaaaggtgaaaagatccaaactaatatatccttatttgaaatacaagaaaatccatagtactaaactactaaactcctaagctcttcaactactaaaactacagccaataaactgcaaagaattcaaagaactccataggcaaaagctcgagtgtagactagtctagacaaacttgtcgatgccgtagatctcgcttccttctaatctccttgttagcatgttttctctatatgtcaaattatgcaagggtgagtacttatgtactcagcaagacatattataaataattaaatgtgaagagatatgaataaataaaacaataataaagtaaaggaataataaaaaccataaatcatctttatcctcaacattttaattttaaaaatacttatacttcaggagtaggaatcaccctgatgacacaactccagaaccgggagtacggcacattcgaatgatttaattcacctctgcagagactgtccagttttaaccgcacgatgcccacagctagctaggctgagaacaacagagccgtttgaaggtcccacttactactagtaagtctaggtctgtccccattctagaagctgcggtcgtactcgttcgtttgacataagtacttggtaaacttatatcgaccaagacagtactagccacccggaaatcaaccaattcctgcgtactgtcccaatctaagttcattgtatttttatgcagtctaactaggcagggctaagcaaaagctagcatataactggtttgctatatgttcagattatgcattcaaaatcatgaatggctaatgcatagaatagaatgtagaatataggataattatgctcaaaggggaggaataataacttgccttgctccaacgcaaataaatacgagataggcaacctgattatccgattctcgaaataccataggttgccatccaaaagacaataaactctactgagaaagaggaagaaccaaatttaataaaagccataaaataataagaaaacgataaacggctaaaagggctagggtttaaggtataacctatctcttttatagggtatagggattatggggctagtatttgctagcggtaggtttaggtagtataatagctagggttcagttatatgggagttgattgtggagtaggatagtatattggttaggctctatattttatgtggaggctctcgtggtttggacgataggaaatatactagatagttgatatggttaaataggcatgtggctaatatgggtccaggttggctttgatagaatagtggttaggatttagttgtttaggccgatatcgaggtaggataaatatcggctagggttttaggtgtttgctagtcgtcgctagagttggacatcatgacgactaggtttagtatcatttctagccgtgtcgatagacaacatatcggctagaagaataggaggtgggtgcaggtttagtggggcggaagtgttactccgacaaccgtgagtggcggcggagcggcttggatcacacagagcccgagagctaactgtgcggcgtgcaatggaggtcgaggggatagtgaagctccgaccgctatacgcatcaaggcgtggggtgccaggagcagcacttcaaccttgggtttggtttatgccgagctttacaaccaacggtccgacgttgaggttcgtagaccgcgcaaacgtccccatggaaggcgtaaagttctaaccggcggctttttagtggctacagggtattttggaaataaaagaaaatatttggaaagcaaatataagtttaagttgtaaattcaattaaaagattaaatcaaattttattcaaatggcatttgaataaattaaagaaattcaaataaaatcttaaaatagcaaatttgatatcaaaatgaatagtttgaatttatatgaatttaggtccaaatttcactggaatcggatctacggtttaggagatataggcttctaaaaattgggatttgaattaaatctaaaaaatacaaaaagttactgttgatgggcccacctgtcaatctccttttctttttctctctccttctctcgtcgtcgtcttcttctcttctctgttccagagagagagagccgagagaagagagaggagaaggcgagcggggcggcggctctccggtggctggagggcggcgacgtcggcgtccacgcgtgttcccgagcaagacatacccggggagggcggtggctggcggagagagtgaaggagttggccggaacggcgcagtcaagagcttgtcttcggcggcaaagagaggtggcggtggtggttgctatggggtgggggagaaggggaaaacgggaaaaatggaatcaactcgtcgaggcgaactcgatggcgcgatggtttggcttgcgaagctccggtgagggagatcgggtggtggcggccatggggaggagagagaactggaactcgattttgtatggaatagaggaggggtggccggctatttataggggtgagaggcggtggtgagaggcggttcggaggaggagatcgagaagacacggcgacggtagcgtgaagaaaagaatgacggcggccggcttcgtttgcttagcggcgacggaagaggagttggcggcggcatgcgccgtgcacggcacgcgcaccaggaggaggaggcggctcggctggtggtgtgggctggtttgggccggcttggcttagctgggccggcagcccaagaaggaggaggaaaatagaaaataaaagaaaagggattgggccaaaagaaagaaagaatggagtttcggcccgatgacaaaaagaaagaagtctaatctgaatacttgatttggataactaggttttgcaaaggatttgaattcggagagaattcacaaaagagatttcttaagttatttgagtgcaatatttacagatggagtttgaggaaatttatttggaagcactcaaataggaagggaaattaataatattcctcaaatatttttggaatatagaagggaattagttgaaggcaataaataggatttgaactctaaaattggtattatgtatatttgtggctaaaaggggaaattgagtgaagaatataaattggaattttcttagcacaagagctattattcataatatttgtaataatacaattcttatgccgaagaggaaaatcaagccacaacgattaaattggtggctagatcaaaaggaggaaaatggatatttggatcgagaatcaaaggatgggtttaagatcaaaggatggattagcaattaattccaatgagattggaattactttggtctaggttcaaggacgaaattggaggatttcttggaccataattcataatagtaaaaatggttttcaaactaaatttgaataaaagagttttaatcgaaagaaggtttaatattcgaaaatagaattccaacaagaaataccaaatatgtttttaaatgaaaaacacaaaagggattaaataccagagaggttttatgcaagttaattttaggaagtcccgctaagtatattttcctaggtttaaaaggttattaagaacataagaatcagcatgatgcaagattagaaaatgacatattttcaggatgttacagcaaggtatctatatcgtcacactttcatgaatcccactgttgtgaaacactgctgcccaaactccttacgcaagttcaccccaaaaccgctcatagagccacccaacagtctttcatatagtgggacaatgtactaggctaagttacttgatcgtgcggatggacgcaactatgtcatttcccatgggataagggggtaattataatccggttaaaccacccaaaactttccaaactccccacaccaacatcacaaacttcatcattcatcaacattcataatcacaactcaataatgcccattttaaccggattcctaagtttgtaaagatatttaaataataaaccacataaaatgatgtccaatgcatctttctatgatttcatgtggcagtgctcggaagcattaataattaccacaatgttattctgaagtataacatctacccatgagatgttaaaagagtaattatcatgcatcaaatttaaatatgaagattatctccaaggtttctatatgattaaaatttttagttatgtcttgccttgcgccttaagattccccggcggtttcagcgtgccattctggggtccaccggtccagttccttggatgtcgacaggacttggtggtacggtcctaacggtaccgaatacgaaaacctaggcaaataaaagccctattaagcaaatggctaccaagaaacgataaagccaaggaataaaattggagcgaggcgagaggacaagggaatgggtttaaaataagttttaatttgaaaaataaagagaggtgttctacaggttggagattgaataaaatcaaataaagaataaatttggataggtggggtctattggtggattggtttctagtcggtgctagaatagggcagcacgacggctagatatgtggagttggttagccgatgctaagatgggtagcatacagctaaatgtttggctcgtctagtcgatgctacagttaagcagcacaacggctagagtcgggaaaatttgtgggggtttgcaagatggaaagtgttactccattgccgtgagtggcagcagagcggctaggatcgcatagagctcggaagctagtgtgctgtggaggtcgagggagaagtgaagctccgaccactatacgcgtcgaggcgtggggtgcgaagagcaacacttcgaccttaggattagattataccgggttttatgaccaacggtttgacgtcggggtttgagaccacacgaacgtctccatggaaggcgtaaagtttccacagcagttttttggtggctaaaggatggtatatgagtggtttaaaaagaagtattttaaataaatcaaaggaatttaaattcaaaaaggggttttaaataaattgaaaaaataaaatttaaaatggtattttaaaagaaataaagaaaaggtaattaaataaataaaagatatttaaagaaattaaaagataatttaatttaaaagtttttttaaataaagcaataaatttaaaattaaagggatttaagataaataaaataggtttaaattaaaaaatatttaaataaataaatttaaataaaattttaaaataggaaatttggtatcaaaagagagggtttgaaattagatgaatttagatcaaaagttttctggaattggatcatcggttggtgagatatggatgtctaaagtttgaaattgaataaaaagaaaaaggattactttataaaaggtgggggccactgtcatagcctcttctccttcttctacctcttcttcttctgttcctgtttttgccgaacaggtagagaggagagggaggaggggcgctagagctccggtggctggggatcggcgacgttggcggcaacgtgtgttcccggacgacgcgcatctggcaaggatggtggccggcagaggtagatgaggagttagccggaacggcgagcacaattgcatgaaccggagagagagagagaaagctccggtgaggctcgattcgaaaggaaaaagaagggggaaaggggtaaaatgggttcaccagagggaggcaaagccgatggtgcaaggaaactaggagggaagctataggggaggagatcgaccgatggcggcgtcggccggacttggcaggagagagagagctcgaggagctcggctatggggaaggaaacggggtctcactggctatatataggccaggagaggcggtggagtaggtcggttccaatggagaatagcgaaggatgcacggcaacggcgacgtggggaaaaagaagtacggcgccggctctgtccgttgattggccggtgatggcggttcggctcggcggcgtgacgtcgcagctgacgttggtgatagatccttcgcgtcgacggcaagacaacggcagcggcgcaaagctgcgggcgacggcagcacaaagccacggcgacggtggcggcggtgtgccacgcgcgcccacagagaagagaaaggagccggcttagctggggctgggtcggcttgggctgaggagggagatgggccgaggggagaagaaaaaggaatttcggcccgatttgaataggaacctttgggaatttttgtgtagaggattttaaatggaatttaaaggagatgaaatctataagaagaatgtttgtggactttttgaatttgactagaattcaaaggggaaaaaattctaaaggaagatatttgtgaaccttttgaactttggacaaggaatttaaatagagttaaaggaattttaaactagaggaattttgaaaggcagggttttaaataaattaataaattttaaaggagataaaatttaaaagaggaatgtttaagggtctcttaaactttataaaaggatttgaaataataaagggttttgaaaaagttcaaaagaaaggagttaaaatacttataaaataaaatccagatattattttttgagatataatttgaaaaggataaacattaagatgctccaattttaaaagaattcaataagaaccaaatataaaacttatcacaaagatttttctttaaaaattaaattaatcaaatgggaaggaaaggaaataatttaatttctaactttggataaatttgggatggtggcaaaaatagatggaggtaaataactaggattttagcctccaaaatatgtggtatggattctcggtgaattatttgtggctaaaggaagttggattttgagtagaagggattggaaataagtttcttagcacaagagcaatcattcaaatatttgtgataatattattctttgtgccaagaatgtgatcaagttataggaatcgaattggtgcatggatcaaaataggaacttaaccacgggatattttggaccgattaaaaggagacaaatgtttttggggataggtttagataggggttgatccaaaataaattccaacggaaagggagttatactggtttagccccaaagataaaaatggttattaggatataacagagaatcgggtcaatcggggaaatattggcctaagctaaatagtagactttgaaatcttgaatggataatttagatgaacgagatttcaaaggggaaatatttgtgggagtatagaactggattcggaagtatatgtggatgggaatctttataggaacgaaattggtggtatgttgataaactctaaaggatgggtatgttgactcaaaggggaattgaaaaggatattttatggactatgggaatatttaggtggagatccaaaggaaaggtattggttctgggggaaaaaataagaattggtatttcatgtgttcgggtagagatcaaaggggaagtatttgatggaagataaaaatggatttggtggtagtatggtaagctctagagagattgatattttatgtgctcaagagatggttgaatgggaattgaaagggtattggttcgaggtgttcgggaatggattccaaggaaatataatttagagccaaagttagagattacagaaaataaatggaaaggttttataaaatttaaaagagagcgattaactttgcaaataaagtttaaatccaagttaaaagaaattaacagaaggcaagatcacttcagaagaatcgagaagagtgcaactaaaatatttcgcaaaaatttttcccaaaattttgagtccgttacaatcaagcatgtaagataaaagaagttagatcaggtaagatcggctgaaagtccgatactactctaatcggcaaccagaaagcagactagggattgaa

SEQ ID NO: 73715 - DNA, 17508 bp, Oryza sativa
cacatgaatataatctcttagtgttctttctgtgtgatatacatgaatagcaaatatggcacaataaattatcgagagctacaattttgcggtgtgcgtcaaaaatagtagttccaatttaaaagatatgaaaaatccccgtgcagtgcacaatattttttttttcataagaaagagtttaccagaattgttctttatttggggcgttcgtccataaccaatagtatgtcttcccaatcctcttgatagatcaaacatcgtagggcgattttcaagacacaagtttctttgagcaaattcctgttcctgttcaatttgttagctctgatgtgactcttctctttaaaagatcaagccagataagttctccaaatagtatgtgctgtttagagaacatagctctttagttagttgtaaaaggtgacagcactggcatggtctgccgccgcatgttcaaggagttttgaccaaacgtgcaacactgattgctcttgcatagttgacccacatcactaataattttctgcaaactggaagtccctgatgcagtgattattgctttctatcacttgcataatcgacatactttactttcgcgaggggtaaaagattgaatatcatgctcagcgggtaatccgtttgaaatgcctgagaaatttactacacataactcaatgtgcaagctatgatgagccatttttctgataaataacagtttattgagtgtacctttataattaacttggaattttccagtgtttatgtattcagcaggatgaccagctgctgtgagcctatgattctttccttagtttagaacaaaattgtttaccaggttacaataaaacccgatgacatcagtttatggaccttgtgagaggcactaaataaaacaaaacaattaaacaacctctgataaaacatacaaattattgtctatttctcacaatgttccacatatgttttgatcgcttaatagggcacttataatttacagttgctccatggtggattatttatttagtaccatgacatggagatttcgtgatccaaaattttggtagctttagggctcctacataagggttgctttgcatgtacatttttcacaccttttcttacaatggagagacattttgccacgcaataatatcatattattgtaacaatcactgtacatccttttccccttgcttcattttctaccaagtcctgtttaattatctacttgttcccgtcagccaatattgttatcaaacttattggtttttctatgagaagttccttggatggtatgattagcttagtactccctccgtttcaggttataagactttctagcactgtccatattcatatagatgatgtataccttgattcattaacatctatatgaatgtggacagtgctagaaagtcttatagcctgaaacggaggaagtaataattttattttcaacaatggaccatactactgttagctactcacaagctatgtaatgtcattgtgttttgctcttaattaattattcacaaggataatagctacaaattgattctattatggtcaatcttcgcggttctgagttctgtgctgaccagtcaaaatgccactgctcctctctcaccagctataaatatttagccttttgaattaatcatgcatttacgtgttcttctgatggattttgtaggcatatgctgataagcatattatttgtcattttgcaagtgaactaaatcccagatatttcttctttatgttgtagatgatgttcaaggtgagcaggggcgccagtagatgtctagctagcactgtggttcttcagtattttgtaacccatgttgtcattccttttatataataagatttcattgtaattttagattaaattcgatcaatgttgcctatataaaattatgtatatgtattctctaagttgttcgtttacagtatagtttgtttccaaatttggccaacattatagagtaataatgcttatgtagaaaattctgattatcataaaggcacactgtgatgatggtcaaaggttatttgattccatggatgcacaactctatatatgaagggacaagcagactcttctgtgcattttgatcaattcagatcgcacacggcgtagcacgtgtttctttctagtatatataagaatgaacaagtgctcatatgttgattttaaaagtcattatataaagttatagacctaataactagagttatctaagaattgatcattaaagaatttatgctacttaaaagttcttttaagagtttgatcacaatatatagataacaaaaattagtactaaaagctgagataatcacacgttactcctttaatggcaaacttcatggaacatgctatgacaaaatagaaaaatgaggttctactgatttatgagctataccaaaaaagaaaaggaaacctcaaaataaaaaccagaactgttgttataatcaaaattatacatgctttactggattgtgagcaaaattagttcataatgttggaataaatgggctaggctcaatttaattcaattaaaatctcaagagcccacaagtaatgttagagagaataatactgccttgaaaatttaggtggaagaacctcaacttaaatagggtgatattagaaattccctgttaaccggttgaggtgatggttggactgccacacgcatgcgcgcatgccgagtcgccctcggccgtgggcgtagcgaggcgaggcggccgaccgagccgagcctgcttgctgctcttctgttttgtaacagacgagaataaagtcaccattaacaaatgaaattcattgtgttgtaatctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgagatttatttgtgtggtaatggagatctctctctctacatataacgcaaggcagaggctctcaaagtgtgtgtcttcctcctactattgttccttggtgatactctccttctgttcctgcgctgtctctctgtttccccggttctgttcatcccgcgcgcacgggtgatcggaacgagcaggtgcctccgaaactccgtccgcttgagaacctgcacgggtaggcgggcgatcaagtttttgggtagcgcttcaagcgcgactgctctgcatcatcttcaccaacatgtcgacaaccagtgacaacaacaacactggagacaaggagaaggagcctctcgtcaataccaacagaagcaatactgcctcaaactccagcagagggccattctcggggtataacgtttcactattaccgttcgttcttcatttcctacaactgtctgtcgcaatattattgcgttctcttatctatgttgatgcttattctatattaagcatgctcatgttgtacacatctagtactgccactagatctactcaaattacaaatgtcatgtttgttgtcttaatattttggattaaaatatgccgaattaattatgaccaaatttccaacacataatgcataggaaacttcgatgttatcaccaaccaattgaagcaagtggtgattttgaaaaattttcatgtaacaaaagctgtacatattcatcaataggggaaaaatggcagaaagtgaaagagttaccgtagtatacatgttatttcactctccaatttatttaaaattaatcacctataatactaggtagaaaaaaaatcttgtaaaggctgatcagaagggatgtttttttttcatattcacaagtgacgtatgcataagataaaaaaaagaaatgtaaaactaaatggataaatgtatatttaaaggaaaccagtattctttttttttttgggaattgaaggaaaccagtattctataaatggagaaactcaaactgttgttctaatcgagttcagcttcaacaggccatctgggaattatttttttgactgacatgggctcatatattttgttttaatttttaaattattaaattttgcttcatatgccatgtcagtgccacgttagatgaaaatcgagtcaaattagctatgtagcgtgcctcatcggctaaaaccaccgtccaaaccaccttgatacatatattagaccggttttgacagtccaggtaccgattatattggtagtgcggtttaaggatgaaaatcgaactagctgcaagttaagggacctaaaataaacttattcctttcaaaaacgaaagaaaacaaatcagcccagtagcaaactgggcctggcaaagcttcgtctcgagccccatgtgtcagaaggatggactcatcgtcctgctttaggtcatggcccagcatcctgcatagtagtatacctgagtcatcgatgggagctaggctcgatgtctcctccttcccgactctctccactctccccgacgccgccgcttcccgaagaccggcggcgagctgccagctggggatgcgccctctctgctgccggagaatctggatccggccggcatcggcgacggcgacggcgagggccgggcggccagatcgacggcgccgtcgacgtggggtggagagcaggtacgccacgcagctctactcctagccctaggtcgctctgcgcgctgttctttggctccgactgaatccatccggtaataagttttgtaccatatcgcccattctgagacaacacgacctgtttattagctcgatttgattctattccatcgccaccccagggacactcaccccgactgcaatgggcagcggtagggcgtgtatccgccctaccgtttcagctgcaaaaaaaaaaaggcagtgaaaagatcccctactggggcacggcaggcgaccccctgccggccagctgcaaaaaaaaaaagatccccacggcaggcgaccccctgccgaaaagatgccctatagaggcacacagtcgggtctctcggtggaggcagcgctagacactagcgcttggctttttgaaatttgtaacattagatttttttttctatgttgaactcattgctactcatgggttaatcgaaccaattgcaatttgaccattccatcctttggatgcatagttcgattactccatatataatactccaaaaacagtgtatttagccgagagaagtttaattttttgaaagaatcttacaataaacacacaactagacattaagataggtagcagaggagatacattgatcttttgatatgcccttactgctagcagttttgccgtaagacgcacaatttcgatcatactctggatgatttgtcatcctttgccttctgacttaagacaataggagtataggacatgaaatactctggacgatttcagcgtagtgactgtgaaaatgatgccggtggtggaggacgctgaactttcatattaccttcccttggaatccttgattaggtggaatccattgaagtgaaccaccagcggttaacagaattgaaccaccagaaaccgggggatcatttctgaaggctgtccacaagatgaacctggatggatcagtgacaagccacacaccaatggagaatccctccccttcgggatagaagccaaacgcaaagcgccctgagggggagacccaactttgggggccagctgtgttgatttcagaaccttgaggaatggttgtctcattgatctgagctcccatggaatgactagcttggatgatgaagagaatcaggcacagagggataatacaagggaacattgtttggccagaggaggttcttcctttgggctctgcaaaatgaactgcttggttctcatgtaaggaaataaattcaggacacaaaaacctcctattatgtgcacatgaattaaaacacaacatcagggataatcacaactcacaagaacgttgacctggacctggacttgggaaagggaaagtactaagttagtcaactactgatgtaaagtgaaagtaatcttgattttttttttctgggcgtagccgtaccataatggtatggaagcaacatgtcagtacaaggaagtccccaattttccagggtgacaaataacacattggacaagtcatgcaattaattgcgcaggaaggtctgggggcaaaaaattgaaccgaatgatggcaatgtatcagaaaatgacatcctaaccaatcaaagcacagaggaaatagaacaatcaaatatgcagtttctcaatttattacaatattttttcaaaactgttgctctttgagtgtgctatatatggcgacactatattactagttagggcgaattgcagcgatgaagattaaatgtcacatgtttgcacccatttaaaacagaaacacatgatcattccacactagacaaatacaacatgataatttgattggctcacataataattattttttcaaaaattgttttaatattaaaaagcactttactgatctctctgtagtcaaagaccatggcagttggagtaaatattggcgcaactgcgatgtgctacactacaccccaagcaggaatgtttctattgctaaagtcaagtgaaattgtagtgcattattgaaggccaggctccagctatagtgaaaccagagatatatagctaacggtagcagattgtcttgaacacagaactgcttaaaactttatgaatctatctagtcttttcaaatctactagcagctcatattttgttccctaaccattgctcaaattttgttgcgctgttgctgacaatcctcagcatcatctggattgtgacacaggtttgctatccttatgttttttcatggaaatataggtgaactaggtcatttacatatgcaggggtaccatttgaagtgcaagttacaagttgagagggccatggttacagatgcatgtcacctcaccattgcatgtggaggcttgatctgctaggaactttggctggctgaagaaacaaaaaataatcttatttgcttttacatgctcgtttgttaccgcatggagcaaactatctcaaaatgttcttttgtccaaaaactttgcttcggcacaagatttgtacatgctatgtaaagtatttttgcaggtatttgccctgtcaagctgatgatgtctcagttgtcaatgtgaacaatcaatacttttcaatacaacaccgttagtcacggcaaacagtatttgtacatgcaatgcatatttctcagaaatccaatttatatatctctgttttcatgtgagttcagattagaaccgagacggcagcagagtttgtataaccccttttttttactttgaaattcaatgggaaaatatgttctgaaagttgtttttcctttgcttgatgttccgtagtaaaatgaaaaatttgcttgatgcaactcaacatgtgattttcacctgtcctatgaccaagtatggtgtgcctgtagagacgcccttggctggagttctgttcctttttcttttgatcattgtttgctgcagctgtaaacgaaacaagagctgattatcatgtagtagtgaacatttcattccacaaatgcaaaaagggggaaataatttgaagtgaaaattaccattcttgagtgtacgggtgaaaagtagattttaagaagagtccaagagaaggaaaatgaaaagatgtagtattactgaaatgcccaactcaggggtagcttgtccaacagtccaaacctcactcgaaatttgaaatgcccaactctgtttctcgaaagagcatggttgagcccaaaacacattgaagtgagcagacgatcgatttgaacaaatatttaaagtgcacgctactatgacttttccttagatactcctagttcatactactatgaaaattttccggtcttctcgagtacctaacatttcagatcgtatctatttggcaaaacaaaagaggaaaatatcatatgtacgtctaagtatgcagtcttgttttcgattaattaacactacttaaaaaaggtttttatatgcggctaaatttatttttcacagaaaattcacgctataatgtctaaacaaggcttgtgaaaataaataatttaaggtggttataggcggccaactctaagagacctacccgtgaaaattggatttcacaaactgcccaaattagttttcctaggcggtcctctaaagtgaaccatttcttcaaatgtttttgacggaaagaaaaaaagaatattaagatccaatcataatatgcaatttcccaaacttcttataagtaattgtaggcacaatcacaaattcccaaaactaaaaaaaaaaattgcaagttctccaaaatccaagaactcacaaattcctcaagcatatgagcaagcggatggtaataggtcttgcccgagactttggtggcctatggagctaccgttgacaccctaaccgacctttattgacgccatcaagtcatttttgtcgacggcacgcaagccacgaccctcaccaaggtcttaattgtcaccaatccatagtcctgatcgtatatttattttgcgacggaatgactagtactaaccaaacaaccccaataccaatttgagcacatacaagaaacaataatccttcgggaaaacattaaaaaaaagaagaaaaaaaagggggcaaaactgcccagccgtgaactgggcctggaggacgtgaactggactcatggtaatcttatctcatggcccaccttatatggaaggctcgatctcgcttcccgtcgtgccgcccctctcctcccgacttctctccccgatggcggcgcttccccacgtccggcgacaagcagccagctgcagatgcgccatctctgctccatcggccatactctccacggcatcggcaacggcggcggtcgggcggcgccaagcttcagctcgggccagatcaacggcgccctcgccgccgggcctccatggagagcaggtaggcctcgtctctactcctaacttggtctgcgcgacgcgctgaatccatcccgcaattagttttgtcccacctcgctcattttgcgacagagcgacctctttttaaactctgattgattctattgtgttgcctccccggagacacccacaccgactagatacagcggtaagatccccactgtggccacggtttggcggacaccttctgctgtaaaaaaataaaaatggagcagtcataaggtcccctcccgttacggggcacggcaggcgcctaccggttaggctgcatccatcatacacgttaagatgtcaaatacggcatacatacagtcgggtctctcggtggagacagcgctagacattagcgctttgccttttttgaaattttgtatcatcaaattattatttttctgttgattaatcacgatagcagcaatggaggcctgcatttgaaccccctctgcgtttcaattccaatttcctttgcatttgtatttgaataccatatttaccagcttaaattatctatggtatagactacggaatgtgtatagcaaactggaaaaattagagatgtggcgatagaggagagcctatcatcagcaggtatgcaaagaatttcctgtgaaacgaagtactgaaatactcttagcagaggtgattttttttaagccagagatgtgaatgatttgttcacgctgcaagacaatggaaataatgattgaagtgaaacatcaatcaaatattttcagccaattgtctgaagatgtcaataccgggattccaaataaagcaataagatcggctatgcgctgctttggctgctccgacaacctctgagactgagctgagctcatccaagcatggacgaagtatccaacattttgaagtcctttttgtgctcaaggcattcatgtaagcaaaaagaaaaatgatctcccacacgagtaatttgcgtcaatttttgtttctgaaaaggataccctttcttctagttttctcagagtgcaatcaatcatgaggacataatgcatgctaatgattaccagaagctgcgcctagaagaagcagaagcttcacaggcgtcataaagggaagctgaagctttaaggttttatgcctatcatggatacttagaagttgcaacaatttttctgttgctacatggactggatcattggacgagctggtgcagtggtgctgttggagcaccattctgttttcaggtgggtgctctaaatggcaaagcatgttccctgctgaactgttttaagacctcctactaggaagatactagttcattttgaagtcctaatccgccaatctacaccttcatacgactgcatggtggttcagtcagctcaatgagcataactgaacatttcaagaagtttttttttaagaacaagaaccacattccgtccatggatatgctgctgtttgagaacctgttggcaacgttgcaaggatgtgcaaatgaggtgctgaaacctgactaccacaaattttagctgtagctggtcggagcaaagtaatgtctaggtgtaacgcactgtaaatttgatagatgagacgcgtccctaaataatatcctttttaagtctttgggtttggcttactgattctttttgtacaaaagaaacaaatttcaaacagagcatgttgggttactggttgcgaacacagcaaaacaaacatttttcactggaaggcatttcttatggatttatgtagctgactcgaatttatcactggaatgcttaatgaactggcagaaccacagcaattcgttctttttcctagcctgtagtgctgtatgtgaatgaaggcatgaagcatgacctaggaatacttgacgatttgttctgtacttatttgtgagattactagccccaacaaatttagcgcaaagtttgattatgcttggtttttttcctttgctttgagacggtgtcacgccctggcaatgagaacttggttttttctttgctttgagacggtgtcacgccctggcaatgagcgatttcaaggcacggcgactagattcatttctccttgtcgatcttaatcgaacgaattacaacttaaataagactcgatctaagattgttcatgagataaaacgtgtttgctgtccatcggagaacgaataacactgcaaagtcatccctatttttgtccgttaatgatgacaatggcaactaatcagaaggaatttgcaatttctcaggatttagctcgaagtagagcggtacttttttccccgcgagaaaccaacaagcatgagattctgactaacagcaatcaccatgacatggcccggcacaagctatcggccgctgatattgtagcaatggtagaggatacgaaccccacgaactcagcctaaatgaagattgttgatcaatgcagagagttgatcaacagaacaaataaggcaataaagcaagcacaactagcgaacatatcaagaaacaaaagcatccagacaggaacaaaccccagggccaacgggtacagatttcccaccggaagtctcactgtaaacacaggccaagtctacctcctgttggaacgccaaaattgcatatccagtatccagctcaagacagcctaaagataaaaataaccatgttgcatacatagataaggagacattctccccagtaacagaagaaaagcctagttcatcctccggatgagctcgttgatgtagtcctcacggttgccggcatcaccaccctcgacatagtggttcctcttcttcttgaggccaccgagtggtgccttcaacttgaagggccacaggaagttgttggcctccttgaagtgtggaccgacagtcatgatctcgtggacaagatcctcaatgcagatgatgtcatgcttccccaagccctaatggttgaccaacaataggccaaataagaatttgattagctgtaaatggcatatatacaacacaatgaaagcctacaagagcaaacatacctcctcaatgactttgttgttctgaagaggaatcctctgcttgttgagctttccgtaacccctcttgtagatcaattccctgacactcttcaggtttgggtacctgatcacaccagagaaggtacttgattcagccaggtagaacattaaaaataaccaagtatctaacaagctcaaaagctataaagtcactatgagaaccctactgctgatcaaagtattatcaaagcaacatttatgcctcaagcagcttagcaataatctaataacccaattgagatagtgtcatcattctaattctgcaacagttgacatatccaccatagtactttcaatagcttctgaacttagatcaaacaaacaagattgaacagaaataggcaaaggccattaagattaactctttcaagaatgtctaaatggtaataccacaagtccacaacagactataaacaagggggaaacttatatgttcatcacacaattttaggtcttaaaagcattgataatttgcgatggaggattacaagtctgtaacagcaagcaataattagcacagctaaatatataaacagaacagcagctaaaattgataacatacccatatgcaacatatggctcaaccctgcgcagcatgttaatggttgccttgttaaccttgaggaagacaccattgaagatctgtagaatcaaacaattaagcacaaagttaatacaccagcgtacgcaagagttcacgcatttctaagaaaactggttcataaaccaacctgcctcaaccgcagaagctgcaagatcttcctggtcttggggtgcatggcattgatactacataaagcatagcgaactgtcaatgcttatgcaaacaaagacaattttaagccgtagcggtatagtttctcacccacggatgcggaccacaaacagaagtttggcctcagggctgacgtagaacccacccttcatccgagcctcacgcttgagctgcacaagctccttctcctgcaaagaacacaatcgtcacaataaattcaaaaagataatgatcatttcagaaaggaactatcccttgaacaatgccaacgaacagattaactacacttcaaaagcaaaaaaaaaaacataatccaatcgcccaccagattaagtgtgttggcattaaaacaaattcatgggataattagaccatttaatcataccagctctcagcaaaacagattaattagaacatgactacaccgttggtttttaaatctaacgcaagttgctaattactggcatctagctaaaagaaactgaaatcttgaattaaacgggttcagcatccaccacggacacctgcagacgcgcattagacgcttctaaacaatcaatcgtcacaggagaaaacaattctcatattttttagcggacttcacgatgcgtcgatgcgcaacgcaaatctaaacgaaccattcctagacgccacagggttccgcgaatcaacgggcagcggggaggttgctctgctcacctgcgcgtcgtactcctgggcgtactgcttggcgcgggcgaagatgagcttgcggctctcgacggccttcttcttctcggcgagcgccttctccttcctgtccgccgcccactgctcctcccgcttccgcttcttcagcaccgactccggcaccaccgccgccttcgccacctccgccgccatctgcacacacacacacaccgctcagagatccgcacggccgagcagtcgctggatcgagctagggttcgggagcttaccgcgatcgagtcctgcgagagagagaagacgagatcgagaggggagagagagaggaagaggcggcggcgaggagggagaaggggatttatgggggaggcgggaggttttagggttagggtttcgggcgcggctcggggtgtggatcggacggctgtggttgccgcggccgcgtgatcggacgggtgaggagggctctgggagggatgggaaatggcgaatgggagatcttccgagggggtgtgcggaaatgtgacggcccaggttggtcaaaggtttgttgggccggctgacatccataaatgtgacggcccagattggtttgggccgaatgagatggtgttacgggccacatagttggctggctagagccgataataataggggcaattgcgtttttggccatatttcgaagactaactactaatttgactaactctaatttcaccctgttttttcaagtttgctcatttaaccctctttttttaaacgaagatggaacttggccctattccgtgaaggcaagatgacggtgttaactcaagacaaaagtttcatttatacccttatgaatttaaccatgtttctcaaagttttttattacacttatcagtatatattgcctcaaacacaaaaatacatggtgcaaaattatgtctaccaaaaacaaaaaaaaagaaaaaaagtcaagcaataggtcaccgcgtggccgaggagcggcaaccaggggcggcgggaggagcggcaatggaggggcagcgtcggctcggcgacgaggagggccgctgctggcggcagatgagcggcggtggcggctgcggcttggtgatgaggaagtccaccggcggtggcgtcggctcggcacgaggaagaccaccggcgacggcggttgcggaggggcggcgtcggcgtcggctcggcagtggcggcggaggtagttgccgaggggcggcggaggccaccactcctctctccgcccaccggctccgctgctccgtgcgccggcgctcccttccttcgtacgacgccaccgccggcgctccctccctccccgtagaacactccatccattgtggcataaaaaaaacatttttttctattttctaaatgaaaccctaacggtgtgatgaaaccagggccaaacggcaactccaattttgaaaagcagggtcaaataagcaaactttaaaaagtagggtcaaattagtagttatagttcagaatagggtcaaacgagcaattgtcccataataataagggtagtacacccgaagtccctcgtcttgtcaccaaattacaaaatcgtccttaaattgtaaaaccaatgagaaggtgggcccgaggagctcgcccactctgcccaataggggtggcagaccgagaccgataaatttggtcatcaattcggtcctacgtagtaaaagaccaaattttttcggtcaattcggttagtctcctcgggtaaccgaatagaacgaattatcaaaaatgtctaaatacaacctacaatccactacatttaataggattaaactctaattttcacatccctacttcttctaggcatgcaacctaataagagtctttactcataagtgcttatgaatttatttttgtgatttttgtgttgaaaatttccattatttctttgcatatatgaaaatgttgttgaatttcggtcaggacaaagaccgagagcgaatttgtcggtcctaacatttttgcgctgatattcggtctttatttttcaaagaccgaaataccgaagaccgagactggaattttcgattagaccgaatgcccacccctattgcccaacgccgtatgcgaggagaaaggagaaaatgagaagagaggaaggagagaggagaaagagaatgaggatggcatgcgggccccacatgagcccatcatttttagttattttctagcgtaactaacataagtactacgtggagcaaagacttagtcaaagcagccatctaggcgccacatcagctaaaaacggggacaataccgtcaagggatctcgttcgcactggttttttggttttttaagttagagaatgcgttatatctggttttacggttcaagaacgattttgtaattcggtgataaaatgagggacctccgctgtacttttccctttttagttgattggctagctagcttgcacataggccaaggagggaagcggcgcgcgcggcttcagctcggaaacgtgtcgcgcttcggttcgtcgaaaggagaatgacacagattgatccctctgttttggtgtggaaaattcggatcgattacacaatcatctggagtatttttttttgagaagaaggaagagtggatagcttagggtaagtactataaatatccaagtacaatctcttggagagataaagaaccacccctcaagaggtaacgactatataaaattcaagacaaaaggagagagaggaaaagtagattggacaaacaaatattggggctaatctattagaattagtatatatatactagaaatcagcgcgtctgttggcgcgccctcatagttaaactcatactaagatctctttttttaaaaaaaaatatatatagaagattatttgtccattgttaatccaatttcagtaaaatcctttaattggtttcaatcaaagttgaattaatgaagactgcattaagaaaacaatacagtatatttgaataggtccgttactttattctaaaaaaataatttgtacaaaagaatgattatgttttatttgtatataaaagaatacatgttatgaatcaattgtaagcaattttatggtagtaatttgtatttatattcagtttttatgtttccatagtttatcgtggcaaagttagtcattgagcatccattcgatggttatcaagctgaccagcgctaggttgcacgagtgcatgcacatgcgtgaccacggagggaagacaaaacatacggaagatttgggaattgtttactccctatattagtcgttttggacaaaagtaaaatcaaactttaaaatctttgactacgaatgatttctaaaatatttatcttagaaatatgaaaaccacatgtgtagattagtcttaaaaagtacttcaataaaataatatatttgttaaaatgtctatatattttataatagaaaatagttatcaaagttactttttaaagaccgtgtccttatccaaaacgacaagtattatcaatccggagggagtacaatttagatgatgtttggatcgagggactaggatgtttaaacactaatttggagtattaaacatagactacttacaaaactaattgtataaatgagagctaattcgcgagacaatttttttaagcctaattaatccataattagcacatgtttactgtagcatcacatacgctaatcatggattaattagactcaatagattcgtctcacgaattagtccagggttatgaaatggtttttgtcattagtttacgtttaataagtatcccaatacatgatgtgctgtatcatacacaggggcttactaactcggttgaactcaagccgcttgtcctcttcaagttcacaactccacagatttgccaccgatctcaccgtccagcacgagggtcagtgccggcgtcgctctccatcgccaagtccattgtgcattttgtgagcacccaggaccgtcttcgcttatgtcgctcagcgtcgtcagatacattggtgga

SEQ ID NO: 73716 - DNA, 574 bp, Oryza sativa
  unsure (1)..(574): unsure at all n locations
tagccatggtctattacccaccaccagnctatactataagccttgctctaagcgacacgggacaaacactgcttgcgggatggagtcactccgcgccagagcgcgtcgcgcagacccgaccttagcactagaggcggcgcataccccgtacctggtctccatggaagctcgggggcgagggcaccgcccatctgggtggagctgaagccccataccgcccggccgtagacgtcaccgatgccgcggagaactacacacacggccgaccaagatcctcctggagcatccgcagatggctgctcttcttctgacgttgggcaacagctccataggcggacgtcgggaggagacaggaggagagggagcgaccaacgggacgtttggccgtgcactttggctatatataattgtaggccggttgggcgggccatatgactaaactttctcaccctccgtgctctgtctcactttctaatgcctaaaacctggtctggttatcccctaccggcttcgtaactgacaactgtgccgaactgttgacagaaactgtgccggaggacgatgaaaaaagaaa

SEQ ID NO: 73717 - DNA, 10732 bp, Oryza sativa
  unsure (1)..(10732): unsure at all n locations
cgctcttgtgcttggcgctcctcctccagtcggcgtcgttcggcttcttgtcgcacgcgttgttcttctgcttttcgggcttgacactgctctttcgtctcattgttggccatgaaaatgccgaaggagaggggtgtgtagttgtcttcaaagccttcgtcgaagtcgtcgtactccacgatctccgctggtcatgagtcgacaccgggggagctgaggtagccgtccagttgttccgttgaaaccgtgccgagaggctggagtatgacgccgacttccctgaagctagactggatcagggccggagccggatctcgcctagacctacggggagaagacgcccttgtggtgaagacggcaaccaaatcattggggagtttcatcaggattggcggataggctccatcgtcttgatcagatcgcgttggagtagattggatctcgtccgagtggttttgggccgactcggatgaaatgatcttggagtagatctcggccgagttccggataccgaacgggatggagacctggccttttccgactggttcgaacccagtcgaggagagaaatcttgcccaagtcgtggtgatgaaatccaggctgccgaatcaaaacgcctgcccggtgggaagacgaaatcgtcgatgccggagacgaaacccatcgcactactcggtgaaaaaactgacgctacccctacctggcgcgccaactgtcgaaacatgatttcggcaatactaaaagggggtggctatcaagctagaaaagcggatgggtttagagaaagaatcatatacaggtttaggccttcttaacaagaagtaataccctactcctgtccggggattgccccgccaagtgtattattgatcgtatgacctgggagaaaaatcgtgccccaatagacacccgtaccctccttatataggggaaggggtccgtattacaaggtacagcccatattcctaacggaataggtagttacagataagatacaattgtatccgactaggatcctgggtattttcttgacatacaagtttagaatttaacctaaattcctttaaagatattctatttatacatggcaccccatacccagtcggatatacatgccgtgtaggtatagggtatccataatctccacaccgttgtgcatctattttcatatcattctctactacagccacgtatcttttcttccctcaaaaaaccatctcttttcttttgatgagttctctgccgtattatttaatttttaagatggggagaaaagttttacgaggtttctttgttttctttaataatggttaacagggtttctttacgtgagacggttacagaggtgaaaagttgcatcttccaaagggcaggtagttaactctataatgccgttttggagcgataatcttcgttcgttcgttcgggtcttccataattaaataggcgacttgatcttctctagctcgtattatgaaacacttacttgtgaaaggaattaaggaaagaatggcttgctctgactgtatggaacatacacatagccggtggctgaagaaattacgaaacactactacaaaacatcaaataggtatcgccactgcagtgccgatagtgctaaaaccggcacctataagccttttccttcctccacgggttaaaatggcaaaaaattggcaccttttagtaattataggtgtcggttttaaataaaaacaggcacctattatattttgtgtcgttttttttaaaaaaaggcacctataatatattataggtgtcggttagttgaaaaccgacacctataaaatattataggtgccgatttttaaaacaaaaccgacacccatataacacgagccgagccggtgggccccaccatgaggaggcgacacgagaggagataaggtttctctctcgctcccttctctagttctctctcgctctcttctctccctcccttgtctcgctctcttctctctccttcccttctctgctcgccggcggaggcggcagcggcgaccgcgccctcccctcccccaaatctagtgggaggagaggcggtggcggcggcaggaggggaggcgtcatcggcgggcggggtggttggttccggcgtcggcggcgggcgagggggggcggatccggccgggagggttgtcggcgatggctcggcggcggcgggaggggcggcagcagatccgacgatggcgtggctcacgggcggtggcgacctcctctccgccagatctggcaggaggggaggcagcggcggcggtggagccctcccctacgccagatccggcggggggtaggcagcggcaacgacagcggcaagctccccacgggcaacggtgagcacccgagtcccccaaccatctcctttgcttgcgatgatgtttgatgtgagatgaatgttgattcaacgatgtttgatatgagatgaatgttgccaaatttttttctgagatgaatgttgcttgattcaattgtttgattcaatgatttatttgtgagatgaatgtttgattcaaatattttgccaatttttttcgcggatgtgggaggagggactgctcagctcgatgcgccggctccatcgagccgacttttttttttcattcatcggacctaaaaggtgccggttctaatgaaccaatacttttttattttcaatcagtgccgcctcccttgtgccggttgggaaaaccggtatagaagggggtttctcaaccggcacagaataccttttctgtagtagtgaaaggtggtttatatgggtcatagaaggtggcttccgctatgtcacgtaagtaaaagagaattttagcatgctcccaaagattgatgtgtagtagatgaggttcacgacttggtcaaggtcttccaacgccgctcggagagagagatgaaggacactagctagacgcggttcccgcggtgtgacgccacgcgcttggaaatgtcaatgagtgattaagctattttgttttcatttctgatacttatgttttgttttatttcagatatttatttatcgttcaagtaacagttattacttcgtagactgagaccaatacaccgtaaaattttatctccgaatatggatttgtatgtgttttagtttccattcgtaatttaaaagtaatccacacttccacagaactatctacatatacaggaagaaattggtcgatagttcaatcaccgagcatttcaacgtgaagctctacgcgtgtaagaatatgtgtttggaaccccaacccttttccatcgtattccgcacgcacgtttaaaatcatattgatccacacgctgtgtatggaatcatctaggctgtgtttggaatcatctcttcccaacatgcacagtacccaaaaaaaatagagcggtctattagcacatgatttattagcacatgatttaagtattagcttttttttaaaaaaaaaatgaatcaggtatagttctgggcctcagggagatgaaaacagaacagatacgcatgcatatatacgtacgtactcattcttttaggaatcctaaacttaaccttatgattcagatttcagaatagacattcaaataatcgaggcactaaccttctctactacaatcatgtatcttttcttttgatgagctctgccgtattatttaatttttaagatggggagaaaagttttaccggtttctttcactactggagaagtgattttcgccgggtcatgcaaaaatgatatagtcctgtttcgaataggaagttaggaaccggccggactaaagatcatttttagtcccggttaaaaagcgcaacagaactttatgatctaaagatcatctttagtccaggtttattttttgccagccataaccgccggacatatttagtcccagttggtaacgatcatctctaaagtcttcttcctccatcaaaccgagccattgctgcaaaggtttggaggagaaagggaggtgctgctaaaattttttgtgaaaatgttttaatgataatatacaaattagagggatctaaaaggttagcaactgcattcgctaatgatgcatgcttagcatattgcatctatagctgtgtttctatacattgttgtctcttaaaaggtttatggaaaatgatgagagagaaaatttgttaagggaaaattaggttacttttaaaattataagcatgtggataaaaatgttataaaagagatgacaaaggaaaaatatagaaaattaagaaaaaaaaagaaaactaagttaatttaataaaatagttacaaaaaattacaatacattaaagatatgtttagaactttaaaaaatatttaaaacatgaataatatgtgggattattgtatgattatttatatataattattgtattattatttaattagtttgactttcgtggattttatttttacgatttttgtgcatttcaggtagatggatcgacaatgaatatacaccgcggaccgatggttcgcagagtttattggctcgtcgttaatctcagccacttctgcccaggtactatattttttttaacacaatattacatagtcaccaatttaactcgcattgcttggaaaactgaactttgaagcatgtcatcaagtctattgctatggataagactacgagaataatggacgcaattgaatatgttacatgttactccctccgtcccaatatgcagtagcaacctaggatgggacggagggagtagttactaatcactgagcaaatgagcctagatgaaacatgtcacaaattaaaagagaatatcgttgtaaccaattgataatttcgaaatatcctgaatatgctgccacccatctgttgtgattgtagcataagctactatagtctgcaaatgaactgataacatattttcatcatctgaacacgatgaagttgaacttgcatatatccattgatagggactgaactttcatatatttgtattttattttcaaatatagtgatataaatggtattttatttttaaatagtgtggtcatcatgtagaaatattattttgtagtttgtaaactatgagaggtaacctcaccaactaaggtgtagaggtaattgtatccaggcaacaatactatagagaagggatttagtgtcggttggaaaaccctcttcggtgccggtttttctaaccggcataagggaggcagcactgatttgcaaatcaaaagggtgccggttccttagaaccgacagcttttaggtttgacgaataaaaaaaaagccggcccgcatcgagctgagcagtccctccttccacatccgcaagaacagaacgaacacatcacacaatcacaaaatttggcaacattcatgcattactgttgatgcgaaaaacacacactggcctggaagatctgcttaactcctgtgcaggtccaaatcttgcttttaggttcataagcgtgctagttgatttgatcctgcaatcaacaagaataaaagacaagaaaaccgatgttaaatccataaacgatagccgatcggctaggagccgatgacatatcatcaatcgtcaagccgatgtcattgtcattagatcggcaatgaagaataaagcaatataaaactaaatctactcgatcggctgcagatatcaacgacaaataatccttttctcggtgtatatttaaactaagtgattgagatagatcgaacatcatgtcaagacaatataaatcacttaagtctaaagatacgctaagataatgattatatgaacatttatagcatagccatcagatagatctagcacgtatcggctaatactccgataccactttataataagatattaaaacaaataaaatatatcaaacagaaagcctaatatactctaatgcaataagatcttaacataaaaatcaagcatataaagtataaaatagctaaatcaggtaagatcgtctgaaactccgacactatcttcgttagaaatcataaaacgagctagatattgcagttatgaatattacttaatagatcgaactcaaccgatacagcattaagcataaaaacaagtacaagatctaagcaagattatgaaaacctctaagagatggtagatatgcgatataatctagattaataacaagatctaactctatcggctactttctaacaacaaaaaccagccgattgcgggttagataacgtaactaacaaagattataaagcatatataataactcgacgaattacataaataagattagagtgtcgtaatgatggaagcactaatcccgagaacgcaagccgccatgacaagtttacctcttcttgaagatcgaaatcgatgcagctcaacctgaaagcaagaactcgtcgaaacaaacgaaagtgaaaaagggtggcgatgcgccaaaagtgttattgaactgttattataaattacatgggtttgggttatatttattcccgagatacatggtaggtccttgctggacatgattcttatctctaacaaactctaagatacaaacgaatcttcacggcagacttttgctgaaacatatctttaaagaaactattcaaaatatcctaattaatagatacaattgcctatctgagagcttatctccatcgtgacaatcctttcgtagcacgttgatcgattccagagacagttttataaccatctcaatgaaatcggctgtatcggctgtcctctgtccgatccatctcagccgatgcagactctagctgatgccttcgcaaccgatgcatactctgttcttcgaatccaattctttgccaaatccacttcgattccattgccgaacctggttcatagtttaccaaatttggtcgctaacaattacacaatcaaatattcaacaagtttacatctctaaattgttgaatgaaacaatcattgaatcatcgaatcaaacaatcaaacatcactggaatcattgaatcaaacaatcaaacgctcaccgtcgttgtggggagcctgtcgccatcgttgccgctgcctaccccccggcggtggcggagccctccccgccgccgctgcctcccctcccaccggatctggcggaggggaggtcgtcgccgccgccgcctcttgctgctgtcgcccctctcgccgccgccgagcggtcgccgactcccctcccgccggaactagaggaggggaggacgtcgccgcctcccctccatccgttgggccgccgcgggatcccctctagccgccaggcctccgcgggctcccctccagctcctgccaccgccacctctcctctcgccgagggagcagtcgccgcctccgtgccagcgcgcggaagaggaaggagatggagagagagagagagagattgaagagagcaagacaagagagaagggagggagagggggagagagtgagagagagaaagaaaagcgagacgatgagagcgagactgcgagacgaccttatctcctccggtcgggtggtggtggtggggcccgccggtcggctcatccgatgccggcttggctcgatttgtataggtgtcggtttttaattaaccgacacctataatatattaaaggtgccggttttttaaaaaaaccgacacaaaatacaataggtgtcggttttatttagaaccgacacctataattatttaaaggtgtcccttttttgcgattttagcccgcgaaggtgggaaaaagcactaccggcacctatagtggtgacacatatttgatgttttgtagtagtacaacccattttgatacctccattcaaacaaaatataggatcattccaacccatcatatccctcaaaccaaacaaaaaaacagggttcgtttcatcccttcaaccaagcaaaaaccagaaccattccattccaaaaaatagggatggatccaacccatcccatcccatccccaaaccaaacatatgctaagtgaattgttcaatcctattttttggtgttagatgttcagtgggatgaagagatggttcctagattttttggtcggtcgtttatgctaatcgaatcatacaaatagcgaggatggtgtagaattgcgacatagtacatctggtatgttcactgttagatctgcttatcatgtacaatgggatcataattttggcaatctaaggagaaggtcgaactgaggcttctctctgtaatgagctagaaattacatatagtcttatagatataatatagttaaaaccatagtatattttcatcacaacagataaatcagtgggcttttccattgcatacaggaatgtggagattatggataccccatacctacacggcatgtatatccgactgggtatggggtgccatatgtagatagaatatctttaaagagactcgggttaaatttcaaacttgtatgtcaaggaaatatccggtatcctagttggttacgattgtattttatctgtaactacctattccgttagggatatgggctgtactttgtaatacggaccccttcccctatataaggaggggtccgggtgcctcttgaggtacgatttttttcccagatcatacgatcaataatacactcggcggatcaatccccggacaggagtagggtattacttcttgattaagaaggcctgaacctgtataaaattccttctctaaacccatccacttttctagcttgatagccacccccttttagtattgccgaaatcttgtttcgacagttggcgcgccaggtaggggtagcgtcaagttcttcgccgactagtgcgatgggtttcgtctccggcatcgacgacttcgtcttcccacccgggcaggcgttctgattcggcagcctcgacttcatcaccaacgacttcggcaagatttctctcctcgactcggattcgaaccagtcggggagaggccaggtctccatcccgttcggtatcccgaactcggctgagatctactccaagatcatctcaaccaagtcggctccaaaccactcggacgagatccaatctactccaacacaacctgatcaagacgatggggcctatcccttaatcctgatgaaactccccgacgacttagccgtcgtcttcaccacacgggcgtccgctccccgtaggcctaggcgggatccagcttcggctccgatccagcctagctccagggaagtcggcgtcatactccaacctctcgggacggtttcgacggaagaattggatggctacctcagctcccccggtgtcgattctcgaccgacggagatcgtagagtacgacgacttcggctaccactacgactaccgcaacctcgacaacttcgacgaaggcaacgaagataactacacgcctctcttcttcggcgttttcatggccgacaacgagacggaagaacagcgtcaagcccgagaagcagaagaacagcgcgtatgacaagaagccgaacgtcgctgacaggaggagaagcgtcaagcacaagagcgagaacggctacagcgtgagcaacaggagcgcgaacgggccgcgaaggaggctgaggatcggcgacagcgcgccttggaggccgggcaacgagcacgagaacttattgggcaacaagacgttgaggggacggcggtttttcgcaccccccagcagaacgcggttgcagcgatcacccttctcgacaccctcctcaaggaagtcgcactcaatcaagccaatcacctcgtcaacatcttaaatcagaccaagaccatgatcgccgcttcggtcccggtgaactccgcaagcgtccgtacgccgactggcagccgagttccccctctccgatctcaagactatcatcaaccaagcctcagcgtcgtcggcgcgggatccagtcgcaggagcaaggatcacaacgagtgatccgtccactcgcctcctgaccgacgcagggagcgtcaagctgaaccgcccctgctccccacatcgcaggcgtcccatcgcagncgacntgcgtcgagtgatttggcaagcgggctcaaagcngactgaaatcaagaagtatgacggcaccactaacccggagtcttggctcaccatctacagcctcgcaattcgcgcagcaggaggagacagcaaagccatggcaaactatctgcctgtggccctagcggattctgcccggtcctggcttcacgggctaccccgtggcacaattagaacttgggcggaacttcgcgaccacttcatcgccaacttccagggtacctttgaatgccctggcacacagtttgatctctacaacgttgttcaaaagtctgaagaatccctttgagattacatctgacgcttttccgagcaacgcaacaagatctccgacatcaccgatgacatcatcatcgccgccttcaccaagggcattcgccacgatgacctagtcggcaagttcgggcgcaagcgtcccaggactatcaagcagatgttcgaaaaagccaacgagtatgccaaagccgaagatgccattaccgcgtccaagcagtcgggcactacttggaagccgaacaaagatacgccgaccacaggggggagtggaagtaccaatcacaaggatcgcaagtgtaagcccgaggaacttgtggcaactactacaccatcctcccgacaacgttcacgcgtcaacacttttgacaagatcatgaactcccaatgtccacatcatccaaattccaatcacgcggccaaagattgcttcgtctacaagcagttcgcagaacaatatgc

SEQ ID NO: 73718 - DNA, 649 bp, Oryza sativa
aatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagatgaagccccgctaggatcgcccttttccgctgctgctgctttcgtttcggtgcgaggactaagtgcctcttttgtaagtattttacgctttatttacgtttggaactgtatattacttggtcgtttgtgtaccctggctggtcctggacagtgatttaatacacaaaatagtctagaaatttggactaaatttctgggcgtgacagtattccaagggtatcgtatttatttaatcctgcgggaagattataacagagagaactatactaataatttatatattacttgtaataatcaaagtataagcaggggttaagattataaatagggtagaatgacacacagcaagagaattatatactctcataataaattatctaagctaagtggg

SEQ ID NO: 73719 - DNA, 1237 bp, Oryza sativa
atagtctcatttgcataaatagcatttaataaatatttcagaatttaataaaacagtcagagtattaaattaaacaatattaatccaacgctatacaacataccctgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgaccataaccgcgggcacggctattcgaatagttttaactctagccagaggtgtaccactgtacccacaagacacaacctcaacatcatgtcaaccaagcgtcgcgatacttaacaagtacccgaatagagattgtgacaataccctctatataatacaatttaaagcagtgcaccgttcctggatcataatcacccccttataaacaaggcatggactccccagcgacccccgtgggcttatctccaccacttcacagcctggtgctctacaatgaaccatactatacagaaagtaaagccgttgctcacgctggcttgtggttggcatggttaatgtttcacaaccgaaaatcgtgaaccggtccttatttttcatgagcacgaccatcaaaaccatgtgctcacaacccaccattatcaggttttagttggcaaattaattaattaaccaatcacgattaaccatcgtgagctatcattaagccatcattaaataatagtgaatcataagttatcctaatagtgtgctaatgtttctaagcatggctaagcaattatgtctaatatctagctgaaccaatatataaagctcaactagtcaaattataataacccaaagtattaaggaatagagtaatcaagaacaaaagggctataacaaggcaataggttatttccacccaatgacattcaaaaataaatgcaatagttgaatagaaacaataactttaaacgggatcaacatgctcaaaggattgtttggaatctgtgtgacttgccttgctcgccttggaattcctcaaagtcttctcctgcaaaatcggactctccgggaacatcggaatctaaagagaaaagagcaaaaacactaaaacagcacataaacaagcataaaaagtacatgtggatatttttaacatgtagatctcaattttagaaaaatttagagacttgaaccaactaaat

SEQ ID NO: 73720 - DNA, 4285 bp, Oryza sativa
tggggtgaatagaagctacatctgtttcatcaatcagccacgatgtatatgacagatctgtcccccgacgtcataccctaggtaaacattgttactatcaaattgcgtagtcaattaatcgatttattacttaaccaatcttttgctcctgctttgcagacaacagagtcctcccctcctcaccaaagcaatagtggcaagaacattgagtatgcttcgggcttaattccaaatggaggtgggctatctccccctgttattggctactatgcccccaagacctcaactctccttcacggcctaactagagaaccagccgatgcaggcccaaaaaggaaaaccagatcctcggctgtgagcacttcaatcttggctccaaagaaaaaggccaagttcaagaaaaccaaaccgactgacaagccggccgatgatctgcccaccttggatccatctattgaacaagccttagatgaagagataattgaagacgaagttgatcaggccgcagctgaagtaagcgatactgaaagaacaccatcggcttcgcctaagcaaacccttccaactccttctgccccagtccacttctcaagggtaagtgtttctcgttaatccttttagtgattattttgtcttatagccgatcattcccaagtcttataattgcagaaaaagaagactgcggtgaagaagaaatcggctgcaacaacatctaaaccagctccaccagtaagatagatttaactttcattagttaatttttagccgattctatctgacacttgtctccctttcagccttcacctcctccttctccttttattcaacaatcatcaagtgatcagaccccttcagctgcagggagtcatcacgtcgaggaagaagaacaaccaactgctcctgctatcttagtaagtttcttttatcacaacaggcattcaaatcggctataatcgtttaacctctaatctgcttctaaattgttattgcaggcattggccgatcttttctctttcaatatcagagactatcttgatgaaggagaagaagatactacaagcaaagcattggctcctttatctgatgacgtgaagaaaactcaaggaagtattttggatcggctagaggcatcatcactagacagcttagtagttgactgtggctcaatcaggctcggctgcatgagattcaagccttaatcccggatgagttagccgacatccttactccagctgtttaccttgagcaacaccaattcaagctggagaaagccaagttaagattagtcgaacggcgagaatgtaagaacattgaagccactatccaagccagccgacaacttgtgcatgaagagaaatccaagcttgaccaattatctgaaggcccaatcaagtctaacattgatcggcttgaggctcacaagattgacctcttagcacaacttgaagaatgtaacgccgagctggatatggagcgcaagaagctagccgatctccccaagtctattgaagaacagaaagcaagacttaaatcggctatcaagcatgttgctgaactgaccaagtccctaaaagttatccctcgaaccgatgctcaagatgcccaagccatagaagaagtagagcagattaggcagaaggctatttcggccatctagcgatacttatctcagtagtctttatgtaataatacttaagacttttgtaatcggctaaaacattctgatactttattgtcttaacaaccctttgcgccgattaatatgactttgaaatttgctcaaaaaattttgtactgcatactgcattttgatatatatatgcccccctagttttacaatgtcaagagcattgataaaattataaaacagctaagggcgatataacaatatcggccattttacatcggcaaaccacaaccgattacattataaaaaaaactaagggcgatataacaatatcggccattgtacatcggcaaaccacaaccgattacattataaaaacaactaagggcgatataacaatatcggccatctcaaggcgatgtaaacacatcggctgtcacgcatcggcagtagtagccgatcatgcgttaacccacacacttgggtaatatttcttcaagtatttgccattgagcgctcgcccgtaaacttcaccatcaagcccttgcaacatatatgcccccttagacacaaacttatgaatttggaacggtccctcccaattcggcaaccacttgctaaatttactatcatgagtaccaatcggcaaaatcagcttccatacaagttcaccttccgaaaaatctttaggtacaactttcttattataatgccgagcaacacgttccttatccttagtaaccttcgcaagggctcgcaatcgtgactgaaccaaatcctccctctcatcagccataagattgtaatactcatctgctgtgaaatcgttttgcaactccgttcgtcgagagccgattctaacttcccatggtaaaacagcctcatgtccataaacaggtttgtaaggaggaacttggatcgatccatgacaagccatcctataagaccataatgcttcggccaatcgagtatgccattgccgaggataatcagaaatcttccgcttgatcaacttaatcaaactcttattagatgcctcggcttgcccattagcttgtgcataataaggtgaagaattcaacaacttgatacccacgctatcggcaaactgaataaactcatcggacacgaagattgaaccttgatccatagtgatagtttgaggaagaccaaatcgatagattatatgctcttgaacaaattgaatagcatcccccgaatcaactttcttcaaaggaatcgcttctacccacttggtgaaataatcagttgccaccaatataaatttatgccctttactcgatggtgggtttatcataccgataatgtcaatcccctaacctctaaattgccatggtttaataataggattcatagccgacgccggtgctcgctgaattgctccaaacttctgacaatcctgacaccccttataatatctgaataaatcttccagcattgtcggccaaaagtaccctgcacgccgaagcaaccacttcatcttgtgagccgattgatgagtaccacagatcccttcatgaacttcaccgattgcaaccttggcctgatcggcactcaagcacttaagtaataccccatcaatcgtccgataataaagctcatcatccaacagtgtatagttcaatgccttatatcgtaatttcctagaagccgattgagatggattactcaaatactgatgcacatcatacctccaatcatcggctgacattgctgcaatctcaactttaacatctttgatcatcggcttataccccgatgccccttgggccaaatcattagcttcaagattttgttctcgagatacatgcttcaaagtaaccagccaaaactctttcattagttccaggcacttctcattataaaccatcaatgtatcattcttgcattcatattctccagccaattggctgattactagataagaatcccccatgatttcaatagtatcgtgatatgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaactgatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacg

SEQ ID NO: 73721 - DNA, 4687 bp, Oryza sativa
cccctaagcactgcttcatattcagcttgattattagtcgcatacggtttgatagtataagcgaactcgaaagatgcccccctaggggaaattataactaagccgatgccacaaccatgagtgcacaccgatccatcaaagaatataaagtccatggtactatctccaccgagccgattgaatcgtcatgatgttccacaataaaatcagctatagcttgtcccttaatcgccttcggtgattcataccgaagatcaaactcagtcaaagaaaatatccatttcccaactcgtccctttaatattggagccgacagcatgtaactgactacatcggctttgcatataacagtgcactcgttagataataaataatgcctcaaccttgtacacgaaaaatacaggcacaagcacaacttttccacaggagaataccgagtctcagcatccaagagccgtcgactgagatagaacacaactcgctccttcccttccaattcttgaatcagaaccgagccgattgacctctcgccagccgataaatataacctaaacagtattcctttctgtggagggatcaaaacaggaggagagctgagatactccttgatattatccaaagctttttgctgctctgctccccaagtgaattgttgatcggcctttaacctcaataagggtgtaaaaggttccaaccttccagacaaattagaaatgaaccttctaacaaaatttatcttgccgatcatctcttgtagctccgtcttattttctgggggcttaattttcttgatcgcattaacgctcctttggttcacctcaatccccctttcatgaacaagaaatcccaaaaactggccagccgacacaccaaaagcacattttgttggattcatcttcaagccatacttcctggttctctcgaaaactttccttaaatcggctatgtggtcctccacttctttagacttaacaaccacatcgtcaatatagacttcaaccaaccagccgattaaatcatgatatatatagttcatggccctttgataagttgctccagcactctttaagccgaaagtcatgacaacccattcaaataagccgattgcaccaggacatctaaaagccgtcttatggatatctccctcggccataaagatctgattatatcctgcattcccatccataaaactcaaaaatttgttccctgacgcggcatcaaccagctgatcggctaccggcattggatattcgtcctttggtgtagctttattcaagtctcgaaaatcaatgcacaccctgaccttgccattctttttaataactggaactatgctagaaacccattcagcatatcggcagggacgaataaaaccagcatcatacaatcgtttaatctcagctttaacaggttcgagcatatcggctttacatctcctcggaggttgctgacgtggtctaacccctggccgatgttcaacgatcgatcggctaagtccgggcatctcatagtactcccaagcaaagcaatctctaaactcttttaggaactctatcagcttggttctaaactctggagacaaatttttgctaataaatatcggccttggccgatcgcctggacctatgtctatttcttccaaatcattggccgacataaaaccttgaccttgcttgtcattgagatcatctactgtatccttagcgtagacattcgaaccctccacaacgccctcaaagtaatagcttgggttctccatcttcgattggctgtatatcagaatcggacacttttagaaaatctccatcccagaattttccagataaacaatcaaggccatccatctcccaaagggctaaatcggcactggcaacattaactgacctgtcggctggcacgatctctatcttgttgccttgccattgaatcaagcattgatgcatagtcgaagggatgcaacagttggcatgaatccaatccctttcgagcaacaagttgtactaacccttcccatcgatgacaaaaaacgtggtaggaatagtcttgctgccgactgttagttccacatttggaacacctttggtctctgatggattaccaccaaagtctttgagcaccatatttatcttcataagatcctcggcgttcctacccagcttcctgaacgtagcataaggtatcaaattcaccgcggccccaccatcgaccatcatcttagacatcggcttcccgttgatgtagccatttacatacaatggtttaagatgccgattctctgtcccctcgggtttctcgaatactgcctgttctggtgacaagaccaacttagccgattcctcttccacctcatcaacatcggcctgatcgatccagaattcaggtggcaatgtaaagaccatattaatcggtgccgctataacactctttccttttgccaacttcttcacttcattggctgcagcatcatcggctacgggaacctgattcttgacacgccactcctgtcttggctttggtttcctcagccaatggttgatttcctcttcaacctcctgaaaacgttccctgctcctcaatctctggaccctccttttctgattcttcgtgaaaataccagaaggacaccattgattcttcctgatcacctcatcctcttggccacgatcttgattcatcggacccaacctttgatgaacagggagtcttgtctgtctcagccgatcatccctattacgtggtcggcttgagctctcgatgatatcactgcacccaggacagttttcaatagatggcaacctcatcccttcattccagcagaatctgaagaactcgcaaccccaatgaggatcaaaaccatcatcgtactcctcataacgcctctcctgctgcttatcatacttcctctgatacttgttgataatcttagccgaatttacttgaaaaccctttgcatggtccctatcggttgcttgaccagctgtatgcaccatattaacgggaaaaggattcccatcgaccttcatcggcttcttggaatcatcaaacttaatctttcccccctcaatggcaacctggatttgctgtctaaagaccttacaatcattggtagaatgagacctggaattatgccatttgcaatatctcttcttgcctaattcctcagccgatgggatcgtatgaccagcaggaagctgaatctgcttttctcggagtagcaaatcgaaaatcttgtcagctttggtgatatcaaaatcatacttctcctctttcccaggactttttacccattggcatggtataacctttttgctcctcacccattcggctgcagctatctcagaatcatcttcttcgtcatccgacccatacatatatggacaaacgtgattaactttcttagagcttttcctgacttccgctgacctatgctcatgcaaggtcaccttctgtatcaggtgcgataagctatcgaagtcttcggatgagaatttctccctgattggagggacataccctggaaagccaaatcggctaactgagcatcggtcaaactcaagctaaagcacttgttcctcatctttctgaacctttgaatatactcgtgcatgggttcatcatgccgctgcttgatcgctgtcaagtcggacaacttcatctcatggaccccgctgtagaaatagctgtggaattgcttctccaaatcggcccaactattgatcgacccatacggcaaagaagaaaaccaagtaaaagctgatccggacagagataaccgaaacaaccaaactctcaaggcgtctacagccgatgcttcaccccactgagcaaggaatcggctgatgtgctcataagttgacacgccctcttgtcccaaaaacttggagaaatctggaactttaaaccgattgggaagaggaactctttcaaaccactcagggtaaggctgccgatacaaacttctagtttcttttggtttaagtccaaactgctccctcatcacatcggcaatcacatcggcccatggtcattgctgagctgctccttgcggttgttgctgcatgggctcgaattgaccaaactgaggtgcgaactggggctgagccaatccccctggctgatattgggcttgcggggaaggaggctgatactgatagctcaagttacccccttggtaattatgaagattcggctggatgttgcgtaccaagtgctcagggaccatctgaggcaccacagtgccatccggctgtgcatggtgaaccaaatgctctgagacaacttggtttacaaattgctgcgcaggttgcccaccaggtgctgcgaacccagctgatgcattggccgaccccgggtgctgaatcagctgaacgatctgctgtcgcacctgagtctgttggatcggctgaagccgctgccttggcagtgtttgctgaatcggttggataggctgctgtgttgatggtgtttgctgagctggttgtacgacctattgttggatcggctgtacaactggctggattggtagtgtctgctgaatcggctgctgctgcactggatcaacaataggtggaggtggcaaaaacatggcagcaacctgatcatgggtcggcggattcgcgatctgcccagtaggctgtggatgctccctcattaacaaccgaggggggtaccgagctcgaattcgccc

SEQ ID NO: 73722 - DNA, 2075 bp, Oryza sativa
tgaaccaaatgctctgagacaacttggtttacaaattgctgcgcaggttgcccaccaggtgctgcgaacccagctgatgcattggccgaccccgggtgctgaatcagctgaacgatctgctgtcgcacctgagtctgttggatcggctgaagccgctgccttggcagtgtttgctgaatcggttggataggctgctgtgttgatggtgtttgctgagctggttgtacgacctattgttggatcggctgtacaactggctggattggtagtgtctgctgaatcggctgctgctgcactggatcaacaataggtggaggtggcaaaaacatggcagcaacctgatcatgggtcggcggattcgcgatctgcccagtaggctgtggatgctccctcattaacaaccgagggttcatcggctggcctagcgccatagctgatgtagcgggcaagggagttgatgttggcgccgttggctgagttgtgggtgcaatagagggaaccgcttgcacagctggttgaacatcgatgaccagagatcgataattcgggaagacacctccttgcaagtaaaccgggcccgtagcctgatgcttagctatcgaaccatcggctattgtcttcatcatgtttgacaatgtattgactaaaaccccggactgattgatcagagcatgatgcacagtgtaatcaacccgatcttgaaagttgttgaaaaagtcttgtgctagctcattattctgattaagatttcctccttgcgacccttgagcagcatcaccttgagctccgtgcactccttgagggttgtcgccttgatttcctagagaaccatcagtagcacctttgttgctcggctgagccgagccttctggagcttgcttcacctctccatctttagaagaaccggttccaggactatcagcaaccacatttatcttatacttctgaacaagcgttcccttgcgggtttgcatgaacgagctcagatactgatcccgtgcttgctgcatcattgcttcaaactcctgcttctgctcaggcgtgaatttctctggattgattggcatgacattgtcatcaatgatgtcagtcaatcctggcttcaatgccttgcctttaatggaacctgggcttgatggtggtggtgcttgtttctcggccatgaggaagaactgacgtctgacttctaatcaagtcccactgggcgtgccaaaagcgtgttgacagaaaacacgtggcctgggagatctgcttaactccagtgcaggtccaaaactcgccttcggatgtattagcgtgccagttgatttgattctgtaatcaacaagaaataaaagcaacgaaaccgtggttaaatctataaatgatagccgatcggctagatgccgatgacatatcatttatctttgggccgatgtcatctgtgtatcgatcggcagtcatgaataagtaaataaacactaaatctactcgatcggctgtagatgttaacgatatatactccttatattggtatatacttaaatcgagtgattggcatagatcggacaccatgctgagacagtataaatcacttagatcgaaatatatatcaataacaggattatatatgtttatagcgtagccgatcagatagatctagcgtgtatcggctaatactccgatactacctcatatcaggatattaaagcaggtataatatatcaaacaaagccctaacatatttagatgcagcaatatcttgatagcaagggcagatttagcatatcgatgagacatgtagaataaatatggctaaatcagatacgatcggctgaaaccccgatgctattcttatcggcaactagaaggcaggccagagatcgatattctaaacacgacttaatagatcaaactcaactgatgcagcattaagtatgaaaagaagaaccatatctagacaatcaagccgctagcagtttcatagaatggtagatatcttatataatctagatcaacatcaagatctaacctaatcggctgccttctgcatacagatattgaccgatagtagtttagatggcgatatcgttaga

SEQ ID NO: 73723 - DNA, 3429 bp, Oryza sativa
gggcggaattatctcttgaacaccaatggaagtttgcggtgcgagagattgctacgtactggttcgggaaccagtgagcgagtagaattatctctcgaacaccaatggaagtctgcggtgcgagagattgctacgtactggttcgagaaccagcgagcgagtagaattatctctcgaacatcaatgaaagcgctagagttggtttattacatgtgcatctcatgtggccagcatgactcacatacccaacttatagcatatccggaagtccgttcgcaatcatgtcgggtgatcaagccgacgccgttcgcgaggaattatccgttaacaaccttttctcgagtagtccagccatggccggtgctatgagataagtcgtcaatcttcgttggtaggttggacgcgacgactctgtatttgtcgagatcgttctcgataatgcggtgtagtcgaccacaacctactcgagtgctcaattattcctgaaaaatattttctagaaggcaagacatatagcagagaatatcgagtatgtactaaaaaactgcatggatcttctagcattatcaggatataacgagcagatgtaattatcaggcattatgtaaaccgtaaacaagcatgatttatacagaagaaaacagagcgagtccccaatgttagaccgtagtcagtttaacatcgggaacacttgcacaacagatattgtataaaaaacatgctctaggtaaacataataaattactgatctgacaatattgtatgaatctagaaaacaggtacgataaaaaatattgcgtacctttgtagatacatgccggatgtatatacggaattagtagattaatttaaaataattaatctgctaattacctttgttcatgtgttaattggtctgacacatgcgacatgtgtgtagacgtgtcaaggagctgtccagtagttttgctcctggttcatggttgcgtaacctagtcggtttcctttaggcttcggtacagcatatcccgtcgtgtccgacaactcgttggactcggtcggcgcctcggccgcggtatgtgtttatatgtaaaccaaaaggaaccaacaaaaagcacataagcagtactaaaagacaaaaccgatataattatgattagaatcagatttagaacggttaacctgttaacgatggatttcaagatttcggcggtggacgtcggctcggatgtggttggaacggagcaagatctcgtggctgacgacgctgaaccgatgtcctccgcggtatctcccaaagctgaagtcgagagtttcttgtcgggaaatccatctcttaaacccatctcatcaaaatcttgaagcaccaaaatcctcctacctggcgtgccattgttgacgtttgatgtcgcgattctggtatttgcatagtatggggatcgtcggtactaggatatatgcgagattgaggtaaaagagacagagatagggatttttatacaggttcgggcccctgaattgtcagttaataaccctacatcctgttggccggagccggtgttgctcttattcactataatcacaccagtacaatatttggacagcctatctaactgttgtcaacatggcggtctgaaggtctgactcgtagtcgacaacagggtagtcttcctcctcgaatccgtgcccggcgagatcaaagatagcgctttcgtctctcctgacagtatctagagataccgtaggggactagtcgtgcttatccctgaagtcgatatccggcgtcttgtcttggcgtatgttggcttgtatgttgttccgtagattgtggtgggtgttgattgtggtgatcttgtcccctctcctcctaggggtcttgtatttatacccatatgtaggaatgaaaacggatcaaatacggtcggaaactagctttatcatattcgttttcatattttttctcggaatcaaaatcggaatcggaaacccggatacgaaaacagaatcaaaaattatcgaatacagatacggagcgaatacaaatcgaaacgaatacggtaacgaatattaatcggaacataaaagtccctcaaactgaccttcacaaatcaatgaagaaatataactcgttactttttctaatagaacatatcaacattttcaaattttagtgttaataattttgttatatccgattttgtggttgaggaagatgattcaatctaagagtaagacattatgaggcaaaatcatgtcaataaattggatgattgtttttttctaaatatttctaaaatcatgttctatcgagttattgtgttcttactgcaactagtttttgataaccttttcacatgagttcatttagtatcataaaatttaattcaaagttgagggacatcatatagacttaatagctaattcttaggcccgttggcccagggatatataaacctatccctagtttctcccgcctcccaatctcccacacctcccaatctcctctcagccgccgcccttcctcccgggctcccggctcccgcgagacgccaccacgggggcggggcccgcgtgtggcggacggcgacggcgacggcgacgacgggggctgggccgcgtgcggcgaatggcgacggcgacatcgggggcggtgccgcgtagggcggatggcgacggcggttgctcggcggcgcgaggcgacgacttgcggcttgcggcgacgagcgtaaccggccgcgccgccgtcggggcggccgggtcacggcgacggccagcgcgaggcgacgtcgtgtgggtgcggcggacggcaacgccggcctcggggcggccggatccggggttggcggccctggagccgcgggatccgacgtcgtgaggcgacgacgacggagggggctcggcggcgcgaggggacggcgtgcggcggacggcgacgagcggatccggcgtgcgacgtgcgacggcaacggcgggaactcggcggcgcgaagcgacggcgtgcggcggacggcgacgagcttttttcaatgttttaatttggatttttctgtttattatgattcggatatccggcaaaaacggtcggatagtttccgaccgaatccgagttctgacggataccatcgctactgtatttgaattcgtatccgagaaaaactatccgaattcgtatccgaatccgaaaatatctgaaaaaatccgaccgcaacaatccgcatccgaaaaacaggatcggaactcggaaattatccgtaccacttttatccctacccataggtgtccccttgtccaagtagaactagggaaacctatatggatataatctgagtagtccttgtcgtttccatgtagaactctagttgtctttccttattcggaactccatccatatctgaggtcggtttccgtataagacatggtatgtggtgtgttctgccgagatgtagtcaa

SEQ ID NO: 73724 - DNA, 3715 bp, Oryza sativa
tatcggctaatactccgatactacctcatatcaggatattaaagcaggtataatatatcaaacaaagccctaacatatttagatgcagcaatatcttgatagcaagggcagatttagcatatcgatgagacatgtagaataaatatggctaaatcagatacgatcggctgaaaccccgatgctattcttatcggcaactagaaggcaggccagagatcgatattctaaacacgacttaatagatcaaactcaactgatgcagcattaagtatgaaaagaagaaccatatctagacaatcaagccgctagcagtttcatagaatggtagatatcttatataatctagatcaacatcaagatctaacctaatcggctgccttctgcatacagatattgaccgatagtagtttagatggcgatatcgttagagattatataaggtatatgataacttgatgaattacataaacaggactagagtgtcatgaggatggaagcactaatcctaagaacgcaatccatcacgacgaatgttacctcttgttgtagatcgaaatcgatgcagctcaacctgaaagcaagaactcgtcgaaataaaactaaagcaaaaggatggcgatgtgcagagattgtattgaacatgtgtattaaaaattacatagggctcggggtctatttatacccgaggattacaagatatgcccataccggacacgactattatctctaacaaactctaagataccataagtctttacggcagacttttgtctataaggaatttacataaaatatcctaattaatagatacaattgccttcccaggactctatccatgcgtggcaatcatcttgaagtacattaacttgaacccgatgtcgcgtacaagtcgtattgtcggaatcggctacatcgacttacccaacacgactcagacccagccgatcttatcgtagccgatctggatttcagccgattcctgctctgctttcaaacccgatttcctcttccgactttgcttcaatctactcttctctcccgacgctgatgttacccaaattcggttgttaacaggaacgcacacgtggaaggccaggatcaaaggcgccggtggtggttcggccaaaccttgggccccacctcctggccttccctttggccaggagactgactggtgggccctgatggcggttatgacagttatgacgcattccatggcggtttcacctgacttatgggcccttcaatccgtgtacttgcgtctaattggccagaggtgtgtttccttgcatgactggtgtgttttctcattaaaatacccgcatacacatatttcaccaacactagtggaattgggtagtaataatccctaccactaagttgaataccatattttatttcattattttatttcattatatgcaggtattgacggtcaaatattatgatttaaagaccatcaacatttggcctaatttgtggtcccatcaatccgtgtgctcacacgtgattcgctggtggtgtgtttctttgcatgccagcttcatttctcattcactttggtgtataatctccgcattcatgttaattctcttagtctagtacaactacattatttattattgatatacgtataagaaatgttaattttccctttattcattgtatacgtatgtcacgcccagaagttcttctccttagcaaaaattcaattaataaattgttgcaagaaattatttgtttaaaggcaagagagaaaccctaaattaataaatgcatttaataatcggaatcggcatgtgaaatttttcttagattctacatgctctactacattaacaggatttttagtggaattttcagagccttggaaataattttaaccaattaaaataagcaaagtgcaatattaaatccctgggaaaatcctttttcccttttctcttttctttttcctcctttttccttttcttgggccgtcggcccattccttcccgcgccggcccgcttctcccctccccgaagtcctccctccctccctctctccttcgggcgccgacaggtggggcccacctgtcggtcgtcttcctcctctagccgttggagccgtagctccaaccgccggcgccccacctcctccactccgcatctgcgccccaccccacacccacgtcgccggctcgccgcccgcttccccctcctctcccgcacgcgcgagccccgcaagggcgggattcggtttcaatcccccccccccaaactctctctccccactcccccacgtcggcgagaaatccggcctcctcccggcctcgtccgtccctcccgagcccatataaaccatccccgcattctcctcctccatgtcctttatccatcagccgctccgtagctctccatcgctcccgcaccgatacaccagccgccgccgccttttccactcctccggccaccgctcaccattgctagcaccgccgtcgggttcgcacggctgaggtccacctcgtccgccgctcccccgtccaattccgtcaccggagcccgcatctcctcgcactccggcgagcttccaccattgccgccgccttcggccctagttttcgctcgccgcggacctcccttctccctctaatctctcttattttgacaactaggtggttccggacctcgttcggcacttgccgccatctcccggtcgttcgccatcgccgttcgtcgtcccttcttcccgcgccggccaaccccatggtgagaactccctgtcctccctctttctctccctcccgtgtccactgccatccaccgcgtgcgcgccattgccttcggccgacgccgacgccttccgcgccgttcgccgccgccggttgccatcgccggcgaccgtgcaccgccgccgctcgctgtagccggccggccggcttggagccgagccgagcccggcagacgtcgcccctccccctttttggagccgcggccggtggggcccgcctgctagtaccccctccctctcccttgtgcctccgacccttgggtcccgcctgtcggcgccgccccaccccttggatgatgtcagccctaggatgctttattgcacaataaatcaataaggcttttctttaatagtaaaaacacaaataatcttctaaaaatcatatctaattcatccgagctccgtttaaatccattcaagtcttagtaaattcataaaaatgcatagaatccattaaaaatggttttgtttcctgtttcagtagacttatagcatgttttgcttgtgtgctttgtttgttgcgtagatttcggtcgttccgtcgatccgcggtttctcgaagacgttgctgtggtctcatcagtgcgagagcaaggcaagtcatgcattagattgatcatattgtacccaatttacaagtgtcccgcatttctattaaatgttgcattgttttacaatatcatgtgggatgggtcctaccactcagccatatcttgtttaccttatgccattgatgataacttgggtatttgttgatagaaaacacgtggcctgggagatctgcttaactccagtgcaggtccaaagctcgccttcggatgtgttagcgtgccagttgatttgatcctgtaatcaacaagaaatagaagcaaagaaaccgcggttaaatctataaatgatagccgatcggctagatgccgatgacatatcatttatctttgagcc

SEQ ID NO: 73725 - DNA, 6183 bp, Oryza sativa
ccggatggaaaaaaacagcgaaaaaagcggcaacaacaaaaaaaaaaacggagcaaaagaaatctgatgaaaaaaagcggaaaaaaccgaatcgaaaaaaaaaacagcgaaaagaaggagacgatagaaaagataaatataaaattagaaattaactcaaacacggatggcgtaccaaaatcccgacggaaatatctttaatttttataatagtaaagaagagatagagatagagatagagataaagataaagataaatataaagatttttgatttccaggatcgtaagattagatttatctgatttcctatttttaaggtcgttagattatatttgtgatttttatttttagagtcggtatgtcaggtgggacttaaaaaacactataaaaatattttttaagtaggtaaagttacggagaaatatatgagcctaactcaaattagcccccacaggagatatgccaacaaatgcatgcggaagtcagggcaaggctcgtgcgttctcattaggatgacctacttccaccaagtttctttgcatgaaggcagctgcagaagcgacccagcaaccacccaaatctccatacggtatggtcgatctcgatcatgcatgttgaagaagaccaacgatgaccggagtagtagctgactgccctgactctgcttgatttgctatgccacctacggtttggaagattcagagaaatatcccttttacttgtacatgtactaataattgtcgacatgcaaatgcaagtggttgctgttcgtttgtggcacaaacaaagttgttgaggtattattgaaatcaatatttgctataggatatactccctccgttcctaaaatactattattttaactagtcgaaggcaaaataaataaaattgtaaaagattactatgcccttcattagattttattagataatggaaatggattacatctccgacttctatcataagacacataaccataagtttgtttaatataaaataaatcaaaatgagaaataagatgatgggacaaatccccaactcccctttattattgatagattttttagctagcaattctaatgaaactagaccacacatagtgatagtgaagtaagagacccttgactaccgattacaagagtgtaataccgatgtatattatcatgttcttcctcgtgtgatagcatcgtaaactaaaagtaaagtcaataagaatatatgaagataacccgcgtagggttagataattgtttatcattatggcaacatcaaattgaccaagatacaacactagcttcaattagaataatatttttaatggatctagatacctctctaagccaattaccaaaaatatttttgatgttacggggtggagggatattaaaagaaaaaaacacacatctcaaaacaaactgagcaacgtaacattaaaaaaaagatgttggattgtctcttgtccataacagacagaatagtgtttgcctccttctattttcttttatccagtttatatctttcgttagaattactttctttagtggaacgtacatatcgataatgagccgtctttgatgattttgtaagtctcaagatatgccggctgagcttttagagatgctcgtaagggtatgacgtgtgttagtaaggattagtgtgcatacggttagacgagcatttgtgtctgtgtttgtactgtgtttcatcgaaaaaaaaaagagaaagggataaaacaaagagggagtatggcgtgtgttcgtacaggttagcgtgctgtttatatgagcgttgtattgttttggggaaaaatataagcagagggggataaaacaataaggagtactactgattaagtggttaattaaaggaaagagtatgaattaccccctaacaatcgcaacaatacgaattaccctcgtaaatcacaaaaccagacatttgacaccccaaactattgaaaccggataaattactcccttggctaaatctgaagtggttttggtgctatgtggcatacacgtgatgttaatctggcaatccaataaaaaataataataataactatgggcccatttctcatatactcctacctcacccctttctcttctctctctgatgctgggggcgcggcatgcagggcgagcggtggccggagggcactgtggacgtggagcaccggtgttggtgcccgcgtctgtggtgggtgcagtggcggtgttgcggggagatatggaggtgcgccagaggcggacgatggtgaggaaggccgccaccgttgttcccccattcccctatccgtctcttatgactccctcccctttcttgcagtgcggcggtggcggtggtttgggcggaaaacgccacgggcaggaaggtcgccaccgttgccgccacctttgcacgggggcgagctctcggccactgggggcgtggtgatcgtggaaggaggaaggggaatgggcgaggaggcagacacgcgaacgggatcgtgctggcgtgctacaccgcggtcctcgacgagccaggcgcgcccccgcgcgacaccagttctgcttccgccgccgcctgcctggtccgcctccgccactacagtcggccgcccaagcgtgtgcgagagagagaaagagcgaccggggaaagattgggttgagggagaagaatggcaagtgggcttggagagttttatttgtttttttactgactggattgccacgttggcaccacgtgtgcaagctcaagttgaaaccactcaaaatagtgttaaggggggttatttgtccggtatgaatagttgaggatgtaaaatgtctggtattttagtttggggtgtaattgggtcaaccacaataatttgatggggggaaataattcgtatttttttccttcattaaaagagaagaaaagggtaagcagtagcaagaggttcggcagacctcactctaaaaatagtctttgtgaaacaaaacttgaagctgaaacgacagtctctagggtacagaggaagagtaactaattaacatctagtactaataatttagctgtccccactccccactagctagttccttcttgcacatttccattccaccaaaccaacttccagacaaagatggatcgattattggttgaagctcagaggaggctacgcttgctttatacaagtgctggagctgctattgcattttgagcatcgagcagccgcggtaccccaattctcgggcctcaccaaacgcagaaaacacacattatatactgcattcgtgtcagtaatacaatggcaaagaacctgtcaatctccgttcagctgcttctcgtcctcttcgttttactcgcttttgccagcggcatcctcgcacaaggtggaccaagcacctgcacggacaatcgtaagctaccactgctgctatttctttacttctttttttctaaatagacgaaagaaggtttaatttgctgcataaattacgatcttaatttcgcctttctagctaattaaagttctttgctcgtcatttctggcagctgtgcagcaagattgcccgccaatccctggtagagggaactaataattaattaatgttgccaccggatccatgcatggatggacgatgcggagaaatatataattgatcacgtgccatatagtagtatttctacgcagcaagtttactacggagtactttctcagtcaataaaacccatttctggatttgaatatagatatagtgttgatgtgtttttgccgtgcgttgcttgtaatgatttgctttaccaatataaataatataacggacagtataactgcccgaggagatattgtatccggtaataagtaaatgtatattcaccatctggtgtccaacaccgccaagttatatattcactgtggggaagagctctttagtcctggtttgtaacctcttttagtcatgggttacaaaccgggacacccaatccaggactaaagatgataacgctaccatccttagtcccggtgttaccaactgaaactaatttttttttcttttttctattgttttttttctacttgcatctatttatttcaagcaccaatgctgtcacccccaattcctgacaaatcatccacaacaaatcatccaccataggtccatccccaaaataatccgcgttccacaagtcattcaaaaaatcatccctaaatctaaaaatatctacaacaaaatttacaaatcattcacaaaatctaacaaaaatctagaaagccacagccgccggcgggcgcctggccatgcgccgcctcccatcccgccgccgcggctgcttccgccacctggcggcctcccctcccgccggatctggtggaggggagagccgccgcccgccgtcgctatcgtcgaaggaggggggagggggtggagaggggaaggggaggagggggaggatgaggatgagaaaatgagaggggaggaggagaggatgagcagataaggacgaggcgcgtggctcggtgcatagctcggggcaactgttcatggttttttttaattttggtcccggttggtataaataactgggactaaagataatagggtctgacatgtttttcaaccaggattaaaaatgataagtaccctaggttactactcgaatcaggactaatgtgatttttgcatgaccaagcaaatatcacttctccagtagtgatttcatcctactcaatgtcacgatgcactttctgaaatgaccatggatcataattggatcaacttactttgtaccgggctctttctagtgcccacgtactgtctctagatagcgtcttgccatcaagtgcttttgtcggtgcacggtttaggaggaagactgtcgtaatcacaggctcaccctacaacttcataggcaagtcgtgttcggttcagcagctggctatgcaccatcgccacgatgctctggtctcacttctcaacgatgttgtttactccctgttggaggcatgccatgaagcctttcggccggacctgccgaaaccatagtaccagcagggattcaagccaaagacgtcaagaccattcgggcgaagccctatggcgaaagccataagcgaagctggcgaaggctggaaagccgcatcggtactccgcaagtaaaggcatctcgggcgaagggcatacggtgaactacaaatacttcgccatgacgagttcggcattaaggaggcccagcaggctgcccccgacctttaaggccccttcgccatagaccaggcccagcctatcggcccattaaaggcccatatatgcaaatgacaccgtgtacccatataaatatccctttcataagggcaaccatgtaaaatcccctgtaaacctaaaccctaggaggtgtaagcctgtgctaaggttataaatagacccctagggccatgtaatgggggatcccaataaattttataaatcaatacacttattgcttttccaacactgttgagcaaccacgtccttcgacgtgacgcagttgtccattcgacaacagctggcgccgtccgtggggaacccagactaaaaggctgaaatgggagccttttgccacacccacacccttcgccatgttaccaataaggtacgacgtcaagggctgtgggcgaacaggttttgccacacctaggcccttcgccgcaataccaataaggtaaggcgtcaagggctgggggcgaataggttccgccatacccagacccttcgccacagtaccagtaaggtatggcgtcaagggctgcgggcgaagagatttcgccacacgtcacacccttcaccacaataccaataaggtacggcgtcaagggctgggggcgaataggttccgccacacccagacccttcgccacaataccaataaggtgcggcgtcaagggctgcggatgaacaggtttcgcccgcccacgcccttcgccatagtgctaataaggtacgacgtcaagggctgggggtgaataggtttttccatacccaagcccttcgccacagtaccaatgaggtacggcgccaagggcttggggcgaaaatgagtcaggaccagagacgaaaataggggccgcgaagccaaactagcctgtggacacctttcgccacaataccaataaggtacggcgtcaagggctgcgggcgaagaggtttcgccacacgccacgcccttcgccata

SEQ ID NO: 73726 - DNA, 782 bp, Oryza sativa
attatgtttctagggtatcctctagactttcgctctacaagttacatctctagagctatgggtttgtttggaaagagactacttgcaggaggttgatgctatccctggtcgtgttctgtgcaggcatattttgatggtgttgatttggtccaaggaagaattgttcttaaatagattcctaatcatggtggtcaaggggaatcgcggacctttggagtgcttaacttaaataataagtttgctaatccacaaccgcaagatgaagatttgccccctattggtgtacgccaccatcaccaggccccactcaacatcaaggtgcagcttgggatgatattaatgagcagcaagaggatgtagggggatgggataactaggatcaacaggctaagaatcaggggactggtcagtctggtataagctcacatggaggaagtgaaaatatgcagatcataatgttggctgacaatactaaatattttccacagttttctataacacctgagatgcaggagaagattgatgagttccttttgagggtgaaacttttgagctctttgcaaaatagagcccccatcccaatgcccattcaaatagctgctcttttcaatccgctcctttccctaaaaggaaagctatcactgactgttctccacctgttattaaaagggacaacgtgggtgaggcctcaagttgggccatggaaaaaaagtctattagtggctgatgatgtcatgcatgctttaggggatctaatgatttcctcttagttcccctggcta

SEQ ID NO: 73727 - DNA, 21711 bp, Oryza sativa
acacgccacgcccttcgccatagtaccaataaggcacgtcatcaaaggctgcgggtgaacaggtttcgtccgtgacgcccttcgccatagtgccaataaggcacagcgtcaagggttgcgggcgataggtttcgcccgcccacgcctttcgccatagtgccaataaggcacgatgtcaagggctgcaggcgaataggtttcgcccacccacgcccttcgccatagtaccaataaggtacggcgtcaagggctacgggcgaagaggtttcgcgacacctaggcccttcgccacaataccaataaggcacggcgtcaagggctgcgggcgactaggtttcgccacacgccacgcccttcgccacaataccaataaggtacggcgacaagggctgggggcgaataggttccaccacacacagacccttcgccgcaataccattaaggtgcggcatcaagggctgcgggcgaacaggtttcgcccgcccaagcccttcgccatagtgccaataaggtacagcgtcaagggctgggggtgaatacgtttcgtcacacccaggcccttcgccacagtaccaatgaggtacggcgccaagggctgggggcgaaaatgagtaggaccagaggcgaaaataagggctgtgtaacaccctgaaaattcccgacaacaaaaaaaaatcactaaaattttgaacttttataacttgtgcatcatgctggttgttatggttgatattgcttgccaaaatgtaaataatcacaaagaaagcaaatccaaacaaagggacggttaattactaatttaatttgtagatcaaatattaaatattcgaaccatgctgatagcttgatgccatgattaactaaaagaaacagtaaattcaaatctaattcatttggatccattctcacatgaaatataagaacacatgaaatgatgatcaccactataatgatcgttttttataaataagtaattcaccagaatatatagattgatacttagaacacttcaccaagttcctgatgacatgaaaatcactcatataaaataatggtcatataaataaattaagctttatatataaacaagaatatgtgaatgtttaattaaacaattagattaatgttgtatcgagtctcaaattatatttatagaatgactagatccacgtaaaatacattgttatacaaataagttcattcaatgtgctattgtaataataatagccacattaggatattttaattaattttagaaccctcaaagcctccaaaattatctaggttaattttggaattagacctcatctaaataatgcaataggaatatatatatatatatatggataatattaaacattgagtaaactttcatctaaattaacagttgagtgacctggctcataacagttgaaacatacctgctgctcccttccactactgttatcttcttgaggctggttctgctgaactggcactgattgagtagcttgctcaatgttaacttcattgcttgcattagtctctgaattgatctcacaactgatgttcaactgttgcgactgtccttgacctgcagaagaagattcacccatttggagtggcttgatacgctgcctctgcctcctggaaaacagtcattcttctcttacggttgtccatcctgttcttcttgtcttcaagtcgaattgctttgtcaaccaactgctgaaaatcagaatagtcatgagagatcaacttaactgacagttcatcctttagaccttccaagaacttctcctgcctttccttgtcagtacgcacatcttctagagcataacgtgctagacggttgaactcatgaagatactctgtcacggtatgatccttttgcttcaatgtcctgaactcacgtttcttcaaagtaaccactcctgcaggtatgtgtgtcttcctgaatccttcgatgaactcttcccaagtgattggttgtccttttgctctgttcatccgaaagtgatcccaccattctgaagctggtccttgcaactgatgtgaagtgaaaacaactttctcctggtttgtgcactggagcaataccaacttcttctcaataatgtgtagccaatcaccagcttccactgggttggtagtgctagaaaaggtaggcggcctcacacgaagaaaattagctaacttgttttgaggcggcggaggattgacattattgttcccttgctggttctgcacttgttgcactaacatgttgatcaattgggtctgttgagccagcacttgagcaagggttgggttctcttcattgttattgttttcgcttctactggcgcgagtgttcaccatttgttgcatattagagaagatagaaggagaggggttacactagagttaagaccttaaccaggttaccactgatctggtgtgtgtagaccattatattgttcaagttgattaagcaagcaaccttgtatagttacacgctcatcattgaaccacaccaatgacgagaatgcaaccatacctacacacaagcaagcaacaaacattctaccctactaactattcttccacgacagtttggcggcgtaggttctaaggtaggatgcaaacttcattccatcttgacatctgggcactttagatcgaccattaccttcttattcgtcgatccacttgacttaacctccataagtagaccacattggcgtcttcaagtttcaacaactagtttcagaactactcaagttgaaagagagaggggagtagacaatgaaacaatttgcaaagaattctagataaggaagaaaggagaaattttcacaaatcatgtttttgggaaattagtccttaaggtttgaccatttggcttatcctacagtcgagatggctctgataccaacttgtcacgcccagaaattcactagtaatttctgaacttatttgtgcattaaatcctcgtctaggaatcagccgaggtacacaaactgacaatttaatatacagattcatcataataataacgttacatacttacaaaataaaagaaaaacagcagtggaattacggtctagcgaagctccggctccactcccacaggcagctcaactggggtataagacaaacgtcttctccttcgcaacttgtcttcaactgaggtttgattgattattgcaaggtgagcatatgacatactcagcaagccacacagcaaatatgcaagtgcacaaggataccaaagaatggcataatatatggctcatttgcaaaagcagcatttagcaaacatttgggaattataaaacagtagagtaattaatcatcaattttaatcaacactgaacagcacacccatgctgctcaggcccaaccatcctgaacaaccatacccggctgcacagatctatctccaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctggccagaggtgtaccactgtacccacaagacacgattccacacatgttaccatgccctgaagtaccaccacggcactgcagtggtggtggaaatcgcgacagtacccttcgcacaacacaactcaaagcagtgcaccattcctagatcataatcacccccttataaaacaaggcatggactccccagcgacccccgtgggcttatctccgccacttctcagtctggtgctccgcaatgaaccatgctatataaaagataaagccgttgcccatgctggcttgtggttggcacggttaatgtttcacaaccgaaactcgtgaaccggtccttaattgtcatgagcacgaccatcaaaaccatgtgctcacaacccaccattatcaagttttaattggcaagtaattaattaaccaatcacgattgaccatcgtgagcttccattaaatatccataagtgatagtgaaacatgatttatcccattagtgagctattgtttctaagcatggctaagcatctattataagcatctgtgtgacttgccttgcaataatcggtcttcaattaatcttcttgaatacttccggcgcacacgcgaacctttgcaacgacggaaacgacaagctaacacgcaaaatgaggaaaacacagagaaactccaaataaacagtacataaaagtaaacaaacatgtagatcatgattttagatgaatttagagacttgaacggtctcattccgatttcctatgaattaaatacgaattttacaagatttaatctaattaaagcccatttaaaaaaaattaaataaatttaattcaatttatggataattttaatatatggatctttattttatacaacttttgcaacttgaaccacattaaactgagttacagagaattagttatgaattttcaaagattaaatcggattaaatcctttatatagattttaattgaattatgacgcaataatgaattatttttgaaaaggaaaagaggattattgcgtcagcggctcgggttcacggtgaaccggttgcacagaggcggtctacggaacggacggccaagaacaaccctatccaaaatggacggccgagatcgacttgatctactgccggtctacgggaaacggcgacgatgacgtcagtggtgacgtcaccaccggcggcggctcgggcgcgcatgctcgccagcgaacgacggtgcggcggcgcaaacggagagcatctacgggtagcgggcgacacggcgaactcaccggtgacccaaacgacggcgaacgacaaccggatggcaacgattacgaggttgaaacggcggcgacgatcgggttgacgacgacagcggtgctccggcgatcttcggcggaaacggaggggtggacgaggacggcgacggcttggcgatcacgatggcggccttcccgagcgacgacgatgaccagagcggcggcgtcgcacggctggacttgcggcggcgacggcggcgcacgggtgaacgcggagacggcactacaagcggcggcgagctaaggcgagggtggcggtgggtagaggaggtcccaggggtccttttataggggctaggaggcggcgacggaggcccacggcggccggcagcgagaaggaaagattagggttcgggagagagagaggaatccgattcgagatcgaatccggcactttccaagcgattttagccgatgattccaaaagagaaaagatagaggggatcccggagattatttcccctcaatcaattcgggcggagaaggaaagaggcgacggaattggaagggcggcggcggcgcggctcggctagggttcgggcgagcgacggcgcgaggtagacgacgggcctgacaggtgggccccacctgtcagcggctgagagagaggagggagggcgcggcgaattgggctggcttgggccgggcgcaagcaggccgaggagagggagagagagagacttgggccgactttcggcccaaagccaaaaagagagatttaaaaatctttttctatttaaattattcatgaaatgatattccattgattaaaaaaatacttccttggctcaaataaatcctagaaaaatctaggaactatagaatcaagagaagtgtttaaaaaaattttatctagcccacttttatattgagatttaacaaattaaaaatagatcttctcttttaggtttttaagattatttctaataattccttttaaacaacaatttataacttaaggatttttaagcaagcaaaacatttaacataattataattagatcattaattgattaattcattgattaactaattactgaaatattctttgtatcatttaagaattgagctctgaaaaatccgagaaaatttcaaagagtatacttaatcatggagaatttaataaaaattaaatccagccatgctttatatttagaaaattttatttcccacatttaacttcacttgtaaattaatgaacatttaatataaattctattaataatttattaaataatttataaatccttaaatggaaaatcaggctgtgacaattgggtaaactctattcgtgtgaaatctagaatttatgggacaagttttaataggaaataggcccctaaaattggataaataggaaaaagtcactgttcattagcccctaggtgttcgatttggttccctagccctgccccctcctctgccacgccgtcctcgcaccccgcgcgccgcgcgccgtcaccgtcaccgcggccgctcgcccgccgctcgcccgtcgcgtcaccgcctcgcgccccgcgcggtcacgctatcacccgtcggccccgagccccgctccgccgtcgccatcaccgcgcgccgcgcgccgtcaccgtcgcgctgccgcaccctcaagccccacgccccgtcactgccgcgccgctcgtctgtcatcgtcggcctcgcgccccgagccgccgcgcgcccatcccatcgccgctgccacgccgcgcgccgtcgccgcacgccgcttgaccgtcgccgtcgccgcgcgcttctcgccgtcccgcccatcgcgtcgcgtcgagcctcgtgccgagctgcgcctagccccgcgccgcgctgcccacccgtcgcatcgccgctccgagccccgcaccgccgtgccgtcgcgtcgccgcgcgtcaccgtcgcctcgcgccccgcgcgctgcgccgtcccctcaccatcaagccggccgcccctcctcgagccctataaattccccccccccgtcgccattccaccccacaccacctcgcctcctcttcccccatttctccccttccttccaccgcgaccgccacgccgccacctctgtgccgccgcgccgcgccgcgccgcgccgtgtgacgctccgccttgcgccgccgccgccctcccctcgttcggtcgccgtcgccgccccgggtaggcagagagccgagagagagagaggagggagaagaagccgggagggagggatagaagggagagagaaagaaaagagaggaaaagagagaaaaagagaggaaaagagaagaaagaaaagaaagagggaaaaaggaagaaaagaaaatagaaaagaaggaaaggaaaaaaaataaaaataaaagagaaattagggagagattaaggaggtctagaaagttaaaataattagagtttagttattgattaatcatagttgaagaattgcaaattttatataattatagattattcttggtaatctctataagtaattaattcgcgatgaataatcgggtataactactaagagttgtattgtcgttgaaattttaaagaagatacttttaaatcgcaaaatacctttgagtaaattaaaatcgaaatagtcctatttcgcgaataatgtaatcgatatagaattcacctctcgtactcgctttttgatttggttttcattagatcttatctgaattctaattgagttcaaatcgtttctccgcacgtacttttagagctcgagggagttgcagatccgagagaggatcaagacccgcaggactatgagtaaggcaagtcatcactattccttgaacatgttgaacccaattgcgaaattattttgtttacaaataaaattgcatgcaatgataaacatcctacttgtgattatgccatgccttgattattgtttaccccttattccttcgtaaccatgtttacgtatggagtccctagtcaattatgacaaatgcttagaaatgctcttctagaatcatgcatactcatattatcaaaatgctttatgcttgggcaattaccttcgagaaggtaattgagatgtggcatgtggagacatgagcgccacattgccatgatattgatgacatgatttgtgaaaggaaaataaaatgaaacaactgttttcgactggggcggatggaggaattgggtggtatctggaaaaggctagtaccgtccccagtcagttaaaaaccgagccatgaagttaagcatgaaacgacccccgtacaaccatacttctcgaatgggtatagacctagcggattagatagccgagcggaggcagtatccctgcatagatggttcacccccatgagtgaggcaggtgcgctacggtggggcagctgttgaggtagggccgcgaggcgtgctcctacatcggtgtcgccattggtaggactgccatgagtgtgtgagagagagaacttaacttgaaccataatttaatatgtgtgtgatacttctctttcctgggagcgctagaactcctctcactgctagaaacatggacacctagagtgcatgaggatgaaagttcatggagcgggtactgccaatgcaaggttatcgaaatgctttgccgtgacgcgtctcatgtgttgggacgaggctcatgtgttgggtagtcgcggagtgcgggtaaagtgtacatccactgcagtgtgagtagaccaaatctattcgaatagccgtgctcgcggttattgagcaccgggacatgtattacacttggctagactctaaattcataacttgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccgccgttgtttaatgtgaacactggtactaaaatttgatcagtctatgctaggtcttaggcttgtgaaaagaattacaaaacttgctttacgcaaatgaaccatagccacaccttgaatactctctatcatgtgcattgtggctatggtggcttgctgagtacggttggtactcacccttgcaatatacaaatttaatcagaggtcggagatgaagcttcagacgatccctacgcttattaccaggcgggcgatgaagacgatggcgctcagtaggtcttagttacggtcattacctgtggcaatggcgtgccgctaccttaactccgctgtcttatctacttctgcttttgggatgtattccggaccgttcggtcctatgttctaagactatgcctgcgggcctatgatgtaataattcgcactagactctcgtctatgtgcgcttggtatttcagctccaaattcatgtgtaccagactacttgatccagggaaatggtaccgtttacacgcttgattcctgttataaaaacgggggtccacagcctacgaagccaacctagcctctggacacctttcgccgtatccacacccttcgccacagaaccaataaggtacggcgtcaacgctacgggcgaagaggtttcgccacacgccacgcccttcgccatagtaccaataaggcacggcgtcaagggctgtgggcgaacaggtttcgtccgccgacgcccttcgccatagtgccaataagtcacagcgtcaagggctgcgggcgataggtttcgcccgcccacgcccttcgccatagtgccaataaggcacggcgtcaagggttgcgggcgaataggtttcgcccacccacgcccttcgccatagtactaaaaaggcacggcgtcaagggctgcgggcgaataggtttcgccacacgccacgcccttcgccatagtaccaataaggcatggcgtcaagggctgcgggcgaacaggtttcgcccgcccacgcccttcgccatagtgccaataaggcacggcgtcaagggctgcgggggaataggtttcgcccgcccacgcccttcgccatagagccaataaggcacggcgtcaagggctgcgagcgaacaggtttcgcccgcccacgcccttcgccatagtaccaataaggtacggcgtcaagggctgtgggcgaacaggtttcgcccacccacgcccttcgccatagtaccaataagctatggcgtcaagggctgtagccgaagagacctttcgccacacccacacccttcgccacaataccaataaggtacggcgtcaagggctgggggcgaataagtttcgccacacccaggccctttgccacaataccaataaggcacggcgtcaagggctacggacgactaggtttcgccacacactacgcccttcgccacaataccaataaggtacggcgtcaagggctgggggcgaataggttccgccacacccagacccttcgccacaataccattaaggtgcggcgtcaagggctgcgggcgaacaggtttcgcccacccacgcccttcgccatagtgccaataaggtacggcgtcaagggctgggggtgaataggtttcgccacacccacgccctttgccacagtaccaatgaggtacggcgccaagggctgggggcgaaaatgagttaggaccagacgcgaaaataggggccgcgaagccaacctagcctctggacaactttcgccacacccacacccttcgccacagtaccaatgaggtacggcgccaagggctatgggctaattcgccaagggtaatcttcgctgcaggcaaacgaagaaagccggcaacggttaaaaaggtcgaagtactaaaagggccgaaggccggtaacggttaaaaaggtcgaagtgcaaaaagaccgaaagccggcaacggtcaaaacgatcaaagtacctaaaaatacctttgccaaaggcaaaaagggaaaattacgagccgaacagccgtaacacgcaccacaccccatttatttgccaaaaaagcacaagttacagattaaccatgacgactcaatggcgggaagctatccttgggatcacaatggatggtggacagaaccgctgttgtttaatgtgaacactggtactaaaatttgatcagtttatgctaggtcttaggcttgtgaaaagaattacaaaacttgctttacgcaaatgaaccatagccacaccttgaatactctctatcatgtgcattgttgctatggtggcttgctgagtacggttggtactcacccttgcaatatacaaacttaatcagaggtcggagatgaagcttcggaggatccctacgcttactaccaggcaggcgatgaagacgatggcgctcagtaggtcttagttacggtcgttgcctgtggcaatggcgtgccgctgccttaactccgctgtcttatctacttttgcttttgggatgtattccggaccgttcggtcctatgttctaagactatgcctgcgggcctatgatgtaataattcgcactagactctcgtgtatgtgcacttggtatttcagctccgaactcgtgtgtaccagactaattgatccagggaaatagtaccgtttacatgcttgattcctgttataaaaacgggggtccataggccgcgaagccaacctagcctctggacacctttcgccacacccacacccttcgccacagtaccaataaggtacggcgtcaaggctgcgggcgaagaggtttcgccgcacgccacgcccttcgccatagtaccaataaggcacagcgtcaagggctgcgggcgaaccggtttcgcccgccgacgcccttcgccatagggccaataaggcaccgcgtcaagggctgcgggtgataggtttcgcccgcccacgcccttcgccatagtgccaataaggcacggtgtcaagggctgcgggcgaataggtttcgcccacccacgcccttcgccatagtaccaataaggtacggcgtcaagggctgcgggcgactaggtttcgccacacgcccacgcctttcgccatagtactaataaggtacggcgtcaagggctgcgagcgtacaggttttgcccacccacgcccttcgccatagtaccaataagctacggcgtcaagggctgtgggggaagagacctttcgccacacccacacccttcgccacaataccaataaggtacggcgtcaagggctgggggcgaataggtttcgccacacccaggcccttcgccacaataccaataaggtatggcgtcaagggatgggggcgaaaatgacttaagtctaagctgggggggctacaaagccaacctagcctctgggcacctttcgccacacccacacccttcgccatagtaccaatgaggtacggcgccaagggctaggggtgaaaatgagttaggaccagaggcgaaaataggggccgcgaagccaacctagcctctggacacctttcgccacacccacacccttcgccacagtaccaatgaggtacggcgccaagggctcagggctaattcgccaagggtaatcttcgctgcaggcaaatgaagaaagccagcaacggttaaaaaggtcgaagtacctaaaaggaccgaaggccggtaacggttaaaaaggtcgaagtgcaaaaagaccgaaagccggcaacggtcaaaacgatcaaagtacctaaaaatacctttgccaaaggaaaaaagggaaaagtacgagccgaacagccgtaacacgcaccacaccccatttatttgccaaaaaagcacaagttacagattaattccattgcccgccaaaaacattcggactttagatccgattcatcagcaaaagctgtccttaatggcgaaggactaccccttgagcatcttcttcatcgctagttgttagatcaacaaaaatttttaagcggtgaagaaggaaaaacggggactatgctgtatcgatgctgggcaatggcaaactggcgctcggacatataaaaattcataggtgtcttcgccttttttgtgtatgatatttcgtggaaaaaccccaaggcaatcgtttgatcaacgaaaacgccgggggggcgatacgaaccggccgaagcactgctcgccgaacgttgaaaccgcgacagctcgttttcggaaaacataccgatcgtcgttatactcgacttatgcaaatacttaagcgtttctggacgcgtatgccaaaagtcgagagcgaatgatgagggctgaaaagtcgacaaatcttttcgctaaattacgcaaaggggccgacatgtttcgacctaacgaaagcacgaaagtgactatgcgaacattagcaaaaagaaatttgaaacacacataagctccatcaggcgaaagcacatactttaaaaaaaaagaagaaaaggagctacagcttcgccataaaaaggcgaaaacgaatcggccaaggcatcgctcgccgaacgttgaaatcacgaacgttggaataaagataccgaacgccgttacatttgacttacgcaaaacacaagcgtttttcctagcgcaaaatgctacgagtcaaaaacggaagtcgaaagctgaaaagtcaacaaatcttttcgccaatcctcaaaagggggctgaacgcatgactttcggcgaaacccccgctaaagcaatagggaaaaggggaaggaaaaaatacaagtcaagaatcgcgcaaagcagacaaacttggcaaaatataatcacccagtgtcataataaagcttcaccattctcgaaaggcgaacgccagtattcatattttttctgcaggagtctaaaaagagttttcggcaggaacgtcggccgaaagggggcgcctcatgccatactgtatagtttgcacggtctcggccgaagctccttactcacccttgcccatgaggggcttgttggaggcattccatgaagcctttcggccggacctaccaaaaccatagtaccagcaaggattcaagtcaaagacgtcaagaccattcgggcgaagccctatggcgaaagccataagcgaaggtggcgaaggctggaaagccgcgtcggtactccgcaagtaaaggcatctcgggtgaaggcatctcgggcgaagggcatacggcgaactacaaagacttcgccatgacgagttcggcattaaggaggcccagcaggctgcccccgacctttaaggccccttcaccatagaccaggcccagcctatcggcccattaaaggcccatatatgcaaatgacactgtgtacccatgtaaatatcccttttataagggcaaccatgtaaaatcccctgtaaacctaaaccctaggaggtgtaagcctgtgctaaggctataaatagacccctagggccatgtaatgggggatcccaagaaattttatcaatcaatacacttattgcttttccaacactgttgagcaaccacgtccttcgacgtgacgcagttgtccatttgacagcactccctctgtcccaatatatagctaagacgagcccatcctacttgctatatgttgagacggagggaatagtttttatgatattatttttatagtatggtagcataaatatatataaaactatacttctacgaaagtacatattgtcacaatatattttcattggatatgcaacaacctatagttggcaagtttatttatctttctttatcttttttttttctggggtgtctaaaatggccatttctgttattaattcgatcaaatgggcatctcatgattaggctattgtgaaactggcccacctagatttaaagttacttagtacaggtgcatgctcacattttttttcgattaatatcagaaaataaaaattgctcttatgctacaaagtcgaagagtgtactcacaattgccacaaggctgattgatgttgcaaatttgcaccttagttcttttttttttgaatgaacatcacctgagagtatggtgttttgtattgatatagcagaaaaaaaatcacaagactatagccctacgatgttataatcgggcaaaagaaaaaaaaaataggaccaccacgcaccgacggcattacgcacacctaaatttaattagaaccgcccgcctgccactatgcataacaacgccaccaaacctataacgtacccacccctataccgttcaccacctccaaacagcaagaaacaaaatggcctcatggacaccacctgtgaagaagggcgagagagcgagagagacgatgatccgtgcatccctcgtataacccaccgccattcaaaagcgttggctaaactatttggaggtgggaaaggcaggaacgagacctcctagatgatgcctccagggaggatgtgatgccatagtgccgcaactgcccatctaatgaactggatatggtttttacctagagtgtcccaccagcggcagggggaggtgcctcaacaatgccctcatcaggtaacaagacactcaaaagtgtcggtgttactgacgcaacaaaccactaggataggtttacacatgcaggctacagcctaccaacccctgcaatcatgacccattgtccctctacaggccaccctccacccacctcatgcatcaccccaaatcaacatgtcatttttgtcaccacaagacaaaccaccgcaagggccgagcacaacgctctccccatagtgtagtttgtcctttgctatcgacctcgccggctagcaccgcccatgttgttgtcatcaccacatgacagattgccacgaggccaagcacagttgccttctcgcacatggatttggtccaacaccatcgatagcgcaagtcagcaccgcccaagccactatcgttactgtaaccaaatcaccgcagggtcatgcctccacatgctggctacaccagaccgaagatttcgtaggcctccatcctgaagtcatcgttgccggtcccccgaacctccaagaagacctctacctgcagctgcggatgccatgacgccactagatccgcggatcttgtaatggatgtgccagatctgcctaccttcgccgtgctcatgagcacaagcatcagtaagacgaaccgactagatctagcctaactagttgtggatctgaatgcttccaaacaccagctacactcgcaccacccaagttgccgccatcagcatcttctctactcgtaaggtctctgggtgggattgccccgctgccaccttcctcgttgcttgtcgtgctcccaacatgctggttagacggcgacaaaggcagggtgatgggtagggggaggagcggtgctaggtttggggtgtcgcccgagttacctctttaggcaacacggtggctaggcatgaaaaatctcctatgcgctccattttttgccccataattgaggtgctagcttgcgctctcttttggcacaacatacacaacacatgaacttccaaagttaccccccttttaattgaggcgctagcttgcgctctcttttggcacaacatacccaacacatggacttccaaagttacccctcttttccctccattctcatcttctttctctatacgtctaactaggccatgccgtcgtgttcatgacctttctcacctacgtggaagtctctaccaagccacccgttcccatcaacatcgcccatcgtgcccacgctgccaccagcctcgacggtatcgacggtgatggcgagaggatgcagcagagtttgggagcagggtggcgccggcgaagcttgaatgcgtcatcggtggagcttggcaacgtgcataggaagatggaggaagaagggagaaaatttgaaagggaacgtacatggtgttgtggcaaaagagagggcaatcgcctcaactatggggcgatttttcaataccaatcaactttgtggcacagggtcaatttttcagaaaaaacattggttttgttttttttttctagtggctactcaaccagtggcatgcatattacagaagcactacttggtgataaacttgacaacaaagtcaattcattcttttatttcaggaaaactttgcaccttgttgcgcctatgtccaattgacctaccatcagtcaagccaaacacaaataacacagtatctacgccaaagtgaggtgattattcagttttcctgaacgggatagagagcacattcacaggagcaagaataatgactgctattatgtgacatcacaattccagacacaggcgacaataccgaattgcagatgaaggtatctatgcagcacttgaacatgatttacattattgtcgctaaattatatcgatccaagtattaggaacatgtgaccgtacaaaacctgctaggactgacaacgaatatcatatccgacttggtaatacttgggaaatatagttagccatcttaaaactcacgaaaatcaccaggaatggcgctcttgtgatctccatggtcaaattacatgatcatccatcagtggggcgacagttctgccatcaataagcacacaaaagacaattagtcagcagaatatgcaaacggaaccctgctacaccaaaatcaggccaaatctcaattcttaaaacatctaactcaaatgaaggacacgcatgttggcaaaaattcgcttacaggaagtgatatagtcattctatagtatgtatccaggaaacaaaaccaacttcttaattaatactagtcagatgtggatacaaacagccagcaagtaaataactctgggacaaaaatacaactccatgaagaaacatcaggaaaatacacaaatacagattcaccacccagcatcctaagaaaaattaggactacaaattaagcaaactgttattaatttcttaagatattttggatctttccaagtccatcaatgagtttccattctcaattgcagactctaatgtaacaacattgcaataaaaaatgggttgacctccctgactacttgttcatttacgtaaaatgaagagctataccctgcacaatttagttggtcaggaaaaagtgcatcatatataatctttcacaagttcattccatgcttctcaaacagacaaaactaaaaatacggcaaagcaaataaactataactacagatgtagccagtaatgaattttatagaacttaggccaaacatattcaacttatgtcttctcttttacaaatggagcacgcacttgcaaaaggacttctcagcatatgattaaaaccatcaattagttgaaaggtaacaattcaaagccatacatttaacaacacagtcaataatttatataaaagtattgagcaaaaagactgcacctagcttggaaccttctaagtgggccaactgtgttggtaatttgatatttcaatttattggttcaggtatgttttccatatggttgttgctaatttcaaaagtgatatgtaactcaagctaaaaagtactataccatgtagtatgcacacattaatactaccatcagacaagttgaataaatgaataggagctcaaaatttagttctagtatttctgatatgagtaataatggtcctaacttctaagctatggatgttcaaagcataaattagtcaaacccgctaaaacagatagagactaatattagaaacaacattcaatatttaggacagtttatcaagcagttaaaggaacattaattgtcacggagcgaataaaaggcattcagaaaaagcaagctactggaaataacatgattttgctacatgtacaacggaaaaggcatgggaagcaattacctttagtataaaaactagtgaatggatgatagattagactcattctttgggaaacactcttaaattcctttgactccagatggatcatggagacaccaatatacgtgcacacaaaagccacattatgttcctcagagaagcccagaagcatcggtgccgttttctgaggccctggttccaaagaaaggagcctgtccagttcaatagttttctccagcacccatccagcgacaccatcagcattggtctcactcttccatacattgagagtataatgtgtgacaacaaggaaaagaagcccgccgttctctgcaggcgcaaatctgcagattgtatccccaaatctgtggtggccattcccatcaggatgcatatcgggtggaacatcgatctgagctgttatctgtttatccaaatcgaactgaaagaagctggtcctctgctcacctaggagcaaacagtaaagggaattcccaaccaaggtagtaaaattgcatatgcaatccccaaaattaactgcggctgagatgacattgccccagatgccggtctccgatgagtaaacacaagcgaacgcgtgtgtccgattcttattagtgcctagtatgacaacctcaaagggactcgaatggcagccgccgtgcacgtggcccgggtcgccgtcgccggcgacgcagcgcacctccccggcgcggacgaccacccccctgtcacggaacccgccgggaatagccacggcgcggcggtcgccggcgacggggtcccacacgatgagcctgcgctgagaatagcggcaggtgttgacgtggacaagggcgcggccgtggcggactcccagcaagtcgttgaggtcgtggcggttgtcgagccgccaggagaagcgcgcggcggggatccggtccggcgggtccagcgcgggggcgaagatggggtaggcgcagacctggatgacgccgaggaggggaggcttgcggtggcgggcgcggaagcggcggaggaagccgcggtcggagacgaggcggcgccagcgggtgcagacgagggaggcgcgggggagggaggatggcagcggcgggaggcggaggaggatctcggagaggaggtcgtcgttgtccagcggcggcgccggcgaggtggggcggtggcggcggcggatcatctccgcgctcgctgtgttgtaattttcgatgcaatctagtcgacgtggggttttttcctcttcatatatatttttttttcagttttcaagtaacgttcgctgcaactttggctgaattttcgggggcagtttttctttgatttaccacacttaatgcttgtaaaatcacgtttcacaaaccaaaaatttattaggagttattcaatccaccgtaaaatgtgattttaggtgtttttaattattctttcaattatttacaggggtttgaggatagaaaaaaggtgtgcaccatctgggttgcacagagaaaacattcattattagaaagaaacgaggatattttcggtgtgtctgattgctttactattaaatgtgcatgattagaaagagactagaacactttcggcgtgtctgattgcttcactgttaaatatgcatgattagaaagagacaaggacactttcggtacgtctgattgcttccctgttaaatgtgtatgattagaaagagacgaagacactttcggcgtgtctgatcgcttcatggttaaactagccatgtaagccacgcgttgcatggctcttttaagacccgttcgaaagatatgtaaaaatatgtatatatgggtgaggccaacagtgccccgttattgagttctcgttgatgggcaaaattttaaaggttcggtaaaaaaaacaaaagatatatatttatgacaaaagagagtgcattattatatgataaataaatactaacgtgtttctctatctattctaaaatatatatggcattcttattttgaggaaaatcaaaacttaaaaatttgactaatgaatggactaaaagtttaggagtatatgattagtgctatgtatgtcgatttttatttgatttttatatcactatatgataagggagtgccgtcaggtttctatttaaatctttttatgtaacgttgatttcgtagttatcgataataaacgaaagaaattagtagtagttaaagtataatgttaaaatttccctaaaaaaagtataatgttaaaagattgtgtaaaaaggtaacactgtatctaagtacattttagaataaagggagtaattagtacatatgcatataagtacttaactaaattatttatttaaaagaatacttgctacactatttacatatgcatattaaaacacacatcctgcctatagcctttttctctgcatttaacagggtcacatatgtacaggacatgctgatgatggatgcactacgggctgtttgaggttttatcaatttttgtcatgccaaattttggcaagctaaaattgtgtttgaatcgaaatcaaaataacctaagttaactattgaaatggcctttttttaaggcatgctaaaatttaatttcaaaccaaataaacactaaatattattgaaattataaaaattggtaagattaatttagatctcaaaccaatctagccctagacgttttcctacagtcaaaaaaaatttaaccgtccagtcctcatcattatcgtccctactcatttattcattgtttcccttttgcatctgactctgggttctgggatacacagaccaaccacgactccacgagtaggaccgcatcttgtccccttcgtctctgctataggtagcctgtagctcgacctttgctgccgtggatttgcactgaaaaggaggagaatgtctgaaggatgaggctggcttcactgaggagtgaggagtgatctcctcaacctagccccctttcgtcgatcttttctaaagatgagttttcggcggccagcagcatggtagcgcatcgagggcttctatcttgtgctgcctgcactgacttggtcccaatagggagatggtgagttggtgtggtgaagatcaaggaagcgttgcgttttttttcgtcagttttctcaattctcttctgctagttgcctagttctcctattgaagaactgtactacgtatctacgtaacttacgtgtggaatttgacaaaaactctagatccttccgttcag

SEQ ID NO: 73728 - DNA, 642 bp, Oryza sativa
agctcctctaccgactgttccggccacatcccacactctctctgccggccaccacccttcctgggtgcgccaccctcaggaacacgtttggccgccggcgtcgcaaccacccagccaccggagcaccggcgccccgctcctctcctcctggtctcgggtctacctgtgaagaacgaaacagagaagaaagaagacgagaggaaggatgaaaaataaaaataaaaagaatagaatattccctgacaagtatagatggacataagacccgaggccaaaaggaccggcccacggcacggtattttggctcggcccaagcacggcatggctcaacttgggtcgggtccatgccgacccggcttgaccgcagggccgtgcttgggcctccccaccgacatgctgggctggcccggcacggtcgggcagaaaggccaggcccggcacacaaagtataaaaaaaggggtaaaaccctttaagaaacaaaaaatagacatataaactaaaaatcggtgcgcctgttggcgcccctgaatttttcgcccatatacgtctataaacaaaaatatatgtaattaataatattttaaatttctaatttttggtgttaccaaatagtaggtgtagtgtttatccgaacatttata

SEQ ID NO: 73729 - DNA, 4020 bp, Oryza sativa
aaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaaatcttctcctgcaaattcggactctccgagaacgtcggaatctaaagagaaaagaacaaaatcaccaaaacagcacacaaacaagcatgaacagtatatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagatgattattacgtcagcggctagggttcacggtggaccgggtgcacggcgggggctcacgaacgccgagatctaaccctatccaatcggacgggcgagatctaatgggtctaccgcgactcacggaaagcgacgatgatgacgtcggcgatgacgtcatcaccggcgacggctcggatggtgcaagctcgccggcgaaatacggcacgacggcactaacgaaaggcatctaccggttgcggacaacacggcgaactcacctgtgaccaaagcagcggcaacatggttgacacgagcctttgttgctggtgtggaggagttgttctgagcagggatgacctttgcgcggcggggcttcggacacttatcagcgtaatgtcctgggccaccacagttgaagcacaccccgggcttactgccttgctccctcttggcatgctattgctgtgacggagctgcaatagagcgtggagcttgattgcggatgttgttgcccgcgctgttgttgaagaactggcgctgcggatgaacaacaaacgaagaacctccctgtggcatagattggggtcccaaagcaagacgcggcctctgactatttccctgctgtgccttgaagtgagcaatccggcgtttcttctgctccatgcgattgtacttgtcctcctggcgaatagccttatccactaacttctggaaatcatgataatccccagtcatgagtgggtaagaaagctcatcatttagtccttccaagaacttctcttggcgctcttcatcagtgcgcacatcttccggagcataatgagccagacgattgaactcgtgaagatactcagtgaccgtgcgagaaccctgagtgagcgacctgaactccttcttcttgagggacaccactcccgatggtatgtgcgtcttccaaaaagcagcggtgaactcaagccaagagataggttcagcagtagtcctgttaaggcggaagtgatcccaccactcagaggcagggccatgcagctggtgtgaagcaaaagagactttctcctgatctgtgcactgaagcaggtccaacttcttctctatggtgtgcagccaatcatcagcttcaacaggattggtggtgctagagaaagtaggcggcctcacacgaagaaagtctaccagcttattctggggaggcgcatggttgtttccctggttctgctggttctggagttgctgcatcatcatattcataagctgtgcctgttgagccaggacttgagcaagcgtgggattctctgcattgttgttgtagttgttgttggggttggggccattcccgttgctgcgagtaagcaccatctggcatagagaggagcacaagaagagaaacaagggaaaaactacttagaatagggaattaattttactaacttaacttttattgatattaactgagtttcactattagaaaactgaaaactctcacacctctaaactcaccaacctcctaaaactagaaagcaaacaaagacatgcatttacatcccaccaatgatgtaaacacatgcaagacccactcacacaaccaaacttaaacaagcaaactaacacaacgatctaaggcaatgacttaacaaggcatctaggtcttccgggcatcggagttgattgaaggctcgttcggtgcgtccccatcgtcttgagttggtccccactcgatcttggaatgggtgcgcttggattcttcttcatcatcatcactcacattgacgaccggaggatccgctggggctggggtagcttctttttccactacacgaacctttggcgccaactggtagcgagggacgaatagagctctcttccttgcggtaagacgaaccttggccttctgcggtggtgcttctcccttcaatgctgctagctccttctccaaatgatccaccttgtcatctagcttgcaaatctttccccggttccggtcttcacgatcttgagcggctatcacaatctcaatgcgggtttcatccatagcccatagcatctcaaccaaatgccttgtggtagcatcattctcaatccctgccggttctaggtagctgccacggtcacttccctggggttgacgaggatggtaacggtactcggtgtcggccaaccgatcattgtaactttcgcggagctctcctatggcgatccttgccacctcctgacaagcatgaatgtagcttccccctccagcctcgaacatcaccgatgggatatcttcacgattactgttcaaggtgactttgacccagcacttctcttcatcacgatcatgagggatctgggcatacaaaggggcaatcccaaatcctatgaggaaagacatcgtacgcaactcctggacaaatccttcagtaccaaacaagtactcaagcttgtagcacagcatctaaagacaagtgaaatgagggagttaagtcatttatctagttaatagcacaagtttttgggttagcttgaataaagttagaaattcaaagtaaaaagtaaataaataaagcaaaccaagcttgcaagataagttgaaacagttagaaataggttcacaaactttgcacttttgaataacaggtatcaaagaaaataaataaaagagagttataaaatcgatatgctaagcttagttcattgcagcaaaattaaataaaacaatgttataaaacttttgatggtaaatgggccattagtacggtaatagatgtacagtactaacaacacaggaataataaataaattttgaatgagaacaataaaagaggtcatgaattgcatgtgccattagtttggtttaattaaaagagagagaggagaacagttctacttttccaatatctttagagggcttctatgggtaaccatttggcaaaacctagggtcaaggaggctccgataccaacttgtcacgcccagaatttctatccaaaattccaaacgcttacatgtgtgtaaaccctcgtccaggaatcagccgaggcacacaataacaaattgataatacagtacaattattactctaattaataagcgaataaaatgtcattacagaggtagatagttcctctcaatcaaaagaaacagcgtaggcgattcctctccacaggtagcttgaccagggctacgcctaatcatccactccatcagcatcactgtagaactcctcctctgatgaatgattgcaaggtgagtatatgacatactcagcaagccacgcagcaaatatgcaagtgcacaggataacaaagaatggcatagtataatctcatttgcataaatagcatttaacaaatatttcagaatttaataaa

SEQ ID NO: 73730 - DNA, 3624 bp, Oryza sativa
gaaaacacaggttacaaagggaacaatggaacatgacggatccagcaagatcgtggtcgagttggttcgactagatcccggcgatttggctccttgcgggctccgacttcgtaggctgtgacggttgtgttagctctgagattcgatgccttaggtactccctggggggtcccttttatatcgcaggtcaggcggtctccaagtagaaatcggagatatcagaccctatacgatacattgacgacccagtcttgtccgagtaggacttttcccatccgtagattctgtgaatgatttccttagtgtacgcaggaagtatccgtatgcgcgtgggtataccataccgatatgtgacgtatatcgaagggtaaagggtatgcctaacccgtaaccctgacagtagcccccgacttctgcttaaaatgagctcgtgtaaccattcacaacttctagcgtcgagactgttgtcgttcccagtgcgaggaccgtaaagacaagacatagtcgagaacaccatttgaagcccaacggtcacgagcgaatttgaactgaagtccaaaaaaccgccgcgcgtaacagacccagaaatttccggcgggcatctcagtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcatctcaatcaataaagttctaagcagcggaaaattaaaagaaacagcgcaggcgactcctctccacaggcagcttgaccagggctacgcctaatcatccactccatcagcatcattgtagaactccttctctgatgaatgattgcaaggtgagtatacgacatactcaccaagccacgcagcaaatatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcatggttattcgaatagattaaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccgcatcataatcacccccttataaacaaggtatggactccacagcgacccccgtgggcttatctccgccacttcatagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtactgaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgccagcgaactacggcacgacggcgctaacgaaaggcatctacgggttgcggacaacacggcgaactcaccagtgaccaaagtagcggtggaagatcaacggacggtgacggcgacgaggttgatacggcggcgaccttcggcttgacgacgacggcgatgctccggagacctacggcagcgacggaggggcggacgaggtcagccatggcttgtgatcacgatggcgaccttcccgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcggatcgggaaaggggcgacggaattggatgggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagagaggggggttttgggccgactttcggcccaaagccagaagagaactttttaaaacctttttcaatttaaattattcatgaaatgcaattccatttattaaaaatacttccttagctcaaataaatcccagaaaaatctaggcactatagaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattt

SEQ ID NO: 73731 - DNA, 13552 bp, Oryza sativa
aattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattttgaagtccgcccaccgtgcagaaaacatcccgcctgcaattgctcttcgtcttcttcgctgccacaagaaaccctagttcatcgacctaagccctttctccagcgatcttcgatcagtgatggatctcggcaaatcattctccaccagttgcgatcgaagactatattctctgcggttttctccctccgccttccgaatttcttctcttggttttaaacttctatggtctttctcttctccatttgaaccccaattctatcacctttcttagcatcttttctcatctttgcgaggcctacattggggtagagccttttcttgatctctttcgcttctactacgagctgcgttggatggagtccaacagggtatctggttgcgtcgtgttccgacttcgcgatggcttgaagtcgcgttatatccccttccagtgcccttcttctcgcagcaaatgtcggaataggtggttctatcttcagatcaaagattcagaccctgtcttcgttgttcccaaagaacaaccggacaagatttcgtcttggaccgcaaagccccctttgaccccctctctctagtcgtttatcgacattattgacgatctccgagtacgaggcttgtcggggtatgaagtcgctgcagacttcgttggtaggcggatccagccgctccaggctcgggcccatctagcctttgactattccgaaccggaggacgcgacccgggtttctcctcggggtatctttctcgcatttatcctgacatgctcttgttcgcgttcctcttgatttatcgagatttggttcttgattcgcaggtctgaacagcgaagccgtggaacgtcgtgtcggccaggtgatgatcagtggtccgacaacggcgagtaacatccccgtgcccctttgtgaaaagggggcggccgaacatgatgacgccatcaacgtaagtgttctcgataggcatcctgcattttcctttcgagatcacattgtgacttgattaagcgtaggctcttcctctgactgacatcatcgggccgctcgcggaccatcaggtggcggcgtctctgaaagagaaggtcgccaaggaggcgtctgatgctgctgctactaccactagtggtggcaatgttccgacaaaggggaggaagttctcctctgtaagcggacatcatcgcaaggcgtcaacccccttggtaagttatcctgtcgtcagatcgtacagccagaagaattacgccttacttcgcatcgaccgtttttcaggcctcggacgcgtctcccccgcctccacgacgacaacgtcttgtgacgattggcgagaagtaagtagacgaatcttaagcttccgtgattttattcgagtgttgtctgaaccgtggtcgtctcacagggcagcgcgggtgaaggctgtgcaagacaagtccggagggacctccggcgcatcgcccgctgcggcctcgacggatgtcgtgctcgcacccgggagccgcgaggtgacaccaagcggcccagtcagcgatcccgcggctggtcgtggtccaccagctgccgtcctcacctgggaggagctccaggtcgagatggggcgcctcctcgaggctggtgctcgcggcatcggccgcgagattgcagaggcgaggtcggaagcagcgttggcgaacgagcgtgctgactggctggtacacgagttagcggaagctcgtgaagacctcaagaagatgagggagttggtggccggcaacgagcgacaatggcaggggctcgaggaccgcctgtcggagctcgggaacaacctgtcggaaatccgtggctcgttgcgggtcacatacactggcctacaccagctcgccggggagtgcggcattaagtctaccatcctggcgaatcccgacgagttctcgctgacatcttctcttgcggaactggcgacggcgatgggggagatcccctccaagcatgcggccaggatcggggaggaaacgtcgaacgggatctacaccggggcgtgccacgtccccgcgtgtgtaaagctatcgcatcctgaagtcgatctgcgcgagatcttggatcaggcggcggctagcaacacgcgtaaggaggtgacaaaagaaatcggtgatctaggggaatctgttctccccctatttgaagagtaggacctcttgtacccccaagacatgctgtgtaaaactgaattttaaccgcctttgtgcgtgcaattatcattgtagtttactcttgtatgttgatcttgggagcttttgtcctttgtagagatgttgatgacgaggatgtccaggagcgcgggcacatgtgtcgcccgacaatgtggaccagacccttgctacggggacggagatgacgacgacttcctcaggttagtagtccgttcatcccttgatgccctcccgactagataaactatgttctcgaaagaggcgtatagcttgacttagttgttatcacattgagcagatctcgagaatgcccttgctggccaagatcgtcgtatccaatattggaagacgaaatttgaagtagcggaactcgagagaaccatgctggcagtgaagaaaaagcaggctgtggaaacgctccgaggtcgtgaggtgtggttcaactcatacttgaagagttgctgcacatccatggccagggtctgtagagaacttcgagtgccccgtggagatccggaggagtcggcggccagatacatctcacggctgaacggagcctgtgctcaactcgatggcatcggcaagcgtattgacgaggccttgaagcaggagtgtcgtcgatcgagctgatatgccggagggcacgtgttggcttgcctacgagatcatcgcccgcgcctggacctcgattgtctccatgagggttttgctcgttctcggaagactccggcggagatagaccatctggcgaggtcgatgtcgccgttggcggagaagatcttccagtctatggactggcgttggccttcttggtaatcttcgtatcctgtgatagatatctcaggaaaaaggtgtaatatagctctgaatttgcgtaaaaactgtaagaagtattttgtgaaatagaaaataaatctatctttaataaatctttcttactcctgatgtcgtgtgtaagagtgcgttctcagttcacgactttagtcagccgtttgagttgtacactctccctagcccccagccttgtcgtcggaggaattttctcggaggataaggctcttgtacctttgacctgccttggttgaataagctctgatcctagcccccagccgtgaagttggaaagttaatttccgatttcgcggcttggttaatacgcacggcgagaacccttacacgaccagatcttacatggtctttcgtctctacaggatctgacaaggccttatcggctctgggcgtccccagccgaagatcccttaggttcctcggaggccttgtcaagacggcgtaaagggacatgaggacaggtttcaacgctaggtgtcattagggtaagggatcatcgggcggaaacactttgactgtaatatgggcctaagaataggctttattgatactgtaaggtgtcttacaggtatggatggtattgactcatacatagaatttacgtagttggtcaatgttccaagaatttgctaactcgcgaccatcaccgtctgcgattttgaatgcgcctggccgcaagacttgtgtgattgtgtagggcccttcccattttggtgagagtttgtttcgccctgcttggctttgaactcgtcggaggacgtagtcgccgatcgaaagtatgcgtgctcggatgcgcttctcgtggtaacggcggagggcctgttgatagccgactgctcgaacggcaactcgttcgcgatgttcctcgagtagatttacatcgacgtttcgctgttcctcctagtcctcgtaggagtgcttctgtactcatgtactcggatgtcgtagctcgctggggagcatggcttcggagtcgtacacgaggaagaagggtgtttccttgttgtcagtgtggtgcgtacggtccatagtactgacgggagttcttcgacccattttttgtcatgtgacatgagcctgtcgtagacgcgggttttgatcccttgtagtactatgctgtttgccctctcgacttgtccgttgctttgagggtgagagaccgaggcgaagcatatcttgactcccagcccgatgtagtaatcctgaaaatcagcgctgatgaactgggagccgttgtcggttatgatggggtgcggtagtccgtatctgcaaaatatctccttgatgaatttgatggcgttgtcggccttgatttcccccgtgggtactgcttcgatccacttagtgaatttgtcgatcgcatttaataggaacctgtagccgccctgtcctcgtgggaatggcccaagtatatctagcccccagcacgagaacggccaagtaagaggtttagtctggagcgcttgagctggtagctttgtgtgtttacagtggaattgacaggcttcacatcgctggaccatgtggcatgcatctttaagggcggttggccaaaaaaaacacttgtcaaaaagctttcccgaccgatgttcgaccggcggcgtgtgacccacagatgccttcatctatatcaaggaggaggtgtctaccatcgtcggacgagacgcatttgagaagtaccctgtttggcactttcttgtatagatcgttgccgaccatacagtagattttttctttacgggttattttctcagcctctgtatcgtcctcgggcaactcctcgctgttgatgaatttgattagtggggtgcgccagtcgtctgtggtctcgatgtcggcaacggcgcgttctgcttttgtggcctccgagctaatgtcgggggtggccgagctgacttcgccgctaacctcttttactgatggcttcgtcaggatgtccagaaaagtgccgggctcgagcggttctcgtctggacgcacgtcgtgctaggtcgtctggctcgatgttgtcctggcggtagatgtgtcggacctcgatcccatcgaaccttttctctagcttcctgacttctgcgagatacttggataactcagggttagagcatttataatctttgtgcacctggttcacgactagctcggagtcccctttgacgattagtcgcttgaccccaagtgcggctgcagctcttatcccggcgagtagtccctcgtattcggctgtgttattggtcgccctgaagttgaggtggattgcgtgcttgaattgatctccggagggagatgtcaagataaatcctgcccctactccttggctgttgagtgcaccatcgaacgccattgtccacgtttcgttgtcgacttggttgtctgatttgttatcaggcatagtccagtcggctacgaagtcggcgagtacctgggacttgatggctgttcatggcgtaaagtggacattaaactggctcagctcgactacccatttcgcaatgcggctgacaacgtctttgtttctcacgacttcaccgagggggaaggaggagataactgtgactctgtgggcttgaaagtagtggcgtagcttccttgatgtcatgatgaccgcgtaaagtagcttttggatctgtggatatcttgtctttgcgtcgtggagagcttcgctgacgtagtagactggtcattgtaccttctctctctcgacaacaatgacggtgctaacggaatatggcgtggcggcaatatagaggaataattcttcattaggttggggagcaacaagtacaggggggtttgataggtagcgcttgagtgcaacaaatgcctcttcggcttcctgtgtccatacaaatgtcttgtttcttcagcagagcaaagaaaggttgccctcgttctcccatcctagcgacgaacctactcagtgccgccatgcatccggttagcttttgtacttccttgagtcttgtgggtgacttcatgttctcgattgccttgatcttctcgggatttgcttctattcctctgccagaaacaaggaatccaagcagcttgcccgacggtactccgaacgtgcacttctatggattgaacatgaggcgatatcgccggaggttgtcgaacgtttcccgcagatcgtcaatcagtgagtcgcttgtcttggtcttgacgacgatatcgtcgacgtaggcctcgacattgttgccgagctggtcgctaagtgcgccctagaccgtgcgctggaaggtattccctgcggttattagtccgaacggcattttcacatagcagaatactccgaatggcgtgatgaatgctgtcttctcttcgtcctcttttgccatactgatttggtggtagccagagtaagcatcaaggaagctcaacagctcacagccggctgttgagtccaccagttgtctattcgaggaagagggaagtgatcctttgggcacgccttattgaggtcggtgaagtcgacgcacattctccattttccgttggccttccgcaccatgactagattggctagccactctggatgaagtacttctctaatgaagccagctttgagaagtttgtcgagctcttctcgtatggcttgttttctgtctggtgcaaatctccgcagtctttgctttactggcttggcatcgggtcgcaccatgagtttgtgctcaatcacctccctggggacccccggtatgtcggacggctgccaagcgaacacgtcagcattatcgcggaggaaggtgatgagcgcgagttcctatttctcgcttagtgttgccccgatcttgacggtcttgtcggggttggcactggagagtggaacgatcttgattgcgccgtacggttttggcgccttgtttgtcttgcacactttctttggtggttcagtcgtggcgggtgggctaggtgtttgctcgaccatgtcgaggctccgtttgtcgcactgtactgccagctttgcgttcccttgaatagtgattgttcccttcggtcccggcatcttgagcacttgatacgcgtagtgagatgcggccatgaacttcgcaagtgcagttctcccgatgatggcgttgtaagctgtatcgaattcagcgacatcaaaggtgatctgctctgttcagaagttgttggcttggccgaaagtcacgggcaacataatcttgcccaatggtctgtatagtccgactaggtatggaatgtgatgtatagatagaatatctttaaagagactcgggttaagttccaaacttgtatgttaaggaaatatccgggatcctagttggttacgattaggtcatatctgcaactacctattccgttagggatatgagctgtattttgtaatacggactccttctcctatataaggaggggtccgggtgcctcttggggtacaacattctactcttagatcatacgatcaataatagactcggcggaataatccccagacaggagtagggtataacttcttattaagaaggcctgaaccagtataaacttcctggtcttcaaacccatcaacttttctagcttgatagccacccccttttagtattgccgaaatcttgtttcgtcatgtatcattgtcattttcatagccttcatcatggcgttgcgaatattgtgaatatatcaatggatcaacttgcatgccctaactgtgagcattcttaaaactccaaggtaaaaagagataaatgctgaagtgtgattcatgcatatgtacatattgctcctcccaaatggacatcatgcaggatcgggactaagacaacacattaaaggctctcatgctatacgcttcttgcagctgtagttaaacaagggcatcgagcagtagttcgataacaataagattcattggcaccaacaaaaccccatccattctaataaatatggcacgcatgtattttaagatttatctttgaccaagaattagtttaaatttacaaagatatttgatagaaaattagcatcatttcaatgtgtttttcaatacgaatacaacaattctatgtatatattactagtcatcaacctgtgcacttgcatgggctagaaaaattacgtgacatcaattaactagcatggaagctttattggtgcctccaattactaaatataagatttttcctttctttctcaattctttcggtcaaaaacgagcatgtgtgttattcatagaaacggaggtagtatttgtaagaagtacggtatcgaatttccaaaaagttccgaccttgtgcgataatatacacacacattaacctacataggcaagctagctagaccatgaaatataccatttctaaacctatcggtcacttactcacgttggggagcctaactaaactaacatggtctcacatggcatgcaagctagccatggtactaactcgtctactacgccatagtatgctacaaacacaactaagttatcttatgaaggactactcaatagtacacataaaacaatgttactcgttgctttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataacgcttctgcctatatataagagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgatttcacttccaatctcacgacttcaggcatatatcttgcaacatgaagacatcttatgctctacttccactacaaaattaactaatgcgctattgggatttccatattttaatttcatagttgttgctaagatggacgaaatgggagttcttgctaagatggatgaaatgggagttcttgctaagatggaaggacaagcctacactacaagaatcaatttaatctgtgacgaaatttgacgaaattttcgtgatgttttcagatatcgtcacggatatgcaactatggatacaaggcccataataccgtgacagtttatcgatttcgtcataaaccggcccaaaacatgtgacgttacagtaatttcgtcccggtttacaaatataatattaaatacttgaaaaccatataagagatgtaaattttgtgaataatgttactatcactttatcggatgaataaatgaccaaaataaaagttatagatattgatgagttgtacaacttttatgttgatgactttttcagttgaaatcatttagtatttgaaaataatattgtttgaagttgtcataatttgaaattcaaattcaaattagtgaaacagagtcatataccaaaatgaccaaaacaaaagttatagatattgatgatttatacaactttgttgttgatgactttttcagttgaaattatttagtatttgaaaatgttgtttcaagtagtcataatttgaaattcaaattcaaattactgaaacagagtcatatagcaaaatgaccaaaataaaagttgtagatattgatgatttatataactttgttgttgatgactttttcagttgaaatcatttagtatttgaaaatgttgtttgaacttgtcataatttgaaattcaaattcaaattcaaattattgaaacatagtcatatagcaaaatgaccaaaacaaaagttgtagatattgatgatttatacaactttgttattgatgactttttcagttcaaatcatttagtatttgaaaatgttgtttgaacttgccataattggaaattcaaattcaaattatttaaatagagtcatatagcaaaatgaccaaaacaaaagttgtagatattgatgatttatataactttggtgatgatgactttttcagttaaaatcatttagtatttgaaaatgttttttttaacttgtcataatttgaaattcaaacaacatgcttgcattgcttccagtcttaatgcctatcataagaatatgtcgtttggcttcaagtcatggccaagatatgttaatattatcttcaataaatagttgaccatatggggcaatctatagtggattcatctggtggtctcaactatatgtatgtggtgcatgtgtgcgctcacaagcatatttaatttgtcttgctgctttaataaggccatagcactgtccaatgtgtcattcgatggtctctgaccttagcaatttattatgaccttatcactttattacgacatgattaatattatttgtgtaggcatgttctttacctaatttatcctgagcggatttctgatgtttttgtgaggtttagactatgggacataattaagattgtcatcccaaaaagtattgcaaaacttagaaggaaagcaaaagagccgggggggtggggggggtgggagtaaacatagtcaatttcccggctgctatcccattcctcgttttctcaggtttgggagacatatagccacactaaaggcagtaaagctgaggaatgacaaccttactcacaaggacaaatagtcgttaaaaaactatgacatcactaaccatatcttatttcagtttaccaaacatacatttaaatttaggcagtattacggagaactaaatcaacaaacaacaaaccatacttcattgtcaaaacaaattgccttctatgtacttcacaaattctcacaagatcatatttgcaatttttcctaaactaattaaccaagagcaaatatgcagtggagcattccacatataatttcacattataagtatataatacagtatggtataatacacatatgcatactagggcctacggcaaaagaggcaaagatcaatgtgcatgctaacttgtgtataatacacatatgcacagtactttgaaataagcataccaggacatatgcattagttcacaccattcattcttgcattcttgcactttcaacaacaatcagatctaccaagcattcttgcacattaaaccacaagtagatctaccaataaatcacaaccttaggtagcaatgggggtaatcggaggggaaaaccttacctcgtcagacgacggaaggacaggagacggcggaagattcaccggctgctcaccatggcgcgcggatccctgaggtgtgggcatcacatctatcagcaccaacgacatcggcgggggggggggggaggactggggctctttcatagaccgatgtaaactagacttattggctttgatttagggagaggaaggaaaagagatagactttacccggcatggctttgggcctgcacggagagggatagtagttggcttggtttcagtcaaaagatatgaagagaattttaaattgtttttttcaatttaaataatgacagaaattatgttagtattattaaaattacttctttagctcggaaaatttcaaaaaaatttaagagagcataattaattattgagaagttattaaaactattccaagtcatattttacaaggtaaaattttatttcacatatcaacttgtaacatacaaggaatttcaccttgaaaaatttttgtggaaaatttaaaactttttgaattcaaaagtttttggtgaacatagaagcatactagagcatataactcccttaaataaaataaaacacatagtttttctggccaaatcaaaactaagtccaaaagtaaaagtttacaaatcttgtggtaaaaaattttaaatcaaaaattttgctttgaccataaactgaaacctaatcttctcggttttgcattttcagcctaactaaaaaaatatatttaagttaaatataaaataaatggaaaggtaggtatcaaaatacacaaacctaaatagagataaaaagaacttgcttgtatatgcatattattcttttaagattgtttttggatattcttggtgcatctcataataggt

SEQ ID NO: 73732 - DNA, 1242 bp, Oryza sativa
tttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataatgcttctgcctataaatagtagcagcaccttacattcaagaatcacctctcaacacaaaactaagaaacatagctagataaccagggaaggtagcatcagcaacaggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgacttcacttccaatctcacgacttcaggcatatatcttgcaacatgaagacatcttatgctctacttccactacaaaattaactaatgcgctaatgggatttccatattttaatttcacagttgttgctaagatggacgaaatgggagttcttgctaagatggacgaaatgggagttcttgctaagatggaaggacaagcctaaaacaacatatttgcattgctaccagtcttaatgcctttcataagaatatgttgttttgcttcaagttatggcctagttatgttaatgtttatctccaataaattgttgaccatatggagcgatctatagtcgatccatctgttggtcccaactatttgtatgtcgtgcatgtgttcgctcacaagcatatttaattt

SEQ ID NO: 73733 - DNA, 690 bp, Oryza sativa
tcacatatacgctacccctccgactccgagcacctccgccggcggccaccgctccgaatcgacgacctgaccacgaccaagcagaagcaggcagtcagtcagtcaaacctccattaccacatccaacaaatcgagggaaagaaagagacgatcgatcggtgctcacaagtagagagctacaaaagagaatttgcaaaacaaatttgacacagatgataagtggcaatgtgaaaagaggggaggagattgaacttgaatccggaggaggaagaagaagaagaagacaaagaggaaacttgcagcaattggggggaaaaacaaccgagagtccaggctggccatcccgactacatccaatacaacaactatataataataataataatttaaataaacacggaaagaaggaaattttaaaaaagaagagacacaacaacacaaggggcgcgtcgggatggtccaagtcagcggctggcacgcattggggaatcaaattgacggctacgaaccacgcaccatcgcaaaaatgacacaggacgaacatttcacatcaaaaaccgataatttttcattccaaatcatcgactttggatccccggaaaatccaattgcaacccccagtcagtttcatgggggatcaaaaatctcaaatttcccaagtgaagcaagaaaaggaaacagcttgcgggg

SEQ ID NO: 73734 - DNA, 1124 bp, Oryza sativa
ccactcatgctaggttgagtgaagtacaagtgggatcatagcctcaaatcactgccaactcctttaaatcgtttctaccgctcatgttgacacctagctctcactttccacctttcctttcaccattcattactacaaccaagatttttctgtgagggctaaaatgatttttgcgtgtgggtaaacggcccgcatacacctaggggtctaggaaaataacgatttttgcgtgcaggtggcgcacctccacgggaaaaaaaaacctgaaaaaacataaattttctttaaaaatgaaaccctagaatctagtggtggcgccgccactcctgcttgccgctgccgcctcctcgtcgtcgtcatcgtcgtcagcggcggcctccgcgccgctcgcctcggatccgtgctcccctctggccgcactgccgccgacgcccctcccctctgccagatctagggagggatggaatgggaggggaggggagctggatgccacgcggggggagggcgcccggctgccggatctgtgcggggacgaccgccaccactggatttttgcgttgatggccgccgccgcaggatccgtgcagggacggccgccacccgccggatcccacgcccaccaccgccaccacgtggaggaggccggcgcgcgcctacgcccaccgcagctgtcgccgcgcgccaccgccgctgccgccatcaggaggacaggacagtagagtggagagaggagaggagaggtgtgagagagagaggactgagaggagaagctctgcgtgcaaattttaaagttgaaaaggggattgaggggaggggagaggagagaaagaggggaaattttaaagtgggtcagagggaaaagagggagttagtattttgcatgcggctctcttaataggtctgcacgggaaaattggctcattttcacgtacggtccatttaagagaactgcacggaaaaatcgatttttccgtgccgtcctcttaaaaggaccgcacgtgaaaatgagctgatttttccaaaagcgacgagttgctgcctgcacggaatctaaaagggtccctgtagtagtgattaatcaagccaactcgccactgtgaacctcatctatttctcatagtgtt

SEQ ID NO: 73735 - DNA, 10886 bp, Oryza sativa
ttcttccttcactccgaaggtggtgaactccaaaccactcacaaacggtgccgggcctcctccacaatctcctcggagaggtcaccgggcaacacctccacaagccgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaaggggggttcaagataatgcaatggagtgccaaaaccttacccttgctgctggggagtgggtatatatacccccaaccaccaaaactagccgttggaaccgaaatccccaactttgtgctctgccggtcagaccgccgttgtgaggccggtcagaccggactactttgtaacggctagaaaactagccgttacagggcaatcattgagcccactcaacctggccggtctgaccgcagtgtagtggccggtcagaccgtccacggctcggtcagaccgccgtcggctcggtctgaccggttgcggctctggcagctctgtatcgccaccaaaaaccagaccagtgcaacaaaccagtggggccggtcagaccggccttaccacgccggtcagaccggctaacagacccggtcagaccggcctaatgcccacggtcagaccgcaggtcacttttcagctcaaccgaccgttagtaaaacggcgatatctcttgactcgggtctcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcacaagatcatccacaagctcgcttcatagacccctcttgatagtacgacgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgctgaggtcttgtccatcctttgtcaagactttattctcatcacaagcttgacttcattcttgttaacatgacgatgtccttggcttgatgaccactaacccatggtgtcattcattagcctcatcatagtgggacctattccttttcacacctcaaaggagaacattagtctcaacaaatcggttgtcatccttcacttgaagaccaaccggttgcatatgaaagatatggatatgtttgttgagtattcattaacttcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacttataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatacagagagatgagatgaaaaatgatttcaaatcaagatagaaatcttataataaacaaaatatagaataagctccccctcaagatgtgcatacatatggatatgaaggaacacatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttatagccggtttaggcatagttggttcttaaccagtagtatctccaggtagagctgggacttgggccctgctttctcgggccggtccaaggcacaatggcctagcacgagggaaagcacggcccagcacgacacggcaatgggccgggctagcacggcccgtagttgggccatgcttgggctagcccagcacgaaaaaggctcgtaggcccgaaggccggcccagcacgaaaaaggcccaaaggctggcccgagctctagcctagccgagcgcgcgaggagttaggagtgcgtgcaattcgggccggccgggaggagatcaggaggcaggagcgccgagccgccgagcgcgtgcgtgcgtggtgagacttcagtgatgcgttcagtaactgatgaggtcagccggcggctgcgctgaatactgatcagtaacttatgagcagtgctttcagtctttcagaattcagagagccgtgcatgcatggaaagcatgatttttttggctaattaattctgggatcacttaccattggcgattagtatcgtgtatatccactgtctagtcaattaaatttttgtttgtgttttttcaactttttaaatggctaattacctgtgtccttgtttactgcaatggtgcatgcatggaattatggaaagcatgttcatttgcgtggaagttcagagttcagacgcatcgaacggtcgaggtgtcgactgatgactgatcattggtcgatcagtattcagcacggaggagtcgtttagtcacgtgtcatgggctcatggcacggcatggccattggtcgatctgtcatcagtcaaggcgtcgagccgccgaggagtcgttcagagttcagacgcatcgccggctgataaccgaggaggcaagggagaggtgaagagcctggcgcccagccctagcataccctatataaaccatacccattttttttgatttcaacacacttcttcttctttcaacacatctccccaccgtatctatttttcatagaaaatatgcggaggtccaaaaagcgtcaacacgagtcaacaaccggtccatcccagaggtcggtcgatgcccgacagctatccctgggcatcgatgactacgggatgcatgatcgccacatggatggtctggagggcgacgacgatgatcagccatctcctagcgaggccaacttctccttcgacaccaacgccatgacgttgcccacaccaaattccaataaccagccatctgccagaagagcggagtgttggcagcacttcgaagtattcaccgagatggttgacggtaaaagtatacctcgtgctcaatgcaaatattgcgacaaaattttgtctgcagctacttcttcagggacaggccatctcaaccggcattacttggcgcatctcaagaacaaggcaccggcaggagcaagacagacacaattgtccttcggctctgacggttctgtaagtacatggatctatgatccaaaaatagctagagaagagattgctaagtttattattgctgaggatctaccaattagaatgggggaaagcaaacattttgagagaatgatccaaaaagctttttgcccacagtacaaaaaggtttctaggaaaaccaccaagaacgatattacagctatatatcattctaagttgagtgtgttgaagcaaactttcagtactactagtttttcatttgctgtgacatcggatatctggacatcccaacaccaaagaacatcttaccttagtgttgttcttcattatcttgacaacaatcggtcattaaataagagagtcatagggttccaactcatgacgtcacacacgggagatgccatagccacgacaatcctagaggtattgagagaattcaatttacaatctagggttgtttctattactcttgacaatgcatcagcaaacacaacggccatatcgattttggagtcggatctgcgaagttatgttggaggcttcgttattcatcagagattcatttgtcacatcatcaatctcatcgttcaaccaggtagtaatgttattaataatttattgattttagtgtatgcggcatattgcttatttattttaatgtatgcgacctatttgttttgcaggcataattgttccggataaattgttaaacaaaattcgtcattctgttcgtatcataggaggtaacacagtggtcaaagcgaggttccaggactactgtaaagcgaagaagaaacctggacggatgtttggcattgatgtcaaacataggtggaacaaaacatacctattgctgcgacagttaaaagggtaggaggagttaatttctgttttcatcaattagatgcatgtcagaatgaaggatacaactagacaattatccgagagtctgtccccctccccctcccccccccccgcatcgcccacgcgcaggcgacacggggggcaaaccctaccgccgccaccgccgctcccctctccccctccctctacctcaccaccgccggagctcaccgccggcaaagccgactggcaagctaggatggcggcggcagggcctcttccgcggcggcgccccctctctacgtgggggagttggcgttcgctggtgtcaaggagtgcagtcagggaggcctcccggttaggcagcggcagatccggcaccgctgtcatcggatctgggaaagctctggtggcagcatcgtggggtggcgcgatgcagcggtggccgctgcggcccgtggcggctcacggggcagcacgatgggtggtgaggcggcggtgttcacgcgtgtggtcagttgccggcgctcgcggtgccgttgcagcggctgccagctccggtggtcggcggcgcgtcggggtgaggcggcgtggctattgcagcgtgagggcttgtgcggcggcggtgttgcttgcatgtgggtggtggccggcatgtgggcggcagaggccgtctcttgtggggctgcggcggcagctggctcttgcggtcgcggcacatcgggtcatactggggggtgtgctagcgtctccggccacccccattcccctgaaaccaccctcttctctccttccttccctcctatctctcttcctctcgctgctgtctctcggcactagcagttgggggaggcatgcgtctccctttccttcctccttctttctctcttctctatttgccgcctcttggcacaagctattggggaggccgcccccctcctcttagttgtctaggagccttgctgatcaccccagtgcccctctctctgtgctggtggtgaagttggaggtggttgctgcagtcgaaaggttcatcccgcgaagcctggagctcctcaccggttacatggttgacaccgatgcccatttgccctgcttccagctctcagttcttccccaggcctgcctgcctcctttcctccttgttgctcctcccttcttttggtagtctgcttccagatccggccgtggagtctctcagtggttgaggagtttgtttgtccgtggggttggtccagtctgactgtaatcagggcttttgggcctcgccggtgcttcttgtgccctgtgaccgtgtgaacctgctgtatttccgagtttggaccggagtgcttacctctagggtgcgagagttcttgtgttaaggcggagtcggagctgctgcatcgggtcagctgatgagctgggcaacgataacactcaacactcttactttggcttcttggaggtcctgcaccttttgtgagagtgttgggtgtaagccttgcctggtctttcaggatcagcaacatcgactcctacgggtgccattccctccttggaggtgtttccttgtggactctctcccacctttgggtgaaaacccagtccaacttttgggcgggcgtcaacaatggctttggtcgttgttcacctccttggaggcttcgccttaaaggtcatgctcttccctcggtctctttagtggttcgtagttttgttacaggcttttttgtgtcttctgtgtaagggtttgccagtttccccttagcaaaccatgcagttgtaaggcccggttttccttataaacagggtcaactctcttcttctaatatatccggtagatctcctaccgtctactgtttcaaaaatatgaatgaaggataccgatgacaacggcgatggtgagattgtgattctcaccaatcatgagtgggagatcgctacacgtgtgcataaatttctgaagcccttttataatgctatagctcaattatcaggaatttactatcctacatcttgtttggtgcttgagtggatttggaagctggcacttgtttttgatgaaaaccgttctgatcgtattgtcttccattgttaaacccatggaagaaaaatttctcaaatacttcaccgctatacctcacctttattgctttgctttgatacttgatcctcgcaaaagttggaaaccgccaaggttgccatgaactcaataggtgatgcagtggggcttgattattctgaagcttttcaacatgtcaatgatgagctctatagggttttccgtctataccgaaccaagcttggtggtactccccgagttcctgagcagacctcacaaaagaaagcaagcaagtcaagtgcagtaaatttgtggatgcagtatataggcaacgaccaagcctctccatcctcagagaacaaatcaacatggaacccggattcagagcttaaccactacctcgccaccaatcatactgagcatgatccgacgcttgatggccacgatgtcgatctccttgggtggtggaaagagaaagagcgaactcttcctgtgttagctcactttgctcgagatattcttctggttccagcctcctccgtctcttccgagcaagcattcaacgttactggaagaattattgaagaacaatggtcatgcctgacacccgagacggttaagtcaatattttgtcttaaagactggatggaagcagacgaactaacgcaacactgtctacatgatcaagagtttgccgatgcaatggaagacgcattggcggaaatttgccttaccaaagatgatggtggtgttgatctggagtaattgatggtataatgtaaaatagttgttgtactcttttttccttacggggaaccctactttagggcgtaaggtttttaacgaggcaacaactatatattcaaattattaacatatatattttcccccaattttattgtctcaagttatttacgatattatgtcaattctaattgtgttcattaagccatgtacattattatctcattgttttttcatttcccctctcttattttttccctcccttatttcagtttcctctctcatttaccctgatttttcccctgttattatttcatttatcaatcagcatcgggcaaagcacatggtcagaggcaaaaaccctaggcacccggggcgtcgggagtcggtcctcggcggcagcggctctcagcgtcggcagccctcggtgcgggccgcacggcgtggcgacagcggctatgcgcggctgcgcgatgtcggtcctcggcggcggcggcggctctcggcgtaggaagccctcggcgcgggccgcgcggcgcgacgacagcggctatgtgcggccgcacgacgtcggtcctttgcggcggctctcggcgtcggcggctggcacgggcagcgccgcagggagcaggcggcggcggcggcgggtcggcgcggccgcgcgggccccggcgaaaaccctaggcacgacacgactcctcaggtaattctgggccgtgcttgggccggcacggctcgaagaggcccgacatgtctttgggccgtgcttgggccttgtcttctccacctcggcctagcatggcccggcacgattagcaggccgtgctgggccagcacggcccattctagcacgaagcacgatgggtcgggccgggccgtgctagcccggcacggcccaagtcccagctctatctcaaggtcagcaaatggtgttgtcaagcacagcagggagttctgctcaaagcacgaagacgaagacagtcaccctgtgtacaacaagtacaacccaacaatccatggcccaaaaaaaaaccaagaacaaggtatgtgcaaatctttctcccttgcaaagtttacttgtaatcactacaagttcaacatatgcaaatatatttgactgcaggcaccaatggagacccaggagctggtcagggttaaatgccaaggctaaagtttctatagaacatggtggttcagctagagttgatatgcaagccatagttccccattcctagagctctacaacttcatatgtgagactcacatttggcaaagcatctgtttgtgtctcaactcaagaacctacacaaaccaagaaaaagaagaaatctggtggggcacttcttcttctgcccccatgggaaactaacaagctctgaatatggcacgtttactactgttagagtaatggaagtacttgttttatgatgtaatggcaagcaaattagcccagtatttcagctttcttcgtagtgaggccagactatttgggttaatattccaactatgtgtgatgtaatgtcagacctattagcctagaacttctgctatgtttgttgtgatgccagacaatttggctaactatgccacctatctgagatgtaatgtcagacaatttcagttgcttttgtatgaatgatggagaaaaatatttcagttccattatgcaatatcatccaatctttctgcttgtttgcaaataccaaaagtgccttgtttgcaactagctgaaacatatgccattgtcatgttcaaaaattgaacatttggtgtattatttaggtttgctgcacaaattgcacatataaaccattcattcacaacattcattccaaatggttaccacaactcaggatacatatagttcatgaaaaacatgttgtttccaatgcataccaaacacacgatcttgttcacaaattatagaccacacatcaaataatctcagttcttcccaaacaacaacacaaacaccacaaacagacatgacaaaacacaaattacaagcacatttctctcattatctagcttttggttcctggccttcaaacttctaatttcttctttgttcagagcaaccacactccttacatcatctaccgctttcctctgttcttccccctatgccctactctgttgaacctccttccacagcacttcgttttccctcctcaacgaagtcacagcgtctcgcaagtcacccgaacctagaaatcaccccccccccccccaaagcaacaagaaaccctacattcaaccccgaagaacaccgactgcgtatatgcaacttcatctcaaaatcagccaaaatccatcatttactcgaccgttttgacacttataataccaccgcgcagggttgtcgatgctctacaagatccaccctcaccgccttggctgggcaacgacatcgacacattaccgcaggttggtaatccagaggaccaacccgacaaggcacgggagaggccttcgactgacagggaagaggctacccaatctcacatcatcaacacggtacaactgcagctaatccgtgggagaggtaagaaacatgttccttgatatggtcaatagcacaatagcttagccaagctgtaatcctaatgacaaagcttataggaattcttcaacaagacgaaacctgcacttaagatgccattctggtaaacaagtgcaaacacaattaaatatcagaaattgcaccgtggcacagagggtgaaatagggtcctaggccccaaatcaaagctacaatggcatacaagtaatcatgtaaccaacaatgtagtaacacttcaattaagcaatgcaaggtaggttgtccaatcaatcctaaacccataattaagtaacaaaatcaatgccaaaaatatatggaaactcactgtattgttatggtgaatctcctcagggagtgaagtctgaagagatgggcagcagtcatgtaagtatagtgaaaccaataaatgatcattgtcagaacagtggcacaaaaaatactactatgtgcaagtaacagtgaagtatgtgagagagaactgaacgcactccagcatatatgtatacaattgtgaagctagcagatatacaaaaccaggctccaaacagggagattcttgttagaatgtccatttgagagaaaattagcaggattaagaaaacatagcttgtgaagagcattgatgccattggcagctttctagaaattatatccacaatcatggccgacaaaaatgatcctggcctctgtacttgaagaaagcagggcagcatttgttataaaaatgagaatcaaatgcagttatgcatcagaataattagtaacaaatggcaaaaaccgacctgct

SEQ ID NO: 73736 - DNA, 3430 bp, Oryza sativa
tcttataatagaagcaatcgaccgaggcaagcgagagttcctatccatcagagattgggcccggtgaatcaaggtcgtgatcaggaagatgatgaggacagaaaaactcaatggtgtccttctagtattattaaaaagaatcaaaagagaagggttcaaagattaaggaacatggagcgctttcatgaggtagagcaggagatcaactatcggctgtagaaaacaaagccgaggtaagaatggcgtgttaagaaccaagctgccacaaccgatgaggtcaaagccgatgaagcaaagaggttagctaaagggaagagcattgtgactacatcggttaacatggttttcacgttacatacggaatttggagctaaacaagccgatgttgatgaagttgaggaagcttcggctaggttaattttgtcaccagagcaagtagtttttgagaagccagaagggatagagaatcggcatcttaagccattgtacattaacggctatgtcaatgggaagccgatgtccaagatgatggttgatggtggggctgctgtgaatttgatgccttatgctacattcagcaagctgggcagaaatgctgaagatctcaacaagacaaatatggttctcaaggattttggtggcaatccatcagaaacaaaaggagatttgaatgtggagctgacagtcggcagcaaaaccgtccctacaacattttttgtcatcgatgggaagagttcttacagcttgttgcttgaaagggattggattcatgctaattgttgtattccttcaaccatgcatcaatgcttgattcaatggcaaggcgacaagattgagattgtgctagccgacaggtcagttcacgttgccagtgccgatttagctctttgggagatggacggtattgattgcctgtccggaaaagtttgggatggagattttttaaaagtgtccgattgtgatatatagccaattgaagatggagagcccaagttattatttcgagggcgtcgtggagggttcaaacgtctacaccaaggacacagtagatgatctcgatgacaagcaaggacagggtttcatgtcagtcgatgatttggaagaagttgatataggtccaggtgataggccaaggccgacattcattagtaaaaacttatctcctgaattcagaaccaagttgatagagctgttaaaagaatatagagattgctttgcttgggagtattatgagatgccaagattcagccgatcgattgttgaacatcggctacctatcaaaccaggggttagaccatactagcagccgccgaggagatacaaagccgatatgctcgagcccgtcaaggctgaggttaaacgtttatatgatgctggttttatgcgtccatgccgatatgctgagtgggtttccaacatagttccagttatcaagaaaagcggcaaagtcagagtgtgtattgatttccgagacttaaacaaggctactccgtaggatgggtacccaatgccagttgccaatcaattggttgatgctgcatcagagcacaagatattaagttttatggatggtaatgtaggatacaatcagatctttatggtagaggaacatattcataagacagcttttagatgtccgggtgcaatcggcttgtttgagtgggttgtgatgacttttggcttgaaaagtgctggagcgacatatcaacgggctatgaaatacatatatcatgatctaatcggctggttggttctaacatcctcaaattttaaagtaaaatttgactgcatcatgctgacttttgattaatttagtgtgtttcaaaaatttatttggttcctaattggttcaagtattacttctttagaaccctactaattaaccctaattattccctttattccaaaccctagtgaatttgagcaaattctcttaaatttcaaactatagattatttccttagcttaccctaatattagtgaggatttgctatacttcaaaccctagtgaaacccttccaaattcatagattaaattcattcttttctagggaaatattcaaaaattctgaaattcactgttcattgcacataaggtgttcggtagaatgcctagcccaactagagcagcccaatcccctccaatcttgtacaaagtctagaattgatcctaggggaccacaacccactcaaaaccatggctttctttgcctcttcctccccttcacgcgcgccgcccgggcatccgaatagccgcgcgccgtgtcgccgcgcgtcggcctcggggccgcttgcgcgtgcccgacctccttggcgcgccgtcgcccgtccgacaccatcaacccactgccactgcaccaatcgcaacgacgacaaagccaggacgacgaccgccgcacgaaatcgccgctcgacgccgtgcgctctgtcacatcctgattttcgtcttaggatttataaattatttaataaattattattagaatttatattaaatgttcatcaatttacaattgaagttaaatgtgggaaataaaatttcctaaatataaagcatggatggatttaagttttattaaattctccatggttaattatactctctggaattttctcggatttttcggagatcaactattaattttaatcatacaaagaacatttcagtaattatccacatattaaattaatcattaaatggtctgattataactttgtgaagtactttgagtgtccaagtattttcaggatttttcttgaaattatttgagcattggaagtatttttaacaattcaaagatcatttcagtgattattttaattggaaaaagtttttaaatcctcccctaagccgttgggccgtattcggcccaactctctccctcctcgcacgtggccaagcggcccacgtcggcccagtccaagccgccggcctcccctcctctcagccagccgaaagtccactttacctccttggatactgttcatcttccagctccagcagcccgtgccgtgccctgtagctgacaccgcttcctccgtcgaattcttcgcatcccgagctccgtttgcaaaattagttgaggagaaatattcctcttatcctcctctatcctttcccccaagaatcggactgtcacaccctaaaaatcccaaatatataaattgttgtttaattggaattattagaatttattttaaaagcctagaagagaagatctaattttaattaataaattccaatataaaatggggccagataaaattttattaaatactttgcttaattctataagtcctagatttttaataaatggatttatttgagctaaggaagtatttttaataaatggaattgcatttcatgaataattaatttaaaaagctttaaaaatctttcttttggctttgggccgaaagttggaccaaa

SEQ ID NO: 73737 - DNA, 4583 bp, Oryza sativa
cctttttccttttggaatcatcagctaattcgctttggaaatcatcggatttgagctcgattcagattcccctttcctcccgaaccctaaaactttgcatcgcgtcgccggccgccgtgggccttcgccaccgccccctagcccctataaaaggacccccaggccctccgctacccgtcgccaccctcgccttcgtctttcatcgccggtagagccctagcgccgtaagtcctcgcgctgccgtcgccgccgcaggtccagccgtgcgccgccatcgcttcggtcgtcgtcaccgctcggagaggtcgccgttgtggtcaccaagccgtcgccgatctcgtccatccctccgtcgtcgccgtagaccgccggaacatcgccgctgtcgtcgacccgatcatctccgccgcttcgacctcgacgccgtcgccgcccggtcatcgtccgccgccgttttggtcactggtgagttcgccgtgtcgcccgcagcccgtagatgccttccgttcgcgctgtcgtgctgtcgttcgccggcgagcgtgcgcgtccgagccgccgccggtgatgacgtcatcgctgacgtcatcgttgccgtccgccgtagaccggccgtggacggatagatgtcggccgttcgttttggaaagatagatcccgaccgttcgtttccgtgagccactgccgtgcacccggtccaccatgaaccgagcctgctaacgcaataaatcccttttccttttcaaaaataattcattattgtgtcataattcaattaaaatctatataaatgatttaatccgatttaatctttaaaaattcataactaattcatcttagctcggatttagttggttcaagtctctaaatttttctaaaattgagatctatatgttaaaaatatccacatgtaatgttcatacttgtttatgtattgttttggtaattttgctcttttctctttagattccgacgttcccggagagtccgattttgcatgagaagactttgaagagttccaaggccagcaaggcaagtcacacagatcccaaacaaccctttgagcatgttgatcccgtttaaagctattgtttctattcaactattgcatttattttcgaatgtcattgggtggaattaacctattgttgttatggcccttttgttcttgattactttattctttgataccttgggttattataatttgactagttgagctttatatatgggttcagctagataacttatgctacactattatttaatgatggcttaatgataactcatgatggttaatcataattggttaattaattaatttgtcaactaaaacctgataaaggtgggttgtgagcatatggttttgatgattgtgctcatgacaattaaggaccggttcacgattttcggttgtgaaacatttaccgtgccaaccacaagccagcgtgggcaacggctttactttctgtatagtatggttcatagtagtgcaccagactgtgaagtggcggagataagcccacgagggtcgctggggagtccataccttgtttataagggggtgattatgatccgagagcggagcactactttgaattgtattatatagagggtacggtcacaatctctattcgggtacttgtcaagtatcgcgacgcatggttgacatgatgttgaggttgtgtcttctgggtatagtggtacacctctgatcagagtttaaactattcgaatagccgtgcccgcggttatgggcgggtctaacaatgtctttcgtgattagtctcacacttctcaccctattaaatgatgatgttaataacttgtttagctcatggtttggaatgttgtatagcgttggattaatattgtttaattattatttaactgttttattaaattatgaaatatttattaaatgttgtttatgcaactgagactatactatgccatcctttgttatcctgtgcacttgcatatttgctgcgtggcttgctgagtgtgtcatatactcaccttgcaatcattcatcagaggaggagttctacagcgatgctgatggtgtggatgattaggcgtagccctggtcaagctgcatgtggagaggagtcgcctgcgctgtttcttttattttccgctgcttagaactttattggttgagaggaactatctacctgtgtaatgacattttattcgcttattaattagagtaataattgtactctattatcaatttgttattgtgtacctcggctgattcctggacgagggtttctacacatgtaagcgtttggaattttggatagaaattccgggcgtgacaaattggtatcagagcctccttgaccctaggttatgccaaatggttgcctatggaagccctctaaaaatattggaaaagtagaactgttgtcctctctttctcttttaattaaaccaaactaatggcacatgcagtttataattcctttaattgttctcattcaaaatttatttattattcctgcgttgttagtactgtacatctattactgtactaaaggcccatttaccagcaaagagttttacaatgttattttatttaattttgctgcaatgagctaagcttagcatgttgattttataactctcttttattttatttcttttgaaacctgttattcaaaagtgcaaagtttgtaaacctgtttctaactgtttcaacttatcttgcaaacttggtttgctttatttatttaccttttattttgaatttctaacttcattcaaaataacccaaaaacttgtgctattaactgggtaaatgacttaaccccccctcctttcacttgtctttagatgccgcgctacaagcctgagtacttgttcggtaccgaaagatttgtccaggagttgcgtacgatgtctttcctcataggatttgggattgcccctttgtatgcccagatccctcatgatcgtgatgaagagaagtgccgggtcaaagtcaccttgaacagcaaccgtgaagatattccatcagtgatgttcgaggctggaggaggaagctacattcatgcttgtcaggaggtggccaggatcgccataggagagctccgcgaaagctacaatgatcggttggccgacaccgagtatcactatcatcctcgtcaaccccagggaagtgaccgtggtagctaccttgaaccggtagggatcgagaatgatgctaccacaaggcatttggttgagatgctgtgggctatggatgaaacccgcgctgagattgtgatagccgctcaagatcgtgaagaccgaaatcgcggcaagatttgcaagctagaagacaaggtgaatcgtttggagaaggagctagctgcattgaagggagaagcaccaccgcagaaggccagggttcgtcttaccgcaaggaagagagctctattcgtccctcactaccagttggcgccaaaggttcgtgtggtggaaaaagaagctatcccaggcccagcagatcctccggtcgttaacgtaagcgatgatgatgaagaagaatgcaagcgcacccattccaagatcgagtggggaccaactcaagatgatggagacgtgccgaacgagccttcaatcaactccgatgcccggaagacctagaccgttttgtcaagtcgttgccttagattgttgtgttagtttgcttgctttagtttggttatgtgtgtgggtcttgcatgtggtttacatcattgttagtaagttggtgagttaggtggtgtgagagtcttcagttttgtaataatgaaacttagttaagatcaataaaagttaagttaatcaatttaattccctgtcctaagtagttttcccctgtttctcttcttgtgctcctgtctatgtcagatggtgctcactcgcagcaacgggaatggccccaaccccaacaacaacaacaacaacgcagagaatcccacgcttgctcaagtcttggcccaacaggcacagttgatgaatctgatgatgcagcaactccaaaaccagcaaaaccaaggaaaccaccatgcgcctccccagaacaagctggcagagtttcttcgcgtgaggccgcctactttctctagcaccactaatcctgttgaagctggtgattggctgcacgccatagagaagaagttggatttgctccagtgcacagaccaggagaaggtctcttttgcttcccatcaactgtatggtcctgcctctaagtggtgggatcacttccgccttaataggactactgctgaacctatctcttggcttgaattcaccgctgctttccggaagacgcacataccatcgggagtggtgtccctcaagaagaaggaattcaggtcgctcactcagggatctcgtactgtcactgagtatctgcatgagtttaattgtctggcccgttatgctccagaagatgtgcgtactgatgaagagcgccaagaaaagttcctagaagggttgaatgatgagctttgttacccactcatgactggggattatcatgatttccagaagttagtggataaggctattcgccaggatgacaagtacaaccgcatggagcagaagaa

SEQ ID NO: 73738 - DNA, 3392 bp, Oryza sativa
agaaattaatgtaccctttaatataaaaaagaaatatactataggtatctaattaagactgcgttcgttcttgagctgaacatctgagatggaaattggagcaagcaattaacatatgattaattaattaattattactataaatttgaaaaataaatttatttgatttttagtaacttttatatgattcttttatgaaatatattgtttagcagttcgggaattatgctaattaagaatgagatattaccttaagcctagatgccggaacaaaaacaacctaagtgtgtgttaaaggcgtgcacttatatggatgcgcatgctaataatagtgcacacacatattttccatgtaataaaattaggattcacccaaaaaaacacattatattcgcagcctgcgctaacctgcagggagccatatataaaatttcgttttttttttatcaaaagtgggcaatctgtaagaaatcgttagctcagcctatcgtgggctgaagtactaacagagagtaacaggctactgggctcatccccttgtccttaaccaagtttctaccggttctctcgcccaaaagacaatatcaacgcgcctcagctttgtccaatcatactcactagtcgccatatacagatgaaaaaaaaatgttccaaatattggtcgatgagaaatcgcgacatatcattatcgtttccgtcaagaacaagaactccgcatatacaaatggagtaatggaaacaggttgaatcgaatgatcgccgactcgctacagaacattactagcaatgattccccagattaagcggacggtctgagcaagtaaggtcgatgaatccgtcttcctcctccgattgtgaagatttgcgaggagtacacttgcatgaatacattctcggattaaaggatgaaccgcagtcgtagcaaaacacagtgccacatctgcaaacaaaatttatcacatgaatgtaagaaatttcatgccgacttaggaagcaccagtgatgtggtggtaaagtcgtgggtgtatgactctacccaccagagttcaaattaatgctggtgctcacaaatattacgcatatatatgtgaactttctaaaaaactttagtgagatcatgtatgtgctcctggtttctatttcttagagcatgtgttaggagacgtattcgcggagatgtgagtgttgtgttgcgtgtgtagtgttgtgtgtgcgtgtaagtttgccgtgtaatcgtaaaaaaatcaaagcataattccataactacgggtctacggctctatttgaatagctgaaagtggtttgatggatcatttattttttttctacagttatttcaaagcataaacaaatgaattataactactgcaaaattgaaagtagctttataaaagcattcaagatgtcacaccccaatccggcaccgccgtacaacagcacctgacaggagcgtgtcgtaggaaaaacggcgtgaaccgcttcctacgaaaccgcgatctcagtaccagtcccaggacatagcgctggtacccacggtgacaaatatgaatcattgcaatccttataataaatagaggacttatttaccttaacttaggttgcattttagaacagcccgagaatgcaaccgacgacacgaacgaggaaacaccaacagcagcagcagcagcggaaccaacggactaacacccaacaccacaggcgacggctgggaactaggacgaaaccctattcttcatttcacttcatcttcatttcaaggtgtaggaactatatatatatttatatagagcaagggtgagtactttcgtactcagcaagtcacgagaatttaggtgtttgatgcaagcttggaagagaggcaaggttgttttgcaaatcctttgttttgaaatcattttgaaattactaagtggtttacttctttctaagtttgggccgaaaagagacttgtgtcttgattcgactttaagagatgtttttcaataactcaattggtaatgtaccgacccccgggtcagatcattacttctcggctcccagagccatttcacttgattaagcggctcccagagccttttcattttctcggactcccagagtccaactgcccagcagcacaacaatccgcttcaactcgggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggtacggctgttcgaacagttagttaacctctgcagagggggtacactttacccacacgacattactaacccggatcacccagtccgtgagatcagccatgtcgggagaccctaaggttttcatgacaaggcatttcgaaagccgacacagggttgccatatgccaacgagaggggtcccagaccgacaacaggttaggtcccagaccatattgtgccaggaagcccgagggttctacctgacaccagcccgttgaatccacatgtctcatggcatcatggctcctccgattagctaattactcagccaggggcgtcccattgcacccgtgtggtcgcacttattatatgctcggatgaatttcccacaggaatcggtccttatatgcgaatacaggacagtaccacataggcacaacccccgcatcgcgagttttcacaatctattttgttttcaaacacaccgatgccatatgtcgggttttcaaggctctcaaacacaccgatacaaacaatggtgtatgtggaatagttggtatatgtgctcagagagcacggataccgaagtaccacaaaggtggaacgacaaggaatcagggtagtacaacctacaaaaattagtgcgactactgggtaggtctgtcggtttggcacgcaaaccgaggccaagcaagttaagtgtgtgattctactaatgcaagttgcaaacaaaataataatgattttccaattataggagcaattggtcaaagggtgatttgtcttgctcaaggtcttcacgaagcttcacgtatcttcgagaaaacccacgatcgatgaaaatccggtgaccgcaactatacgcaaacaatcaaaaacctaaacaaaagaccaagaaaaaatatcctatttagactaaataatagtaccattagatagatcacaattttacagaattactggaagtggaacggggtcaatcggatgagcggttgagaagatatggattttcgaagtttattggattttctaatcaaaggaaaaacgatttaataatttattaaaccctttttggaaagaaattaaag

SEQ ID NO: 73739 - DNA, 41387 bp, Oryza sativa
ggtaggagtggcgcacggattggtgcaccgggtggaccgaaggatggcaggcccacgcgcagccgttaggctctccgtggaccgcgcgcactgagagagagaggagggagcggacccgccttgactcggtcttcaccgaggtggcgctgacgtggcgcctccgtggcatgccacgcaggccggcgagaggaggaagaaagaggccggccgagatggacggcgggcggcgggggtctcaccggagcatggcgcgacggtcttcggccaagggggagcacaccggagtgaagaggggcacgagaggaggcgagccagtggctcggattcgccggaggaagatcgacgacggcggattgcggcgacgcacgccggcggtgagaaaaaagggggaaacggcggaggggcgacaaggattcaactcaaggtggtgggagtatctctgggagtcggggattctgtttccggcgccggatagggtggaggagcaccgaggagggctagcgtcgacggcggcctctaggagctgacggtaatggcggcgaggccatgccaggcgacggcattgctatggaatggtttggggaggccctagggagttcaaggacggtgttggctagggtggtcgacgagctggggcccgacgacggcgcgcgactgtgtgccgcggctgaaaaagcgcaacggcgaggcgcgcggcgcattgtgcggcaggaggaggaatacggtggggagctcaccggtgagggaggagcggtgttggcgacgcggagggagtcgcggcgaggtggtcgcgacggcggggcggcgcggaaccgagagggcgcggccgagaaaaggagggaggcagcgaggccgaaaggatgatgagtgtgtgcacacgctcttggccacggcagtgcggcaccgagcttgacgaggccgacgccgaggctcacgcggccattggcacaacgcggcagcgaggaggcagtcgcggaggggcgggggcgagcagctggcggccggcaacaatggcgcgggtggttcgagcgaggtgaagacgaaacgagaggggagggcgcgggctttataggcgaggaggagaggtcggtttggaggagggaaaccgacattggcggtcaagggagctcggttggtgttcacgggcggcagcggcggtttcgttggcagtgcgaaagcggcgacggtgtggatgtgttgggcggcgaaggcggtggatcgagcggcggaaattgaaccgcgagcgcgggctggcgcggcttggcgtggtcaaagtgggggcggcgaactggcgcgcggcgtcagcggcgttctgcctccgcgcgcaatggcatgggcgtgagagagaggtcgagtctgagagggaaaaaggggaaaagagggagaaaaaggggaggcttgtccatgccgttctgggaggaagagtgagaggggagcgcgagcgctggctcccgtctttggagggtagcggcaatgggcatcgggagagaggagagagaacgagagagagaaaagagagctctctctctctcggccatggcgcacgcgcgagcggcgctcgagggaaggggagagcggctgggagagggaagtgggctgaggggaaaatggcccacaacacccgagggaggcaaaataaacttctgcatagagatttgagttgggaggatattgggattggaatttggattggagagaatttgagaaggattttggaatttaaccttgatacttggcctctaggaacataaggtggagtcaagggaaggattcgaggtgggatttgaataattttggattcgaagaagtatttggcgaggattcaaggaaggatttgaatttcgaagacttgaattggaatagaaatcttgaggtggacgattttgatggcgatgagagggaacaaggacggatttgaattgagatccatggcacgacttagactcgcacataaagaaaagaaatttttgcaatcaggattttgccgaattagtttttaacgtcttgctaaaagcgcggcgttacaatattttagtaagaaaacttttacacaaaatgcattggttagcagtttgagaaacaagcaaatatttctttaaaaaagattttattttctccataaataatggtcagttaccgctaagatatttctctcccttttcagcgtccacttcgcgagggaagttcagtacgtgttcggtcaagtcaacaacggttagtcaaaactaacgaatggaatacgtgtttcagatgagtggcgaaaatttcgccccgatttcgaagtttggaagcaaagtttagagatttgagtctagcgatcgaaattaaagattgaatcgaagaggaggatcggagtagtggtgaatcgatgagtttacctgcatgtcatgcgcttgcacccatcgatcttgtcgatcatggcgcggcagctggggcagcgccgccactcgcgccccttggcgagctgggtcagcgcgcaccgtgcgccgccgtcgccgccgccgccgccgccatggcggtcgtcccacggctcctcgcactgcaggcagaacgcgcgggaacaggtcgggcaggacgccttggacgccgcggcgcgcaggggcagggccgcggccgccgcctcgccctcgagcgccgccatctcgccgcagtcgcggtaggggcaccgcgcgcgcgcggggccgacggcgcgctcgcagagcgcgacgcaccaccggtcgaacacgtcgatgtcgagcagcttcttgcagcgctccgggtgcatgacgccgccgccggagcagccgcccccgcccgccaggaggcacggcacgggcacgctccccgccgcgacgcgggcctcgatgtggccgacgacgcaggcgacgcagaacgcgtgggggcagccgtcggagacgcggaaccggtcgaacaccagcttccactccatgcagacctcgcagtagaaccgcccgatctcgtcgtcggtgagcggccgcacgcggcccgcgcgggacgacgacgacgacggcgggtccagcatggagccccggatcagctcctgcaggtactgctcccggtcgagctcctgcgccgccgacgccgacgccgacgccgcggcgctcgccatgggagggggacgacgcgtacttggcgctaattcttcggcgagaaggaactaggaagtggatggagtggacttgggctagtgcgggtcgtcgtcgtcgttggtcgcgatccctttagcctttaggtgggtgtgtgcgctttttaaagttgggcaggtacagggtacgattggaacggttagagatgagctagatacacaacaatattatgcttaaaggcacaatatttgctaacattacgtatcatgctgtgagtatatttaggatatttaggttgtctataacttccatatacttaaatcaatcaagtgagatcattatttgtaagagttttgtaaaaaaaagtacgtgtagcaggactcttttttttaattattattattattatgcatgtgcacacactactatactcgtaatcccatacttacgcacccaccaattctcgatatcttggcaaattcattacaatccgcatcaaccataatgctaaatttcaacaaatcgtgaagaaaacaacaaattttggttgtgatcgtgatgaaagtcttgaattttctttgtaatagtttcctcagttaaagttatgatagtagtcataacccatgctttactcaattactgaggaatgactcgggcagtgacccatgccacggtgccactccactttcctccctcccacctcctcgccaccatcagagccatccgtcggaaatcttgcggtgacaaggatgttagtggtgtggggccttttctcccatgagctcccagaggttgcgagcacaaggtgatagatttggaggatggatctggccatgatagtgactgtgatggcggcaacgcggttgaagcgacgacaactatgaccaatggtgttgaagacagttccagtagtggatctagcgctggtgatgctagatccagtagcttcgaggctagatctacgtgaccaacgcgtggtagaggaatgctcgcaaggcatagcaatggcgacactgggcaatggtgagaccgcctgcgtggaggtacggggatgggtgtgagcagttgctgtggcaaccccctcgtgccgacaggatgcggtattggtagcagacacggcgataggaggaaggtgggggttgaccacctttgtgtagaggtgttggcgacaactctcctcttctcgtgcttggtagtcggcgacgggatggcgtctgtgtcgttggctactgcgcagatgagagaccacctgtaaacatagttatacttagctagaatcaacttcaaatacacatgccatatatccggtgtgcactagttaagttatatataggaaagccactatgcatgtgacatgggtttttttttggtaagtgaacaaaatttaaaattttcactactatttgcatatttgcattgcatttgaggtgtaactgtgcagaggaataatattaccaccccttttatttgaatggcttttattggaggataagatgcagttctccttttagaaaatctgcacagtgctttaatctgtatattgcatttattcatggttagatgctaaaaacatgatacttttatgtacagagaagacaagtgtcctcatgtatagtgatccatgtgttcggtgctcatgggtcaccatccactaattaatctttcggtccgcacaaattactacttcctccgtttcatattataagactttctaacgttactcacattcatatatatgttaatgaatctagacatatatgtgtgcctagatttataaacatatatatgaatatgggcaatgttagaaagtcttataacctgaaacggagagagtactactagtctctccatttcaaaataaatgatatgcccatattattagtagagattaagatgtaagaagaaaataatatagcgtttcttattaaatatgatgtactaattgttggtgaaagggtggttaaagataatataatgataaatttaataacaagtaattgatgggaccaatactacttaaaatagcactatttttttaaaaaaattaaatcctaaataaacaccaattttggggctgaaagagtagacacagcatagaaaagaaaacgaacttttcaattgctaatcaatggttgaaccgaaggggaatttttttttaaaaaagttgtccgatctgtttcgttgcaacatccagaatttatcagctactaaagactaaagagtaaccaacattgttggtttcttatcgtaactcatcctaacttattgattaaatatggagaacacacattttttaaataaaaactactaacactatcagcctacacacaaacccctataacacattttttttccaagggactcctaaaatgttgagaacatatatactcccaccattctcttttatgtgacctccaactccaaactaaaaaaacataggtataaatcagcagctaagatagataaagcacacacacataacagaatccaacacatctaataaatgtctcaattcaaagatgatacaatccgaaaccatccaaccatctatgtctttctttccaacttttcccagcaacccgctggaagcgaaaagaagcaaattgcacagatccacacatcattcaaccacgatcgatgaattaaaccgctaagaaatccaggtaaattcgattaagtaatctagtcgaccgacggatcaaactttaaattaaggaaatagtttggtttagcgaccagtaaacgcatgcagaatctgctgggggcagcagctaatgttcgacattgtccatgcatgcatcagcctccagcttagctccttcttcctcggcgccggcgacggcgagatcgattctgcaggtgatcagggcaccagaacgacgccgagattgtcgaggcactggcatttctccttcccctccagcaccgctcctatctggagcccacaaaggtagcagaagaccatgcggcaccttcaaaataaaccgcttgttaattaaataaaaaatgtatgatatgtgtgttagccacactaatacacacacaaacatatacacaaatctgaattatgataacgcatatacataaaagtctattgctccatgtaatctggcaaaatcgtattcccattaaatatataaacatacacctctgtaaaaatcttcacagcaagtttttgaattcaatgtgcttccatatcttggttcatattcaaatctacgccattgaacccccactaaagccattgaacgccagtttacttactacaattaccactcaaaagttcatttaacctggagaaacatcctaatgtgtacgctaaaaccatatcaaaccaaaactatcaagtataatgaaacggattgagagttggagggagtaaatatatatacaccactgtacaaagatgtaattatcattaaacacgagttataccaaacttctaccatggtaaaaatgtttcccaagcatttaatggtgcaaacggaaaaacaaaggaaccaaatatggattagacacaaactaaagcatgtcctaccttgcaatgtaacccaatatatgttgttaacactttctccctacgaaaatgttggataacgaatctacagacaagttcaaacatgaaaaaacaaatgtcccccctataaaaagttagaggacgaatctacaaacacattcaaagatgatacaatcagatgctttgttttttaaaaaccagatgagtgatgtgcaccaaaccgtatacgctatatattactccctccgttttaaaatgtttgacaccgttgactttttagcacatgtttgaccgttcgtcttatattaaaaaaaattgtgaaatatgtaaaactatatgtgtacatgaaagtatatttaacaatgaatcaaattatatgaaaaaaataaataattacttaaattttttgaataagacaaatggtcaaatacgtactgaaaagtcaacggtgtcaaacattttgaaacggagggagtaacaaaacttctgccaacaacatactactttaaaaaaagcgccttgacaaccaaagaaaaacttgacgtcgaataattaagaagaataattaaaaccatatatttgtgctctctatgctatctagcacatagtactaaccacgtattttaactccctatgctatcgaacgcatctcaaactatatgtgggagatacattttctccaaattatgtactacattttcctcaaaaaaaattgtgtaactacatttgaaatgctcgtgatggattaaatagagtaatgaagcaaatgcaagaacctatgaaatgctcatgatggatcataataaatagtagaataatgaagcaaatgcaacaacacaagaagtgaaatgaagtagacagggaggtgagcacagtagtgaagtgagttgagtacctgcaactcatgaccctgcagccggctgtcctctcaaccagcatcctgcatttggggcacgccttccaccgccgctcgtcggcgagcttcttcaccatggcggcctcgggccccttggagcagtcccggtggtcggcgtcgtccgccgtgctccactccccgccgcacgtcgcgcacagcaggtgctggcacgccgggcacgccgccatggccggctccgcctcgccgctggtctccagcaggatcccgcaccggcggttggggcagtacgcccgccggtcgtgcggcacggcgccctcggcgagccggagcccccagtcggtgaacgcggcgaagtcgatggccttcttgcacccctccgggtggagcacgccggcgccgccgtcgccgccgtcggcgcactccgggtccgggcacgccaccggcacggccccctccctcaccttgccgtcgatgtaggtggtcatgcactcgaggcagtacttgtggtcgcaggggaggccgcggaagaggtcgagcatcggcaaggtgtcgaagcagatgccgcagtcgaacgtcgggaggtcgccgtcggcgagggggagcaccctcggccgcctcgtcgacgggccggcctcgtcggggtcgaggtcggatgggcggaggccccacttcttgtagaagtttggcatggagaattcaccttcttcttcttcttcttctccggcgatggcggcggcggtggcgcggggtggtggttgcgccacgacgggcgattttgtgaggtattgcaccgggagaggcccatggagctctgggtcctcttgcagctcggcgatcacggcgtcgcggatgacggagtcgtaccagtcgttgtcgtggccgtcttccatgccggcgaagacggccggcgtgtccctgtcggcgagtagggcctgcctcttcgaggaaaccgagtcgttctcgttcgcgacgttgcggtgaacctcttcttcttcttccatgccgccggcggcgcctcctttgccggcggagatggccggggttctgtgttgcccacacttgccggcagagacggcaggggcggcgtggctcccttctcccgtggtggcggtgacggccgccggggtgtcggcggcggcggcggcggcggtgagctggcggtcggcggcggcaatgcgagtccatatccggccgaactgcgcgacgtttgggcgagggtttgcttgcaatgctgccatgaggttttctgccctagcccaacggccattgccggcgccacgggcatggccggtgccgggagcggcacgagccgccatacgggcggcaggacgtctcccgccgtggcggggagcggcggcgccgccagcgatgaggccgccggggcggagtgagagttcagtagacggcgccatggcagcaggtaggccctgtggtaaggtggcggtagagctcgtgccgatgtcggcggtggcggcgccgcccggcggccgcgggaggaaggccgtcgctgatcttgccggtgccggctgctgtctcgtcgccacggtgcggcgcccaccggatcgtaacggaggcggcacgtacagttggacggtccgcgccgccgccgccgccgccggcgcgtcatcatcatcatcgatgacgatgggttgggccctgctcccggcggcgccggcggcgagggaagacgtcgatcctacgcgatccatcggcggcgcgaagctgctccagtcgtcgtcgcccagctccatcagctgcgacacgtacaggtcacgcgcgaacgcctcgtcgacggcgacatcggcggcggcggcggcggcggcgtggtggctgctcgatgctcctcctccagtcgcagcagggtggggttttcctccttccatggcgaattggcgcgatcgatcgacttcgattctctcagagattttctagggtattagggagtcgatcgatcgatcgatcttgaatttcttgacctgcatgagaagaaagaagatgcgaattagggggggatttcttgtttctactcagaaaattaatgtacagatccgaggctgactgtactatctgaatttctatgtgttcagctcataaattgtactattggcgcctatatatatatgctgaataacaggaggtagatcaaagtttattcgggagtagaattgcatatatttccaaaaacacgtgtgcatgcgacttcatcggttaatattgatgaatatatactactcttgctttttgttcaaatattgttgtattttgttctcacttatattaagcaaaatcggcccttgtacaaatggtgtgcacataaataatctgataaaaatgataaacccacaaatacaatgaaatagatcgggatgtggatttagagtggttcctacatattatacacatagttttgcaaatatgtaaatatgcaaatagttgtcttgcgcaagcataaatacggtgaatgcaagtacataatacacatatattgaattgaaagtgtgattaatcagccatggtaagaaatgtcggttaggccaagaattcagtagagaatgatggagcagtggcaatggatctagtctgatctacgatgatgagaaaaaccgagaaaacatgaaggtaacttactagtgactatgaagaactaagggaggaggaagacacagttgccaccggtagacgagccacgccaaaagttgttgagagactagcggtcctcaccggtgtttgtggatggaccgatgggcctcgtcggcaatcacggagaagccgataggcttcaccggtgtttggcggcgataaaggggtagggcggcggatcgggattgggaggcgttagggtttgagggagaaatctataagcttcaatgggagtatatccgattgattgagatccgacagccacgatttatttggtttatgccaaaatctcttggatatatctattagtaccccataaattgtctcttccaacctcctattttaatatctcacccacctacttatttgacttttctcctactcattcactcctattcaacttttgatttctttgaagttaaaaagaaattaaaatctactaaaaaagctatcaacaattttctactcatctacccgtctattttcactcaaacatagaaacctatgcatcttgattcaatagaaagaataattgtttgaacaacgacgatcatttactaagaggttgtgaggaaaagatttagagacaatgaataatgctaggaggtggaagacaagtttccaaagggagaaactagcatgaggtttgtagtagcggtgaaggtcatgtacgccaagattttggtagagaatgatggggggagtggaagttagaagcaacatggaagtaagggcataggaattcacgatggatctaacttgatctacgattatgagaaaaaccgagtcgacgtgaggggaacttaccagtgattatgttgaacgcaagaggaggaagacggttgtcggaggctgtcgagagattggcggccttgccggtggttgcgaagggaccgacgggtcttgccggtggttgtggagagactggcacgcctcgccgatgttggcggagataccgaggcggcgggatgtgggaagacggcggcgggtcgggattggggaggtgttagggtttagggagggaggaatttatatgatcttcgatgggaggagatgcggttgattgagatccgacggccacgatttatttggtataaggaaacttctctagtgtatatccattaatgccccataaatgttctcttccaacctcctattttaattcctcatccacctacttttttaacttatcctactccttcagtcatattcaacttctattttttttatttttttgaaaataaaatcagctaaaaatttatcaacaattgtctactttttcacgaacacagagagcatttgcatgttgattcaataggcagaataattgattaacaactacgatcattggtcaggaggtggtgaggaaaatatttagagataacaattaacgttgggaggacaaagacaagttgccaaagggagaaactagcatgaggtttgtagtggttagcatcacttgctaatgttttggaggaggttagggggcctcagcaagagttggaggtgatgccaattcctaagtgagttggaaagggaaaacggcgggtggatcgctatggttttggcaactgcctctaaactagtagacatcgattaacaccaacataattccctttccaccttgtatgttaatttcttcccaacatacttgtttaacttctcatagtccttcattcttctacaacttctaaaatattcattattctaagaaatcaaaatcaactaagatgcaagctttgcatgtttaccatgtttggctactcttacatctttttattttttacaaacatgcaagctttgcatgtttacctaattcctctatttcacattataagatgttttggatttttaataagttcatatatggatccatgtatgtgcttcatatatgcgtcaaaatttatatgtatattagtgaatctagactaatgatggagaagccaaaatgtcttataatgtggaacggagggagtactatattagtagagcttgaaaaagaggctgcacattagatcttgtaaaaactccgactttaatcgaagacaaaaagaaagatattgaccatccgatcatggtagacctaaattatgatggtgtagatcgattgatatggtcatatagaaaataagattttacctatgaagctaagtgttgtatatgaaaggcttgttcactttgttgccactttcaaccctaccaaatttgacatgactaaattttggtaagacaacaaaccaaacggatccttaccaatgctaccttatcaaactttgttaattctagaagttttcactgttcaaaattctaccaaactttagtatggctttaaactaaacacaaccaatgctaccaaaattttggtagcgtcaaaatgtgtcaaaatatggtattaccaaattttggtaggattgaaagtaacaacaaagtaaacaagcccaaaatccaattattcttttgaaaaccacactccatagaaaattaaaatttatttatggaaacataggctaatgagtgtatatgaaacccaactcttttaaaatcttgctggtgaaatatccactagtacaataaataaaataagtgtcgtggtgccaaccaaaatgtggttagtgagatttctagtgctcccacacgccttttatttcaaatctcctgacaaattctcggaccttgaacctttctagataattttgaaatttggtgaggaaacaacatggaaccccccccctccccacgtgaagttttttgaattgtagagttctttctctgctttagggcagttgttatcccctctctgtattatgagcccaagctacatagtcctacatgccatgcaatctccatccattctatatcctagtttgattgttcgcatcagacaataccttgtggtggttgcaccaatcaaaccaaagacaacaatatttgattattaaaaatgtgtcgcacgatttaggtgctgtgtaactaaattagcaaaaatcgtatggtatggaaccaaaatttccttttgaagtttggctagatgcaaactccttggacctgatggtgttcatgcacgaactaatttctgtttccctagtcgcattgcctatatataacttattataccgtttatcccccatttgtagcacagtctagccagcctactacttatctttttgcctctctcagtagatttatcagcttagcttattaacgtagccaaaattggaatcttagagttagtttaggttttttttttcatagttttctattctttattagccttagcttttggaccactaagaatagaagtataaactttttactgtaaaagtatctttggtagcttcttttctttttctagactttatcacccgtagctcaacaccagatcgacctctacttcttactcctttgcttccatgccgcttctaacttccattgctccatcgctctctaccaaattcttgtcatggtgaccttcgttgacatggctgaccaacccttttattcaatatatgtttgttatgtccttgcattcaccatatttatatttatgattgcacacaacaactatttacatatttgtaaacactacaagtatatgtagaaaccgcatccaaattgtcgatcgaaagaagtcacctcgtagacgatgtgcccgttcatgtaacactgatgagtggagcccatttactatatgatgctcagtgcatattcggaaacatagattttgtaaagttgaacattgtaaaaactacaaattcatgagctttatgataacaatgctagaattatgcttgtttgatatttttcggcatactcaccgccatgggtgtgtgtgggttgagtatttgattatgtgcgcgcgtgtgtctttcacataattataacaaaaaaaaggtgaatttgttgtgcaactttatgtgtattgcacatatattctgttttagaaatttttttacccatcagtacatgcaacatggtgatcatcagtttttcatttgacaatggggacagtacataggaagaattgaatcactacaagaattcgtaattttcttgatggtcaaaaacctccaattataacatgaaaactgccaaggtggttatttattcatcggccgaccgccaaagaaatcagttggccgccaagaaaattatggattcttgtagcgaataaacttcattatttgtgaaatctagttctaaaactaagcatccatgccggattaagttagtcacctgcctgctcttccaagtgatcctccatcttctccatgaaggagaagctcaaaattcatacaaacttttcaaggaaagaataaaggcgactcgatggtatttgcacgagtcttgcgactatggagaaggagaagcccaccaccgcttttcccgcggttttcctttctctttggtgcaatgcaaagttgcaaatggcaacatatatattcgtctcactctgctgattccatggcttcttctatgatctctctctctcactagctatagctagctagccatggattctaccagcagcggcaggagaggtcgtcagagttgcgaggagagctgcaacaatggcgctcactggccgccgcctcagtcggcgagatgtctctgcctctacctcgccctctcggtcgtcttcttcgcgctcgtcgccgccgtgctgctcgtcgtgttcgtcgcgaggctcaagaagccgacgttcttgctgcagtccgtgcagatggacaggtcgttcagcctgatccagtcgtcgctgtcgtcgtcggcgtcggcgaacggcaccggcggcggcggcgcgaacgcgaacgggacggcgtgctcggtggcaacgctggtgttcgcggcgcagaacgccaacggcatcgggatcaggtacggcgcggcggcgctcggcgtcgcgtacgcgaacgagtcggtcggcgccgtgggcgtgccggagttctaccagccgccgcggagcgccaacgtgacggtgcccgtgcacgccgtgttctcgcagcccgacgtgacccggctcgtcgtcggcgagctctcggcgcagcgcaagtacttggagatacggatcgccgggagcatcgatgcgcgcacgcacatcatgaacttcgctctgcccaagattcaggttcaacctctcattatctgcttattagcttatatcagtcatagctaaaacttaaattttaaattttaatgttagatttaatctttttggttttattttcatcgtaatatattttctagcattagcttttgaaacactaatatcacacgtaaaaaagtttattctactgatagttgaaaaaagatcttcagatttcagacttgctctaaatcatttacttgcttgctgtaatttcaggagattggatcactaaatttgcaaactttcaacatgtttttgggtgcagttttcgattgattgcaggataggaactaactacaccgacatagtgcaccgggaagggatcgagtctgtaattacacgcaaggtattcactgaaacttgtattatgatattcttcagaccttcagtctctcaggctattgaccactgattctttctgcaggctctcctcgtatctgaactgcctcacgtttcacagaagtgctccatcaagattgacctgagatcaaggggaaagaggacaagtcttgacgagttaggatgctgatttaatttaagccggagattctttacctgtgtagcacgtacatacggctattttaccttggggaattttttattcgaaacccgacttgtgaaatgtaaatatactaggtttcttcagtagcaactgttgatctgtatattgtgggaaatgatttattgcactagagatagatagatggatagataaaagatcgattgattgtaatttgacacaatatgtcttatactcttaacatttttgcatttgttgctgaaaatgtgagaaatgtacttgagatataaatttacagtcatcacgcatgcatctgcgaatgcatggatcctttcaatacatgcttaagagatacaaagccccctttgctattgatcgatgagacttcataatcctgttcttttcagctagtctattggattatttgctcgatatttctaaaaaaatatatatttttctaagaaaaactttctcctactgttgatgcgaaaaacacacactggcctggaagatttgcttaactccagtgtaggtccaaagaattgcttttggtttctgagcatgccagttggtttgatccttaaaccaacaagaaagaaaagaaacatagttaaatctacaaacgatagccgatcggctgtattgccgatgacatatcgttcaatattgggccgatgtgaagtgaaccagatcagcaataaagaaagaagcaagataaaattaaatctacccgatcggctgtagatatcaatgatatataatctatttctaaaaatatgtttaaactaagtgattgtgatagatcggacagtctgccgagacaatataaatcacttatgtttaaaagtacttcaagattgagattatatatattcatagcatagccgatgaagtaaatcttagatgtatcggctaatactccgacactgctctatcctaagatgttaaaacagacaaaatatactaaacaacgagcttaatatattttaatgcaataagatcttaatataaatggcagatttagcatatcgagtaaacatgtaaggaacaagataactaaaccagataagatcggctgaaaccccgatactatctctatcgataatcataaaacaagctagatattatggttctagatgttacttaatagatcgaacatgactgatgcagcattaagtacaaagagaaacataagatctaaacaagtcgatgaaaacctctttgagatggtagatatactatataatctagatcaacattgatgtttaaccctatcggctaccctctgatgatagatgctagcctatttaaggttagataacgatattgaaaaagattatataacatatatgataactcgacgatttacataaacaagattagagtatcataaagatgtaagcactaatcccgagaacacaagccaccatgacaagttttacctcttgctggagatcgaactcgttgcaacccaacttgaaagcaagaactcgtcgaaaacaatgaaagtagaaaaggtggcgattgaactgtcgttaatttgtttacaaggtcttgggtcatatttatacccaaaatatataatatgtccttgccggacacgactcccaatctgttacaactctaagatataaaagtcttttaggtagaatcttaccgaaaatatctctaaaaaaactaccagaaaatcctaattaatagatacaattgccttcttaggactcaatccatatgtggcaatacttgtgcagcacatcaatcgatcccgaagatgattctagaaccaccttactagatcggctacattggttgttctttgtccggtccaatatcagccgatgcagacattaaccgatgctctcgtagccgatacgcactctgtttctgggaacgatctcccgccaaatccgcttcgactttagcttcgaatttgatgcatgatttaccaaatttggtcgtcaacacctactatattgcttaaatcctttgttctaaactattatttcacaatatttgatttaaatttataatcgtgtagaaaatcaaatacaataatccggtagataatctattttaaactagagtggtacaaacgcaagcgctcataatgttatcttgagattgacgaagtcaccacgaagtcacgaacgtcttgttgtatgtcacctaccactgaatacaattaaccataaatgtgagtatccgcgtcgagtctaggacttaaattcagatggattagttctatcataaggaatctaaccagtagagttacactcacacagttgagttacactcttttcactagcgtgaaacttttgcttactagtaatatgcccccacgttgttgcagtatttttagttaaaatctactaaaaattaaacgtttggactgcttgcttgaaaaatataatatataatatgtagtgaaagttgtatcggacaacctgaaatgaaacatcacatgaaccgttggatttttactcgttgcaacgcaagggtattttttctagtattgtataaaattcctttgtatttgctcaaaacataatcttaaagaaattctaacataagctctatgttcaaagaaaaaaaatccgttgtgtctatatctctcatctaattagtgagttttcgctctgtgcttcatccaaacggtatttcctacagttatagtgcattttttcggtccatgggattcaagttgctatggcattttaatcctgcgtagtttttatttccgtgttttgagaatcatgggttccaaagtaaccataagaagaataggggtatgacaaaaattaaaggttgttgcttatgggttgtgggattactaggttgtgggctgaagagattggctgaagatttagtttggccgatttaaaacttcagtgtgcataagtgtcggaagacatgtgtgagtgatgtcattctacgtggtgcattctttttgactggtttgcaccgaactcccatacatcgaatacgtatacttcctccgtttcataatataaatctttttactattatctatatttatatatagatattaacaaatctaaatatatatatgtgtgtgtagattcattaatatctacattaatatagaagaacaataatataaagtcttatattataaaatgaaaggagtagttttttcccatccgcaaaagtttgataacagaatgttgcttcatcacgcgtaattgcgtgtattcaataattcaattcccgccaggttatctccttttcacacggaagttcggagttagcaaaaaaacgattttatattgcacgtgttagttcatgataaggctgttccttccagctaataattcccttaagcgtacagcaatcttattttattttatccatttatttgcaacggtccattccatcggaacattcccgaacaatgtgaaaggtatcaaatggaatatatcagcgctatgtacgtttggcaaaatttgttctgggaaattcaaattttgcataatttattgataaatatcataaaaacgtatcattgctaaaagacatttaaatttgataatttactgcaaaacatttttggctcgagtagagagaaaaattcttcaggaaaaacaagaacacattaaattcttcagaaaaatttttggtcaaaagcttttggttctaaggatattatcgtcttccttaagaatttatctatctaattgagccagaattgtcctctaccaaattatcagtttttacggtatctttcaaccgtgacatatttttacgatgtccatcagcgaattacattaaatttgggtatcctacagcaaaatttacccttttaaataggagatgtccaacaaatttcaaaatttgtagccattaatatataaatatataaatatattaatggctacatattttgaactatataaaaaatatattaaaactcttttaatatagcttttaacagtaaggatgtcgaatatatatcgcaccactaatttttttttcatatggccaaaacctatttttgtgtgtatctgcgaaaatcactatttttttcatgcggacagcgcacctgcacaggaaaatcgtgcgcgtgcttatgtcgtccgcacgcaaaaacaaaaatacgaaaaaaataaaaaatcccaaaaaatcaatctcaaaaccttagcaaggtctcatgccggcgacagcgtcccgcagtctgccattgctcgtcgtcatcgccattgccatcactgagtcccgtagctcgtcgtcgtcgtcaccgtcaccgaggccgtcgtcgctcctccccgcactgcattgcccctctaccgccggatccgcacgggggagcgtggggtagggccgccgcctgtagatccgtgtggggaagcaccggggagggccccactgctgctgccatcaacacgtgcctcctccgctgggctcctcacaccacattctatcggagtcacagtaggaagagaggaaaggagaggagaggagaggagaggggtgagaggagaggagaggatcgcctaaacacaagagatatgctgcacggaacgaatctcagtgtcaactcgggagccaactgtgtactcctactttgcaacacttctatgccagaagactccaaccacacgtttttcacctgctcattcacaaatcaatgcaggatttttcttggttttcgttgggaaacgaattaagatgtcatgaacatgatgattaaaaaaaaggaattttggtcacccattctttattgaagtaattgctatagctctttggaacatttggaaacgaaaaaatgacttaatattcaacaacattcaaccttctttcaaccttaatttggaagcttcatttcagggaagattttactctacttttgaatagggtaaaaatacatgatcgaccaatctggcaaacatggcttgataatttctaataatccctcgtgcttcgccttctagagtacataaactctctgccctttaatataccgtagtagtaggagcctctcctactgttttctcgtcaaaaagaaaaggaagagagaagaggctaagcgaggagtggggagagagtgaggagtggacgtaggaagttagatatttgaaggtgggcctcttaaatggggttgcttgtgaaaatatacttatttttatatttgggtatatatgttaagaggtcagtctctgaaaattgatttttttttcatacggatcttttaaaggagcttatgcgaaaatgtaagttgatttttacgggcgcaatcagttacaatccatgtgtaaactataggggttctcgtaccgtttcggtagtagtgtcagttgttgatttattcggtgatacttattaactgttacatcgaaggaggactgtctatatgggattcatatgattttttaggcttccatcatgcagtgtttcaccaaataaatcgaaaatgttttaattttttaaaaaagttggaacacaatcaaatcactccatgaaacattttgctacgatgtatgaaacaacggttcagaatatatatatattctgaaatatgaaacaaatccaaatacatcaagaaaaagtctatatgggattcacattattttttaggcttccatcatgcatattttgaaactaatcgggcgttgtttcaccaagtggatcgaaaatatttcaccaagtagattgaaaatgttttaatattttaaaaagctaaaacacaatcaaatcacctcatgaaacatttttctacaacgtataaaacaacggttctgaatatattgaaacatgaatgatttagctatcaaaaatcattcgacagccatttagccttccgataaaaatatacttttgtgcgtgtagggttgatcagttgggtatgcacacgtctaccagcattacatctcttgcgatgtttgaatacgtgaagcatcttttgttccgagtactagcagatgtttcgtctctttgttgcaacaatatgtctgtactatactgtattacttaatatcatctactttgtttaataacaaaaacaaaaaacatgtgcctctcggagactatatgggtgttcaaaatgtgaaaacaaaacggaaacaacatgatatattatttaaaaagagaatgaatggattatatgatgcatgaaacgtgtcattcgttgttcttaatttatagcgtttcgtgatttcgtcaagactcaacaacttaagcactcctctaatatataagaacccccatcaaccacacatgcaaaaagcatcctcaggcaaaatcaataatttagcttgcaagcaaattcatctcagtgcagcatgagcagtacaaacaagagctcgccagctcgaaatgagagcggcggcgacggcgacggcgacatcgccgtcgacctcttcccgttcctacgcgtgtacaaggacggccgcatcaagaagttcgtgcgccacgccaccgtgccagcgtcgcccgtcgagaggagcccgagtggcgtcgtgacgaaggacgtcgtcgccgtcgacgacgagaccggcgtgtccgtccgcctcttcctccccgtcgacgcggccgcggccgcggtcgccgccggcaggaggctgcctctggtggtctacgtccatggtggcgccttctgctccgggagcgcctccgccccgccgttccaccgctacgccgagtccctcgccgcgcgcgccgccgcggtcgtcgtctccgtggactaccgcctcgcccccgagcaccccatgccggcgggttacgacgacgcgtgggcggcgctccggtgggcggcgtcttcccgccactccgacccttgggtgtccaactacgccgacaccgcgtgcgtgttcctcgccggcgagagcgccggcgccaacatcgtgcacaacgtggcgttacgtgccgccgccgccgccgccgccggcgaggacgacgacgacggcggcggcggcatcgacatcgaggggataatactcctgcagccatgcttctggggcaccgagcgactaccctgcgagagaccggccgcctggaggcgcgccgcgccgccgatgttcctgccggagaggctcgacgcgctctggccgttcgccacggcgggcgccgccggcaacggcgacccccggatcgatccccccgccgaggcggtggcgtcgctgccgtgccgccgggcgctggtgtccgtggccacggaggacgtcctgcgcggccgcgggcggcggtacgcggcggcgctgatgcgcggcggcgcgtggggcggcgaggcgacgctggtggagtccggcggcgaggaccactgcttccacctctcgccaaggcctaaccccaacgccgcggcgctcatggaccacgtcgccgagttcatcgccaagggcaacacctccacgtcgtcgccgatggcgaagcggcggcgtcgccgtcgccggtgcacgttgcatggcgcgggcgcggagaaaacgacgtcaatgcatgcgttgcgaggccaaactgcgccgaaagttcaacatgccggatcaggaataatggccaataaggccgacaagtatgtggtcaggagttgtctctgaagaacaaaatggaaaatgttgggccttgtgtttcctgaacttccttttgcccaatcactatgataaagtacaatatacctatgttgcaaaatgaagtatgtcgatgtgggggacagatgtatgcttaataaatagtttaatgtttttgtgctgctaatttttaaaaaatccatatcatcccttacactgatttctttgttactccctcttgtcattaatatacgacgtttatcaccaaaattagtgttaatacatcatatcatatattaatatttggagggagtaaatagttattatttctaaaatttaataaaaagtggaaaatgatatctgtgatttattgaaataggaagaatgctagaaacattcatgcatagtgtttcttagggtttaccttttccttgtggaattgaaaaccactccttattggttaatcgaaaactggccagaaacctgaaagaacgacgacttcaaggcaatgccacaagtaaaccagctcaaaccgatcggtttccgcaaactgaccaccagcgatttgccgattattacatgaaaaccgaacgattttggtgaaaagcgatgttctgttaactcgatctagtgtccttatttggccgacaacaacacctcaccttgtgctaatatccgccaatatcaaggatgcaaatgggttgatctacgagcccgtttatatatcacttttctatggctgtcttgtttatcgacatgtaaaaggtaacttaaaatttttaagcgagtttgttggggaaactcttttaatcaactatatggatgtccactcgtctattacatgtcaaccaaatagttgtgaaattttttaattttttttaacaaacatacacgattaaattcaacttctataagttataacaaaaataaaaaaatagtatacggatatgcacaactaaatttattttttttacaacatgtagaaatcaaatttgattttgtatgtttaccaagtgatatcatatattacaccttaatctatcttgtttaatcttgtaaaataattataagtatttaaataatataataaacgggtgatcgttcaactgattacaatccatctccggactcgtcggccgacccagacatttttttcctctcaactataggatgcaacagcgttgacgttgacctctatgcatgtaccctcgtctctcgttgcagctaagctagctaggcattgccgtatggctaaccacactgacaccctcatctagtcttcttctcctcttccacgtcgaggcctagtgttgctagttgataaacacacgccgaggctgggcattattgccgcatcagatcatcagtgtcattttaattgctttctgcaagtatatcaacttattatattgtattggggttaatcctaatgtatgtttacatatatcaatccacgcaagtaaccacctagtctatccgtttcagaatatagtaacctaaaatcggatgaaatgtacctgtccaaattcgtagtactacgctacgttctatccgattctagattgatatattcaaggacgaagggagtagctatgataatcattgccattatgttgatctggtaatgttaatcactacctaaaaaaataattttctcatgtgaccaaaatgaatttttgtatgcgggcgcaacaaccgctgcctccaactgtatgtaaaaatcggattttttttttcaaacggacaacacaactgtgtgggaaaatgaggtttctgcaagcggacacgttatgccacctgactgcaaaaagaaattttgccaacttttttcccaaaatccctagttcataagaaaccgctgccgtccactgtcgacaccacatctattccctgaaaaatggctgtcgctgaccttgcctttgacatccccgaccttcccaccgccgaattcacccctcccgaggctggcaccatcattgttatttctcccgaggcctctgtggtatacgtcatcgccactcctatgctcgtcattggcagatccacccctcccaaggcacacagcgacagatttggtgcccccgaaagggtgggtgtgggggggaggacggggtgtcatcgccgctctagaggttgacgtggtcatcgtcgcagctcccatgcttgtcagcaacagatccactgctgctgaggccacaaccatcgccgttgctactcccgaggctgccggactgataaaaagaatgaagagattgagctgagagcaaaggagaaaaaggaacaaatgagcagaggcaggggcgtgtcctttgattttaatatagctcttcggtccatggtggaattgtgtgactgaatcgactcaaaaccaccaactgggaaaataggtctattttgacgagcagacctactaagacaaccttaaccggaggagtcttatgtatttttaaaagcgggtcttcctttagcctattcgtaaaaatgttgggttatctaaaaaatggttttatagtagtgaattggatttccctgtccacctattctcctccttttttgcagatgcaaaacttcataaacaatatcgatcggcgccattgcttcagcaaacacgccttcctcccagtcccaggttctctctccttctcccagagggtccatggataatgattttattttatgtggcatgtcttaattaattcatgagataaggttgctccagcaaactgcccttctacgaaaatgtaccggccagaacaatattggtgcatgcatgaggatgtgaaaggtatcagcctacatgttttttaagaatggaaacatggatcagtattggttttttaatacgtatggcatctctcctctttgtttttcctatgcaagaacttcataacatttaatgcttatatataaatcatatatcttcctttcccagataagttcatcaacaacaattttgtattaattcacgagaaatttgttcctggcttcctgcgaatctatatattcccttctacggaatgtttatatgtcttttcaaatggaacgcgtatgcttgcaagatcgagagaaatgggaacgcgcatcgatcgatcagttagttgtgttctgagaattaatcaatcaattaaggtctcctaaaaaaactaattaaggggttaatttagagaacttcaccagcacggcacctctctactccctatatataagaacccgcttaattcccattccatgcaagccatcgtgcaagagcgagctacagttgcagcatgagaacaagcagcaagagctcgccgtcgccggcgccggcgccggcgcgcggcaacatcgccgtcgacctccggccgtttcttgtcgagttcaacgacggccgcaggtggatcttggtgcgccacgagagacaagacgaggagcgggaacggcgtcgcgacgaaggacgtcgtcatcgacgacgagaccggcgtgtcggtccgcgtgttcctccccgtcgacgcggccgcggcggccgcggcggccgggaggaggctcccccttgtcgtctacgtccacggcggcgccttctgcacggggagcgcctccgccaggatgttccacgactacgccgagtcgctctccgctcgcgccgcggcggtcgtcgtgtccgtggattaccgcctcgcgccggcgcaccccgtgcccgcggcttacaacgacgcgtgggcggcgctccggtgggcggcttcccgccgcctctccgacgacacctgggtcggcgactacgccgacctctcgtgcgtgttcctcgccggcgagagcgtcggcgccaacatcgtgcacaacgtggcagtacgtgccggcgccgccacccgcaacgctggcgaggtgttcgacgacgacgacgacatcgacatcgagggcatgatactgctgcagccatacttctggggcaccgagcggctgccgtgcgagacgcgcacgcgcgagccgccgccgatgctgctgccggagaggatcgacgccctctggccgtacgtgacggcgggcaacaacaacaacggcggcgacgatccccggatcgaccctcccgccgaggcgatagcgtcgctgccgtgccgccgcgcgctggtgagcgtggccacggaggacgtccttcgcgaccgcgggcggcggtacgcggcggcgctgcgcggcggcgcgtggggcggcgaggcgacgctggtggagtccaggtgcgtggaacactgcttccacctcttgccggagttcggctcccacgcggagaccggcgtgctcatggatcgcgtcgccatgttcatcgccaagggcaagacaccaccaccgatcagcatgctgatggaggaggagcgcgccactaagaaaacgaggtcaagtgcggtggtgccagcttgttggagagttccccgcgggccgaggtgtacggcccaagctgtggttgggcttcgacgtgccgggtttggggtgggcaacatgatcaggcttcccagtaaggcccagaagtatcatcgtgttcctgcaattgctctacggagtgtgctccagagttattatctctgagactctgatgactaatggaaacagttgtgttactgccttggatgtttcacggactagttgttattattatgtgtgtattattgtggtacgaagataatctttttaataatggaatttatttgggctattgcttcgaaataactagccccaagtattatagagttggcagttcaaaacaactatattttttaaaaaaacaaaacatacagtttgagaaacgtccaagaatattccggctagctccacaaggtaatgggctagacgatttgggttcgaaacccactccttctcattatttgatatcagatctttccctaatattcgcgtattttaaaaacataaagtttaaatacagacgatctgtaacacaagtctaaatacagaaagtgagatgacaacctactccattcgttgttggcaaaaatatgcataatctgcatataagtcctcctccttagattaggggtgaaaacggtatggaaacggacagaagccatctttattattttcgatttcattttttttcggaatcggaatcggaatcggaattgaaaaccctggatacgaaaacgaatcgaatattatataaaccaaaaacggagcgaaaacgaactggcgcaaatacggtacgaaaatttatcggaataaaaaacccctcaaactgataaatccaatggaataaattatctatgtttaagaaagtaatgttgttgataaatcctaatgcaggaaaaataatattcttatgtaattttagatttgcataacaattttttaaaaaaaatagcaggtaaacaccatgttattcactattcagtgcttaaaaaaaatctagggtatttcagtcacaaaatttctggtaattccgagaaaatttccggaaagtttccgactgattccgagttccgacgaaaactgcccttatcattttcgattccgtttccgacaaaatatttccgaattcgtttccgtttttgaaaaattctaaccgatagattctgttttaaaaaataggtctggaatctgaaaagttttcgtaccgttttcaccactaccttaaacctttgtcgtggattcccaaagaatttgaactcgaatttgcaaatactcgtcgtaatcatcggctgatcagatcacctcacacacatcaccgctgattattacagtcgaaccaagcaaaagataggggaaagtaactgaactgtaaatccatatgtctctatcttcaccagtgatggagagttgagaccgtcaccaacacgacacggaggacgaatatgcaacacacaaaaccgacaacaacaaaggagctaggttacgacggtaagataactgcatcgaagaagctataagccttcaaccaactaacaactcgaggtgaagccgtcttggactggtgatgttgcagaggagctcgagcacggacgcgggaaggaccagcatcacatgaacacaaacaagatcacatcgccgtcgacctcttcccgttcctacgcgcgaacgtacaaggacggcctcgtcaggaagtatacgtgcgccacacctccgtgccagcatcgtcgtccgacgagatcagaagcccaaatggcgttgtgacgatccccggcgtgtccgttcgcctcttcctccctgccgccgccgcatgcaggaggctccctttggtttgtctacgtccatggcggcgcgttctgtaccgcgagcgcctccgcgcgccccgttgttccaccgctacgcggagtcactcgccgcgcgcgccgcggcagtcgccgtctccttcgactaccgcgtcgcgccggagcacccctgtgcccgcggcttacgacgacgcgtgggcggcgctccggtgggtggcttcccgtcacaccgtccagtacccttaggtggccaaccacgccacatgttcctcgccggcgagagcgccggcgccaacatcgtgcacaacttgaaggtacggctcggcgcctcccgcagtggcgccggcggcggcgaggacgaaggcatcgacatcgaaggtgggctggggcaccgaccggttaccgtccgagacaccggccgcctggcgcgccacggcgctgaagctgcggcgcccggagatgcgcgacggcgcgtggggcggcggggcgacgctggtggagtccgacggcgaggaccactgcttccacctctcgtcgaagtttaacaacccgaacgccgtggcgctcctggatcacgtcgtcgccgagttcatcgccatgaaggggtggatccagcctgagggcggcgaggtctcgtgcccccactactggcgtgaagactataagagcctccacgaaaatcctattaaaattttctatatgtaaataggagggggaactttaactctatatagtttgttcagaccccactactatatcttcctgatccgccacttatcgccatggagacaacgcgctccagtgagcatcttgcatgcatagcgatgaagcagctacgttgcatggcacggagtacactgcagaagtggcgtcaagtgcggtgccaacttggagagcttctgacgggccaaattggatcacacagccaattgcatttatcgttgagattttcctaaatcttggttgattcttttcttaaaaccagggtttgaatttctggtacttgatatctcggctgaaattttcggtttttcgcaatttttggtgaatttggttaaattttattcaaattcagttaaattgtgtcaaaatttcagaaaaattcggtccaaaaaatgctgaaatttctgaaattttgaaatggccaaaattttagccaaaatcaaaatttaaaaccctacttaaaactttgagttctaatgtatagaaaaaagttctcaaaatatctatcctataataattaaggttgcaaatgagtcgatttttttaatccaatcagtatttttagttaaaaatgagaaaactttggaaaaattccttataaatactattactatgcaacacaaaaatttgttaaacagaagttgtatttatgtgaacttagcactaaaagccaaatcaaataactaaaactagtaaaaagaaatatttttttatgttttgttgccacaggataccttactttacaaccatatatgccattgatatggaacgtcataataatattatgttgctgatcgatattataactttataagattgtatagtttttatatgtactggctatggacttcaaacttttcgattgttgctataatgttttcagttgtgtactacatattatgttacatcactgtcaatccttgtaaaaagagtcctatatttttccctttatttcctgattttctcgatcacttttattattttaatacagaagcaatcagttttcgacgaaaattcatggctttcaattatatcggtgttcctactctcagtattcaacaagatttctgggcagtttaaaagggaattcacgttctcgttcacttgagatatatacctataggcgatcaggggcggatccaggaaagattaccaggagggtctgaacaaaccatataaaattataggcccctcttctaatagatgtatgacagaaaattttagtggggtctttatggggtcattacaatacgggtagcggggtctcgagaccccagagaccccatggtggatccgccactgtaggcgatctagaggcgcctgcacggaattccaattttggtttgtgagttttgtagcaaaccagtgggttttctcgtggaaaccatcaattcaacggggtttgaattccggtgttgtattaaatctgtaaacactgatgctaagtggcattcacttggtgactggtgtacacattaaggtagaaaaaacacaaaaatattcttcttcgtaggaaagatttaataaaagaaaactggatgaagctagtgtggtgttggaggtaaagatataagggagtaacccataacccatgaatatatttatagattaaaacaaattgtaatacagcttatattttaacttataattgaaagggtccttcgattgagccggcctgagtgcgaatctatattttaacagggtccttcgattaaaacaaattgtaatatagcttagggtctattttagttggtgaaataaaaatttttaggtgtcacatcggacgtttgaccggatatcgaaaagagtttctggacacgaatgaaaaaactaatctcataactcgcctgaaaactgcgatgtgaatcttttgagtctaattaatccgtcattagaatatgtgggttagtgtagcacttatggctaatcatggattagactcaaaagattcatctcgcgatttacatgcaaactgtgtaattaatttttctttttatttatatttaatactacatacatatattccaagatttgatctgatgttttttgaaaagttttaggcgaactaaataggcccttatatatattttaacagattcaaagagtgagggattaattaatttggggttcctttctagcgctgcggctcatgcactcatggtgcagtgttgcctttcctttttactctcgcttcaacaattaatttgcgtcagctcatcattgcagatcggcgcgtagctgcggcgaatcagtgatccgtgtgcactgaactcaaccatgagttaatgttttttagtcgtcagaacttttggcattcaatggcgtgagatcttttgcggcaattttggtccaagtgcgacccgtcaaatctttagtttcgtgatttgatctgaacagtagtacgtcacttcatccgtagtagcactacctccgtattcaataggctactacctccgtattcaacgaggtaatattcaatatttgattgtccatcttattcgaaaaacttataaacaagtttttaaaaagtagtcacacataatgtactttcaccgtcctaaaatatacgtatttttttatcctgacatggcctccgagatactactctgaccaacaatacctataaaaataaaatatcttaaataaaaagaattacatattataatagtttttttaatgataaatcttgtaatatcaaatttatatgattgatcttttttatatttctgctattagtggtcaaacttaaaaatgtttaacttatcactatgataaaaatgcttatattggatggagggagtactattcatgtttatcattttataacaataaaaatactatttataaaactttttaaaataagacgaacgatcaaatgttggatataaatagtgtaaaattgcaatctttctaggatggaggtagtaaaatggtactccctccgtcccaaaattgtcctaggatgtacagatacattgttctaagatgagtctcatcccatattaggttgctatattttgggatggatggactatttgacacatccttaaataacaaaactaaaagagagtaaagcaacatgcaaagaattagtaataaacctcaaatcttatagttctctgcatacagaaaaaaacaagagataagtagtgtcatattttggctgaaagcattagctctataaattcttctgaatatctgatcccctccatccaagaatttaattttagattcttgtatcaactgaacttgcctcctttctttccctcaatgtgaagagaatttacatgttagttagcaagaaaaacacacagaaaaatatataagaatgaacacagcggctcgggaaggcagcccctgaacctgtagggttttttccaccgtcaccttcgaccttcgtccttcggtccccctcctcctccgctatccggtccaataaatttatagggtttcttccaaataaagtctttagagaggtttaaatctatatatgtagagtctaggttttatcttccatggtgttaccgagttagctagatttgtctagagctagttagctttttcttgttcgcggttactactttcacggacttttcaataaaaatttaggagtatataatatagtaccttatattttttattaactagaaaaagtacccgtgcgttgcaacggatgaaatttattttaatcttattattgttatatggtttagttaagatgaaattcactgtgggagttcgcttggatatatatttttttagaaaatcatgagctgcagttagaactccgatcgtctcaagttagcatgcgagtttttttaaacagaattcttatatgattccctctgtattaccaaaagtgaacgatcttgaaaaccgactcaaatacggatatgcatttctagaagcaaatgaacttaaaaaccgactcatacacggatgacgcaccaaaatacctacaaaaacatcttcaatttttataatagtagggatagagatatgctcagtcttttttaaataaaaatctacagtgtaattatccttttggctgaatttaattgatttgcgtcttttttttttttttgcccttgtagtctgattcctttgaagggaccttctggttttacaagtatttactccgtatcctgtaggaagatatgcatccaagtacgaaggggccatggaaagactcaaaagaaagaagataatgctatagcatatgcattgatcaagcatgacgtgcacaccccatcaggcaatcactggccgagcctcctttcgctacccccacaggccacagtaatacagagttacacaagaacggaaagctacatctgatcgatctatatctcagtacgtacaggagtacacataagctaagctagctagggcaacttacgtacgttatggcgtatatatgtatccctgaagaaggggcttttcgcgtcgcttcgctcgtcaaagcaagctagcagtgaagaattgaattcaagtacaggctatcttgcatgtgtgttactcgaaacaaaaaaaaatttctcctcttttgacagggacatagagagagaagtgagcatagttaggttccttgtgatagaactagtatcatccaggtttaaattctagatttaacactgatgctcatatttacggcttattatttttttcaatggtaagcgacgtaccccttgagagtgaggcacccgtggttacttcgtcaaccttaagatataccagccgagtctttcggaggtactaatagagatagagtgtacatgcgtacattcatagaaataagtgtacgcgtgttgtgagcgtctatgtttgcaccgtgtttctcaaaagagagtacacagctggactgtatagtgttgtgtgtgttgtgcaggttgtgcatatatgagagaatttattattggcgcatgcattaataagctagctagccgatcgatggatcgatcgagttcactactgtagtttctactactccatctatttatatagccgatcgtcgagcaaaagaaagctccagctagatagccctcctcttgctcaccgtacctcgctcgcaatcgatcgatctctcctgcatatatgcttgatctgatctctccttaattataagctacacaaggtatgtacgtacgccgatcgacttattaacgcgcgattttaatttcattattattattattattattattattattattattattattattattattattattattattattattattgtacagcagcatttcaagctttaacttgttgcatgcatatgcatgattttctctgtgctataattaagtgagatatatgctataggctatagcttgcttttggtgaagactatagaacgttagaagacttagatgtgtgttttcgcacaatgatcatgcgctgcattggatatgcttgcatgcacatcaccaaatactgagaaatgccttgtactttattcaaatgtgtgtgtacacttggatttcaaagtccagattaaactccttagcaaaggcatctctttcataatttgactcctcgagaaaaggatagacttattttgtttcccttccgaatatatataaacctgattgtacactggtctcattattaattgtcttagtttgaccgagctagaaagcttggtgcacttgtaaaagacgaatattagggaataacctaatataaaataattagaatgagtgaggtttcgaatctatattgtctagcccaccaccttgtgaagctagccgaaagaccctgacacagctatagcttagctagggaaggcatcatcgaacatacgctttactgtttatgtgcatgcatcgttctcttctccttcttaatttgttgattaattacttaattaattaatacttgcaggcaatattgtactaattaagtagccgatcgaccaaggcagtacgtgttggcgtttgctgataatccttggaaatggcggcagcggaagcagcagcgcccatccacgatgagtacgtacgcgtccttgtgattttaggccctgcgctaatcaatcaactaattataattaataatgcatatatggatttgacaccgtcggcgttggatgatatattatggcatttggattgatttagatgggtgctcataattttttattaaaaaatgtttagagaaacgtctctccctttaattttttttcattttttgaaaatttggctgattttgcacgggttgggattttctgccaaaaaaaacaagagtgatggtttgggccaactgggcctcccaagcggaggggccatcaatcaatttgtaggctgtcctcgtttttatggcgtggactaaacaaatatgggacaaccattcattagtagacgtaccggccggccgtaatgactgtcgatcgatcggtaaatttcaagatacgtacttttagtttgaacgcattagtatgatatgcgtgtgcagatttttcttaaaagttactacgtggagtactttgttaaattttgtaaaagtatatatggtacaaaatgtagaaaaagttaaaacatactttaatgtatgaccccgttaactttttatccaacgtttgaccattcgtcttattcaaaaaatttatacaattgttatttattttattgtgactagattcaccatcaaatattctttaagcatgatatagatattttcatatttgcacgaaaattttaaataaaacgaatggtcaaacattagtcgaaaagtcaacggtgttatacattaaaatacggagagagtattataatagtacaatatatttttttaagactggcaagaccatcacactctaggtggagtcctgaacacaatcgataacgtaaaggacacatataacatattctctctgtcttataaaaaatgtttttgcaaacacccattttataaaaaaaattaaactagtactcgttagaatgtgtctctatattcgtttttttaagcaggagggagtaatatggatgcgtgtagtggtattgtatttaatttaatttaatccgtttcgtgcatgcagggctgaggacgacttaccgtacgagacaattgtgacgaggaagataaaggccaaccacaggaagtccgttgtgaagctgctgatcccagttatgaacaagctgggaaagcccgggacggtgggtggcacggggtacatcgtgtacaacgccgggcgcaagttcctgatactgacctgctcgcacgggctggacacgtggatctgcccggagcctatcagggtcttgttcgacaacctggtcagttaagaccattcacaatgcgccaccaaaatatggtgttcctcatttaccaccgagaaagaaaaaacatctacgaactataagatagctacatattactccctcaattctaaaatataaggcataatcacctctaacctaaagaccaagaaataattattatcatcttgtagtttggatcatcctaataaatacaatgcatgcatctaatagaattagagaacatgagaatgtaggattttaaaaagtaataatttaatggagaatggatcatggttaattgcctacatgcatacatgccttatattatggaacatctaaaaaaatggttgtgccttatattatggaatagagggagtactccacaatgcatactggtggtactactccagtgggtcacaccattgtttctcatctctacatactagtactactctctacttctttccccctcaatgacgacgtgtcccaccattctttcccatctatgcatactagtactactcatctcttcttctttcctcctcattgacgacgcgtcactccattgtggaccccacctgcaaaattgatgaggaacggggagctcaagttggctccgagcgcttgagcaggccacacggtttgtctacgtggctaggaatacttgttcttttgctacgaggctgaacgccacgtccttgcactgggaataccctaatactacctccatccgacgagataccgtagttttacatcgtttatattcagcatttaaccgtttattttattttttaaattttcataattagtatttttttattgatattatatgatagaacatgaaaagtattttatgtgtgactatttttttaaaaaaaattcttaaaattttcaaataagacggacggttaaacgttatacacagaaacctataattaattagatataataattagtatggtactctatgtaattaataacttgggggtaattttttgtacgttgtgggttaaattttgccactaattaaatgaaaataatcaggtggtggcgcaggcgctggtgaaggtgtgtgagcggaagaaggaggtggccatcctgtccgtggatgtgtccctgaagcaccgggagctcaccgacgcgggcgagtaccctcccgtggcgttcgaccaccagccagtcaggaaaggggacccacttgtgctcctaggctacccttggccttccagcaagactggctccactaacctgggaagtttcttcggctctgtcacgtaagtgtgtttatagctagcttcttcgtttgtgtttttgtgtttttttttgttaaatttagttatgcatgcaagcagggtacgttggcaaacaattaatcgctttcgctaatataacatttatatatgtggcacaaattgagggtataaatcatactactaattaattaattaaactgctttccatcgagcatgaggagtatataaataatgttgcttaattaattacatgctgcttcacttcacatatattgtaatagtactaattgctggttaaagtcttttgtcccaacgaaataaaatagtacatcctatatttttaaaatgtagcctatatataataatatatagcttaattattggtcaaaatagttatctctagcgttagctgttcattctagtagtactaattaacataaaatgcatgtagtatttgtgcttaatcaattatctctagctagcttttcattcattctagtactaattattttgattttgatgttgtggtcacttactactccatactatatatttatgtacatgtatgtatgtatgtatgtatgtagcaacgaggcagctcttgtcggaaaactgaaagacacccctcccgaagaacacatgatgactgtcaacgctgattactccggtgcaggcgggtcatcaggcgcacctgtttttagaggcgaaaatggcaaggttgtgggcactaatgttcacggtggcaaagaggtcttgtgctttgtcacggtgagctggattcaggatacactgaggaatttacaggaggtcaaaaagtccggagtaagtacccggccctctaatacagtcgccgtgtattagttaattacataattaaacaagctagttttatttatatacgtatgtcccataataattatcacaatagagtattaatgatcctcattaattacttctcatccaaatttcttctctattttagtctcaactacccttttatctttatctataaaccatttaataaatagtatcacagtcttttttttcaaaccttagtatatactccctccatcccataatataaaatgtacacgtatttcaatattcaacctttaaaacatttaacaaacatttaatataatatgaaatgaattttatttgttaaaaattatatcattagattgacatttaaatttactttcatataattataattttgttgctgtaaaccttataacatatgagaaattataagttaaagattagttttagaaaccgtgtaacttttaccatgccttatattatgtgatggtgagaggactaaataacttagaattataatcaatttgggacggagttactatttttttactctccatatgcatatgcaagcaatgtatctcgcttaacaattaattactctcctaattatataattaactacactgtactgtactctgatccatctctgcttggatgctatagcttggaccgaatgcaaccattgaggagattctggaatcatgcttcgctttgcttaaaagcgacgaagctggcccatcatcaaggatcaccaggtactcgatcgatctctccccggccggttgtaaacacattatcgttgtttttttcccctgtaagttataaaatggttgattaattgtcattaaattttaaaatattagttagtcaaaaaaacataaaaaaattagtatggtacgtacaatatttatgcatgcatatagaaaaaaaaaacacgtacttacatatcctcaaggatatatatttttttattaatgaaatagtgcaccttttagatcatagccacatacacgcattaaatcatgctgaaatctctacacagttatatatgtgttatatggttattaattaaggggcaaggctagagggctatgtataattaagctactatacatacgtacatttaattccatagttctttttcgttgtacacaaggactggactaattcgattttttcctttttttttcttttagtccgtcgtcctagtgtatctaatgcatgcgacttcaggcaaagtgcaacctttaatatttatgcatgacgagacgtgcggttctctatacctctccggtgataagcagtgaagggaattgggttaaatggattatgcacttatgccatatgtggcctgatgatatttatatttatatatatgtaccaggagattttatttagaatgtatcagagattcagagtacgtagttcccgaacatatatatgagggagctcaattaatcagcgcagctcaagcctgcctctatctatttaattagacgattgagaactgagaatatatatgtttgttatgccctcaatttatttaagaatgcaggagactgtagcaagtaccaaagatacaatttttcaatatcgtgcaaatctaaagtccctcataaccaaaaagaaaaaaaaagatggattggtgtttcatgaaaagaaaatggtcttaatattcattttgcattttggaaaaaacatgctcgactagttgaatatattggacccttcactgtatatactctttcaccaatcttgaatcattgatttattattactccctccgtttcgaaatgtttgacacccgttgactttttaccacatgtttaaccg

SEQ ID NO: 73740 - DNA, 13563 bp, Oryza sativa
atttttgggaatgtggtaggaaaataggtggaggcaaaaggataggatttgaaccctaaaatatatggcataagtttcaaggaattgtttgaggctaaaaggaaatttaggtgacaagggtataatttattttcttagcacaagaggaattattcacaatatttgtaataatattattcttgtgccgagaaggaaatcaagccacaggaattaaattagtggctagatcaaaaggaggaatttagatatttggcggcaaataagaataggtttggaatcaacggataggtttaagatcaaaggatgggtcgacaattaaatccaaatggaatcgtttggtttaagttctaggacaatagtggagaatttcttggaccataattcataaaaatagaaaggggttttcaaactaaatttgaataaaagaattttaatcaaaagaaggttttaaaccaaatcaagaaatacctcaatttaaccaaatatatatttttaaatgaaaaacacaaaagagattaaatactagagaggttttgagcgagttagttttaggaggtacctctaattacattgtcctaagtttaggaggttattaaaaacataagaatcggcatgatgcaggattagaaaatgacacattttcaggatgttacaagtcacgaggcaagtagatgatttgttacagaaaggatacatcagaccaagttcgtctccatggggagctccagttatctttgtggaaaagaaagaccatacccagaggatgtgtgtggactatcgtgcccttaatgatgtgactatcaagaataagtacccgctaccaagaattgatgatttgtttgatcaactcaaaggtgccaccgttttctccaagatagatcttcgatcagggtatcaccagttgaggattaaagaagaagatatacccaagacagtttttaccactcggtatgggttgtttgaatgtacagttatgtcttttggacttaccaatgcccccgctttcttcatgaacttgatgaataaggtgtttatggaatacttggataagttcgtagttgtctttattgatgacattctcatttattcttgaaccaaagaagagcatgaagaacatcttcgtcttgcatcagagaagctgcgagaacatcagttgtatgccaagtttagcaaatgtgaattctggttgtctgaagtgaagttccttggtcacgtcatctcagccggaggagttgccgtcgatcctagtaatgtggaatccgtaaccaactggaaacaaccgaagacagtttcagagattcgcagtttcctaggtctcgtaggttattaccggaggttcatagagaatttctccaagattgccaagcccatgacacgattgctttagaaagatgtgaagtataagtggtcagaagaatgtgagcagagttttcaagagttgaaaagtcgcttaatatcagctcccattttgattttgcctgatccaaagaagggtttccaagtgtactgcgacgcatccaagcttgggttaggttgtgttctgatgaaagatgggaaggtggtcgcctatgcatctcgtcagttacgtccgcatgagaagaactaccctactcatgatctcgagttagccgcagtggttcatgcattgaagatttggcgtcactatcttttcggtactcgtacggaggtgtatacggatcacaaaagtttgaagtatatctttacccagccagatttgaacatgagacagcggagatggttggaattgattaaggattatgacctggtgtcacgaccggaaataacccaacgggcgttccttacgtgcgtgtattattccttgtcccaggaggcaaggtacaccaaaagttgatacaatttagagtttaatcaagcggaagcgtaaatagttaattattacatgggcaacgaaggcctagcacacagaaagacaatgaaaaacagcggaagactagggcgacgaccacaggcgcttgacggcaggcacgacctaaacaccaaagccttcatcatccaggggctcctcttctaggtttgggaaaaattgagcaagactgagtacaaccaccgtactcaacaagacacacccacaagtgcagcataaatgcaatggagttataatatagggggttagggtttgcagtaaacagcatttaaaagacacttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaagccaacccaggccaaccattccacattttagttgttaagaaggttttaagaattaaaacactaacttgggtacattgctaggcttgcccatatccgagggcgcggctattcgaataggttttactctgatcagaggtgtacatctttacccacaagacacgtcttcctcacgtgcaaccacgtgccacataccaccacggcatatggatggatgacatgacataatttccaacccatcctagccatagacaagagtaccgacccaaccccacctacggccggaacctccgggacaggttggcaggactgagcccctagcagcaggacaccagtcctgtgccatgacatctcgactaccgggccgcagctcgtgtagccttcatttgccctacagatgtccatcgacccccgacttcgtccatctccatccgtgtacttttgtttataaccagactgagccacaaactaagccttacccactagacatgtggaagtacggtagtgctttgcaacagaggaccgaagaccggtccttatgtggccgaggtgctactatcaaaaccatgcaccccgagcccagtctaaaaccattttgggggttttgaatagaggggaaggtgtgcatccaattccgcaataatccaaccattccataatgtccaagtgatatgaatattcccaaagtctagagttataaaaccacctaatgttgcctaaataattagcgaagcatctacctaaattcatactagtggcaccatgaatagagtacccactagctggggttttgtttattctagggtgaacaaggtaataataacaatagcaataataataaggtcataacaaaggtaaacaggcatagctaaataaaacagtgataacgcggaaatttaagtaaagcgataatgcattaatttaaatcaaaataatgtcacaaactaggatccaatatgttcaaagatgatgtgacttgccttgctcgctttcccaaacgtcggcttcaaccttcacgaagagcggatcttccgatgctgcagcgtctacacgaccaacagaaaggaaaaagtcttttactctaataaactccatataacaagcaggaaaaaaaacacaaaaatgggttcttgacttcttaaggaaaaattagagacttgaacggtccaattccgagttcaaatggccaagttatggccatttgaagtttatatgctctttaaatgagtatttaagaatttcttcatttaaattttaatttaaaaagggtttattacgtcagccgaggggagagggcgcgcggaccgggtccacgggagtggggcccacgcggcagcctcacagtccacggtggaccgggtgcacccgggctcacaccggctggcgctgcgggccccatgcgtcagctgcacccgagggcacgggcgacggacggccgggccccacgcggcagccacacgccgcgcccgaaggcggccacgtcggcgcggccggcggaaggcaacgcgcccgcgcccctatggtcgccgccggcgaccaccggcgcggcggagcggcgcccgagagaggggtgggaagggggaagcgaaacggcggtccacggctcaccccgggtcgacggcgacaacgggaacggcgaccggagcggagagaggcggcggcgcggctcgggtcgacggggacggcggcgttccggcggtcggcgaccgaaacggagaggtggacgaggtcggcgaggatgcggcgaagccgaaggaggcggcgccgaggtgggaggcggtccggggtgacgacggcggcggaccggagctcggcggcgacggcggagagagagagcgacgtcgcgagctcaaatccggcgaggaggaagggcggcgagaggcggaaccggacggaggaggtgcggggagggtttaaatagagccggggagagagggggtggccggggaagggaggaaaccggcgcgggaggtcggccgccatcaatggcgccggcgagatttgcgggggcaaatccgcccgtttgaacgcgggagagagagggagaaatggggggaaagagagagggaatcacggggaatatttccccccactttattgcgcgcgtggacggcgggaggcggcgggattcgcggcggcggcggcgctagggcacgggcgagcggcgggagcggcgggaggacagggatgacaggtgggccccacccgtcagcgagggtggcgggcgagcccacccgtcagcggcgcgcgcgcggggaggaggccggatgggccgcggggaagaggagagagagagaaaggtgtcacgcccagaaattcacgaaccagaatttctaagctgaatgtgcatttaacccctgtccaggaccagccagggtacacaaacgacaattgttgacatacagatccacgtcttacaaaaatataaaagattacaaatgcagcggaaaaagataaaagcgagctaagtctgaaggcttgactcctgcagcgggcgactccattccacaagcatccttgacggcagcgacgaaaccaacctctaagatacataatcaactgggaaggacttcaacgctggtgtgggggaaaaaagagcaaaattagtataccccttgtattagcaagtcacaccggaagagcaggtataatgccgaatatagcccacgaaggctaaaggttcttttgcataaagccggcatttcaagcagtagttgaaagcagtaaaacagttgtagtaattaatctatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacatatcggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaaatgccatgggtgcgactagcaagaccatgcacccacagcccaccatgacgtgtattttaattaaccaacaccattacggtggcactaaatcaaagctataccaataatcaagtctatgctttaatgtgatccccctttgtgcactagttgaactaagcatggctaagcatctcctaaaccaacatctagtcattttaatacccaagttatcaatggcgtaagggaaacaacatatagctgagtaataggaccaatcccacatgatattgtaaaacaatgcaatatttaatagaaatgcgggacacttgtatattaggtacaatatgatcaattgcaatgtatgacttgccttgctctcgcactgatgaggccacagcaacgtcttcgagaaaccgggaaccgacgaaacggccgaaatctacgcgacaaacaaagcacacaagcaaaacatgctataagactactgaaacagataacaaagccatttttaatggattctacacatttttatgaatttactgagacttgaatggacttaatcggagctcggatgaattagttatgatttttagaagattctctgtgtttttactattaaagaaaagccttaatcaatttattgcgcaatattgccccagggctgacgtcagcaaggggtggggcggcgccgacatgcgggccccactggacagcggtgctaagagagggagagggggcggctggcaggcgggcccactaggcagtgtcacaaggggggggaaggcggcctggctcggctcggcttaagccggccggccggttgtggcgagggcggcgcgcgcgcacggtcgccagcgacggcaaccggcggcgggaggcggcggcggacggcgcaaagacggcggcggcggccgaagcggcagcgcgagcggccctagcggcggcgctacgcggcgggcggcgcggcaaagggagagaggaaggggccccggtgctcaccaaggagtccggccgacgcggagggaggcgacggctaacggcgacgaggagcgaccggcgaaccttgctggacagcggacgggaagcggaaggacctagagagaaggttgggaggggttagagagagggaggtggtccatggcgcacgacatagccgatcgaaggcggcggcaatggtggaagctcaccggagtgcgaggagatgcgagctccggcgatggaattggacgggagaacagcggacgaggtggacctcgggatggcggacgcggcggcgccgatggcggggtgcggcggtgaccgtagcggctgctagaggcggccggagcagtggagatggcggcggcgggtgggtgcacggtgctaggacgatagggagctcgggagcggacggcgaaagagggaaaaaggtggagagaggcgcggtggtcggttatatagaggtggggaggccggacgtggccgggagcggcggttccgcggcgacgacgtggagaggtggaggaggagagagagggggagaggattcaaatcgaatcctgtccgtgcgggcgcgcgcgcggacgggagagggcagggcgtggggcggcgacgtggggacgtgtgggcgcggagtggggcgcggatgcggaggaagcggcggcgtgggcggcggtttcggcggcggatggtggcggctgccggaggttagggacaaccgacaggtgggccccacctgtcggcgcccgggaggagaggggaggtgggaggagggaggagccggcttgggccggctcagccgagggaaggccggcgctggagggaatgggccgggcccaagaaaaaggaaaaaggagggaaaagaaaagataaaaggaaaaaggattttcccagggatttaatattgcactatgcttattttaattggttaaaattatttccaaggctctgaaaattccactaaaaatcctgttagcatattttgacatgtagaatccaagaaaaattccacatgtcgattccgattattatttgcatttattaatttgaggaattagctctaggttaaaataaacaatttcttcggacgatttattttatgaatttagagcaagggaggggtacttcagggcgtgacaaaagggatgggccgagccggcccaagaggggaaaaggggggggggaaaaagactttttagggtttttctttttataaaatcattttaactttgtttatttcttaataattgttatttgtgctctgaaaattccactaaaatttgagggctctttttagaccaaggagattttaacaaaaattctccgggccacatttgaatttttcttgtacgtattttagtgtttgccaatttctttccgaattttaattaattctattattccttttagcgaatgatttttaattttgggatgaatttatcaggacgtgacaaatccaccccccttacaagaatctcgtccccgagattcgaggaggccagcaagaagataggttgggcggtcttctcttcttggttgacttcttccgtcgcgtcttctataacacacttgcctagcaaaacttctccactctggactgcttggctcgatctcctgttgtagatggaatcttctcttcacatgacttttccctggttgcacctctagctgacttcgactggctacggcattggaagatggggcttcagttccagaacttcttataactcatatctttggagtcaccctcatacaagttaccacttcatgtcatgcgtcaacactagcttgtcattactaagataccatgcttgtcatcatgagaataccatgcttgtcatttacttctaacttgccaccaactgcctcatattagctttcctgctctccgggtgctagctacttctgctattcgatgcaagggtcggtaactttgcctttgaattatgcttcccaagagaaccaacttatcccacttgacatactttgacgtcttcccaaatggctttattgctggatttgttattgtctaatcattatcctgccaaatttgaagcttcgttgttagatgtgattttaatctgacctctgtagactatcttcgaacatatcacttggttcataactgggaatagctcccacgaacaagcaactcggattcactttctttacattcagttttcttcccattattatcttcaggttgtcctcagttagcattcaacgtattcctttacacctttaaccttgatgtgttctttcccattggatcatctcccaagacatggcattgcctggtaaccggtgcttgcacttttcactccgtgtagcatctgataccgagttgaagatttcactctttgccttcatagaaacacttttacctaggtcatcttgcatacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagtgaaaccttgatgtggtttgtcaaaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatactgatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaacatagttcctctgaaatgagaccctaggtctcctttatcagcaagcaattatacacataatcacatatccgcatcttccaaaagaatcctcatagaacttgtctgtattacacatttctccctcattacatgaatactaagcactgcctaaaaggaaaggtgcttagcatcggtacattgtttctgctatgggttctgattaacacgaggcctcacgggtacggcgtttgctccagtgaccacaatacgattgggatgtctgcttcgtgtaaattggcggtaatgtggaggtcgactttgccttggttgcaggcagtccctcgagtaatgccctggttctttgcaattgtagcaaatcaacgtcttctttgctgagctatccgtctggggacggtcattctgacttggagttggaattggtggctggaaatccttgctaacattggcatcagtggtaccatagttgctatcaccatcggagtctttctcagagtcccaattgctagggttgtcattttgggtgccatcattgatactatcgtcgacatcttggtgaatgatgttgacattgcacgcttgattcgagtggtcactattggggcaagaagcatggttgttggtggtaacatcatcatcattagtattgctaatgttgttgtctgcattgtgtccatcttcttggggcggaaactcttgatgcgcaacagaagatccggtgatctgaagtggctcagtgcgctgtccttggttaccacatggaaatactggaatgttgaccatccttctcttgcagttcgtcatccgattatgctcactttcaagttgcatggctttgtccacaagtttctcaaaatcttcataatcctctaggagtagttgcactgcaagctcatcttttaacccctggagaaactgctcttgtttgtcttcatccgtttctacatcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcatagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtgggtacttgaacgttggttgcccctgctgggttgttccaattctgtaatagttgaaaggctgttgccaacatgttggtttggttaaccacaatttggattagctctggtgaggtttcgttgatgcttttctcattcccactggcttgggttcttgagtcatcggatccatcattcccatagcctttgttaccagtgttatccatctgtcacaaggtagaggttgagaggggaagcatacaaggaaagaatcgaccagaactagggacaagaccttaaaggaactaactctttttgttgatgtgttgtttgttttgcttattctgcaggttgattaagcaaacaacctagcatggttacatcacaacccaccgatgcaaaccacgcgctacacacacaagcaaggaacacacgactaacaacactaccctatagggtggcttaggttctgcgacgggttcccaagatcttcactccttcacagctggcttcactgcttccttcacttcactagcggatcctgcagccttctggagcttcggcagacaattgacgacatcttcttcttcacaaagctgaccaactagtactagttgaaatttgaagaaggaagaaaagggtaaaccttgtgcaaatagcattagggaaaggagaaaaagaggaactttcgcaaatagttttagttataaaatatgtccttaggttttatccacttggcttatcctacagtcgagatggctctgataccagcttgtcgcgaccgagaaaattaccttttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggggaaagatagagcaagaatgagtacaaccacagtactcagcaagccacaccggcggatgcatgattaatgcaaggggtacaaggggtgataatatagggattaagttttgcagaaaacagcatttaaaagtcacttagttgcccaaagccattttaaaaagacgatcctagagctacacagtattattaatcaaggccgtgacccctcacgaacctgccttaacccaaggcctacgatgattcagaccgaactggcaacccgaccctgggtcccagctcgtcccaagccaacccaggccaaccattccacattttagttgttaagccaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggaatgagcccccagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgcatgtccaattccaccataagccaaccattccatagtgtccaaatgatatgagaattcccaaagtctaaagttataaaaccacctaatgttgcctaattaatcagcgaagcatctacctaaattcatactagtggaaccaggaatagagtacccactagttggggttttgtttatcctagggtgaacaaggcaataataacaatagcaataataatgtcttaacaacgataaaaaggcatggctaaataaaacagtgataacgcgggaatttaaataaagcggtaatgcattaatttaaatcaaaataattttataaactgggattcaatatgctcaaggatgacgtgacttgccttgctcgctttcccaaacgccggcttcaacttccacgaagagcggatctttcgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaa

SEQ ID NO: 73741 - DNA, 3438 bp, Oryza sativa
tctttttataaaatcattttaactttgtttatttcttaataattattatttgtgctctgaaaattccactaaaatttgagggctctttttagaccaaggagattttaacaaaaattatccaggccacatttgaatttttcttgtacgtattttagtgtttgccaatttctttccgaattttaattaattctattattccttttagcgaatgatttttaattttgggatgaatttatcaggacgtgacacatctacctctgacaaatccgtgggatacacaacaaacaaatctaatctctaacctaaacaccacgtctaagttattaattactactctaattcttgcgcaggaacttccttctctatccggagtcctagtactagagcacttagtatgaatactaaataatgaacccgcaaagatggaaatctatcttactcagactaaataattaaataacaaaagaaatgaacacaaatgcttactttatagaagaagttctccgaacctggagcagagtgtaccgacagctctggtactcctccagaattcctcctaggaagctacactcgtcgaggtagaagtcggatgagcgccaaacttccgggcactcctccagagcttcccctcactctctaccttattctaatatacaaaagatacaatagagcctcttgtaattcagctcaaagttgtgtgttggaaatgagagtgagctcctcctttcataggcaggtatgacggttacagcctatgcgaaatgaccaaactaccctggaaccggcattaggatgtgatccaggccgtccacgcaaaatttggcgatcaacggccaccaaaagggttcggctgaactggaggttcagtcgaacccgggacggctccgttcggcccgtttttcatcgtggacacttattttgaggccctcagcccattggcatgatagttgggcccatttggagttgtttaattgacttatggggcctccaatccatgtaaatgtgtcttgaatgcacggaggtgcagtttgtcgcttgacggatgtgttttcttctcaaaatacctgcatacacatatttcaccaacactagtagaaatgattagtaataatacctaccactaagttggataccatgttttatttcattatatgcaggtattgacggtcagatattatgatttaaggaccgtcaatagcacccccacacttaacctttgctcgtcccgcgtgaaagctttggactctacaacagagttatgactttcttactacaaattattcaaagccatacctgtacttgtgggtctttgtagagtctaccatgcgatcctgagcaactgagaaatggaacaatcttgactcatgtcaccctaacttttcatgaagaacaacttgggtttttttttttcaagtaaaacaaaactattactttgctttgctcctcaattgattctctcgatcactcaaagtgtatgattcctcacaaaggcatatgattgtgccttttcttttcctaccacctaataagccttatgtggagctcagggtatggaaaagagtagagcattacttgcatcacatatattgcaaagtcaaataatggatccacggaaatacaagacatactttctggtcaagaatgtgcatgtgtatgtgtatggtgaatttgtgggtggataaaggaaaaataaagataactccttttgtatacctcctcctccatttattttctcttttgaaatttgggagagtgcatggctatttttttctctttggtttttttcttttttttttcatcatcatgctccatacttgtataagcattttttctctctttttgcatagccatgcctctctctcattttttttgaaagaactttagagggagaggcataaatgatatggagtatttattttgtgcaaaatgaatggaatgaatggtaaatgaggaatgctaacttccagtgtagaagtcaagcataagtgggtgtatgtgtaatgtgtgtgaacttgaccatgaaagtatgaaaagcatttcactagtgtgacaaaacttgacaacgctcaatgtaatgacaagcaacgtatgtagcaagctaatcatgaatgatcaacctatggctttagtgggaataaaaatatcaatgagaagtttagcatcgttatatatttttcttttttttttagataaaattcccaagtgagcaacatgaagagcaagatttctatcatcagaccatatctcatttatcaattaccaagatagcatggggtccctattgaatatatcaccacaagcaacaagtaataagcaaagaataataggcgtgcatgttattttaagggagatcatgaactctaattgtaccatccctagcttgagtttaattatcttcgatattttagaattgataatcaaatcaaactcaagatagaatggatgttcaaaggaaaaattgggcaaacctgcactctgtataaaacaaaggacgattcatggtaaaggaggttcagctgaactgagggtttggctgactcctcattggttctgaccacaacaattttccttgtgtggttcgtcatggctcatcacttctggggtgatcttgctttcgttatggcgttgatgtgcaagatcacccccacacttgtatttgtatctgggaggctttattggacacaaaaaagaaaaagaaagacaagagtgaagcaaaaagggctcacttggttggaagaccaagaagccaactttattttattttattcatgaaagctagacctaagataactggagggggggcctaaggactcgttgcattgaaataacataagaccacctgccatctacctctgacaaatccgtcggatacacaacaaacaaatgtattctctaacctagacaccacatctaagttactaattactactctaatacttgcgcaggaacttccttctctatccggagtcccataactagagtacttagtatgaatagtaaacaatgaacccacaaagatggaaatctatcttactcagactaaataattaaataacataagaaaggaacacaaatacttactttatagaagaagttctcccaacccggagcagagtgtaccgacagctccgatactcctccagaattcctcctaggaagctacactcgtcgaggtagaagtcggatgagcgccaaacttccgggcactcctccagagcttcccctcactctctaccttattctaatgtacaaaggttacaatagagcctcttgtaattcagctcaaagttgtgtgttggaaatgagagtgagctccttttataggcaggtatgatggttacagcctatgtgaaatgaccaaactaccccggaaccgccattaggatgtgaccagggccgtccacgcaaaatttggaggttcggccgaacccgggacgg

SEQ ID NO: 73742 - DNA, 4072 bp, Oryza sativa
cgtggacattaattttgaggccctcagcccattggcaagatagttgggcccatttggagttttttagttgacttatggggcctccaatccatgtaaatgtgtcctaaatgcgcggaggtgcagtttgtcgctttacggatgtgttttcttctcaaaatacctgcatacacatatttcaccaacactagtagaaatgattagtaataatacctatcactaagtgggataccatgttttatttcactatttgtaggtattgacggtcagatattttgatttaaggaccgtcaacagttcccgatcttccgaaaggttataataaacaacgatttgggcggagtcgcgacactcttaacgaccaaatttggtaatccaagtatcagagatgaagataggattgaagcagaattcaagatggaaattgttctggaaacagagtgaggatcggctaaactccgaatcggctatgactatgatcagcagagttcgagtcggactaggttggccgattcagccgatactgtcaatgtgacgtggtacatgttgtcgggttgagttaatatgcttcatgaggattgccgtgcatggattgagtcctgagaaggcaattgtatctattaattaggatatttcatgtaatttccttagagatatgtttgggctaaagtctgccacaaaggcttatggtatcttagagtttgttagagataagagtcgtgtccgacacggacatattttgtaatctcgggtataaatagatcccgagccccatataatatgataacacatgttcaatacaatctcggcgcatcgccaccctttactttcgttttgtttcgacgagttcttgctttcgggttgagctgcatcggtttcaatcttcaactagaggtaaaacttgttatggcggcttgcgttctcgggattagtgcttccatctttatgtaattcgtcgtgttatcatatattctatataatctctggcaatattgttatctaacttccaatcggcctatatctgctactagaaggcagccgatcgggttaaataccaatgttgacttagattatataggatatccaccactctatgaaataaccagtggcttgattgtctagatattgtccttcttttcatacttatagctgtatcagttgagtttcaccttataagtcgtgattagaatctcaatctatagcctgcttttggttgccgattagggtagcatcggggtttcaacctgatttaactacttttatcctatatgcttgactgacatgttaaatctgccctttatattaagatcttgctgcatttaagtatatttaggcttttgtttagtatattctacttgatttaatatcttaatatagagtagtatcagagtattagccgatacatgctagatctatctgatcggctatgctatgaacatatatagtctccttgttaatatatatttcaatctaagtgatttatactgtctcagtatggtgaccaatctatcccaataacttgttttaagtatatatcgacataaggattatatattgttaatatctacagccgatcgggtagacttagttcttttttattcattcatgatcgccgatcgatactcatatgacattggctcagagataaatgatacatcatcggcaactagccgatcggctatcctttatggatttaaccgcggtttctttgtctttatttcttgttgattgcaggatcaaatcaactggcacgctcacacacctaaaggcaagcttttggacctgcactggagttaagcagatctcccaggcctcgtgtttttacatcaacacgcttttggcacaccctgtaggacgaacaaacatgtcagcagaaaagcaatctccgtcgtcaacgggcaaatcggtctgaggttaacgaagcagatatcattccagtcactgtagacaagctttctccagagcaaaagaaagagtttgaactgatgatgaaacagacacaacaacagttcatgaattcattcatagagactcggcatgggagagttgttcaaaagtacaagttgaagctagttgccgatgtccctggaacaggttcttctaaagatggtgaggtgcaaaaaactcaagttagtatagatgattcgggtgataaaggcaccacaggcggctcaagcggcaaaggtgacggttttcaggaaggaatggttgaggatcttggtccagatggtagtggattacaaccatactttaacaatttccaagatcagattgactacgctgtgcaacatgctttgatcaatcaatcaggagtcttagtcaacactttaaccaacatggtgaaaacaatggttgatggcacaatagctgagcatcaagctacatgaccagtgtatttgccaggtggagtttttcgaaattataggcctttggttacaggaaatcaacagggttcttctaacacaccatcaactcagccgatggcaccggttacaacttctgctccggctgcacaagctacaccatcatcggcacaaaggcaaatgaccaatcctcgattgttgacaagaggacagccacaacaaggtggacaaaacatcaatcggctgactcaggagtaggtggctgctatgttcctgccaaacccaccagctaccgatccagcactgcaaagccaacatacgccaccaagacaacacattacttagccgattcaacagcaaagtttgctaaatgcatcggctaggttggggacacctgataatcagctaaggcagcatgttgcaactcgagtcgtccatgagcacttggttcataatgtacaaccagatcaatcagtgatacctcaagttatacctgaacatttggtgcgtaacatccagccgaatactcagaattacaatgggggtcacttgaattatcattatcagcctccttcacctcatgtccaccaaggggggtcacctcaacttcagtttgctcctcagttcaaccagttcgagctgatacaacagaatacgcaaggggtgccttagcagagacagtgggccgacatgatcgcagatgtgatgagggatcaatttgggcttaagccgaaggatactgggaacttatatcggcatccataccctgagtggtttgagagagttccattgcctgtccgatacaaggttccagacttctcaaaatttttagggcaagacaatgtttcgacatatgatcatgtcagctgattcttagctcagtgtggtgaagcatcggctattgacaccctgagagttaggctgcttctctaccatacaattctatcaatggttgggccgatttggagaaacaatttcatagctatttttacagtggaattcatgacatgaaactactttctgacctgacagcaattcggcaaagacatgatgaatctattcaggactacattctaaggtttagagagacaaggaataggtgttacagcttggctctaacagattcccagctagccgatttggctttccaaggtttgatagctccgattaaagaaaagttttcatcccaggagtttgaaagcttatctcacattgcacaagtgatgttgcatgagcaaaggtttgcagaggctaagaagaatttcaagaaaatcaatcatgtgtatccttacatgtatggatctgatgatgaggatgactccgaagtagcagaagtcgaatgggtcaggtgcaaaaaggttgtgccatgcccatgggtgaggagttctggaaaagaagaaagatttgattttgatatcaccaaggctgataagattttcgacttgttacttcgggataagcagattcaacttcctgctggtcatatcataccatcggctgaggaactaggcaaaagaaggtattgcaaatggcataattctggttctcactctactaatgattgcaaggttttcacacaatagatctaggtggccattgaaggggggaagattaaatttgatgactcaaagaagccgataaaggttgatggtaaccctttccctgtcaatatggtgcatacatccggaagggcagccgatggagggaaaaat

SEQ ID NO: 73743 - DNA, 33129 bp, Oryza sativa
  unsure (1)..(33129): unsure at all n locations
catttcgaaacggagggagtattaagcaatactagctacaaaggtatcaaatgcatgacatgccttggttcactttgattggctcggccggtatacgcgtatgtatcctaccatagaagtgcatgcaacacggtacgtatatgattggttcacttaatttgttggtttgctttgcatgcataaatgaatgagaatcatatgcacctaattaacatgcatctcttgatcaacctgtatatgtactgctagccaccaaatatgttcgtacaacgctgtatatgtatacaggtttttcacacagagatagcctacgtacaacactgggtgtgtttagttccaattttttttccaaacttccaactttccatcacatcaaacctttcatacacacacaactttttagtcacatcgtctccaatttcaaccaaattctaaactttgggccaatccaaacacagccactgtctatcacaaaacaactccagctttcagctagatcatctttccctcaaagtcttcctttatccctccagacgcgttccatccttgctgtccatccatggtcggcattgaagatctcacttgccacttagccgagcagcttgagactattgagatgcaggcattaaagcagagatatgttgttgcttctcattagacaaaaatagtagataaaggggggaaaaaacgctatgcaaagatagacaggagaaagggcacatgatgaactgcctgtagtcttccatgtgtgatgacatctgagttaaaaggtgtggcagactcctctaaaggctaacaatatagccacagatatgacaaatattctccaatttggatccgaatatttgtaacccaaaaacaaactagttcaaaccttttccgaatcagcccaaaccgcctaagcccatctccatcaaaacaaagcctgtccaaacatataaccaatccattaagcccatttcagtctaacccattagcatacctatggtgaacaatagaaaactgtggcacacacctcttttatatcgctcttgacgaagaactgccacccgcctttctcttcgctggtaaacttgacatttgcgaactggcaacacccctctcccttcttgacgaagaactgccacccgcctttctcttcactggtgaccttgacatttgcgaactgctaacaccccttccctttctcttcttcgatgcactcgttttttcagaatcgtacttctcaataagagctgacatctataaaatattatcatgaagttaaaaatctgtaaatttctgagccttttacgacctaaaacagcaaaagctattactcgggctttaggttttgtacaaaaggtagtacctcataatcttcattctgtaatagttttgccaattcaacctttaattgactattgttcagggcaaaattaattgataaacacagtgctgtccgagcaacattcattccaaaaacttttccgaatcgactacatataggtgctcccatcaacccatccccaatcggacaggtatgcacaaatgtgctaacctgttgttctcctctcagttccttttcaaattcgcatacactggcatgcattaaataactgttattaagaaggacatacttaaagaataaataattaagaataaaataccaacattccataaagtgttgtccagatctctaaactttcaaactgcaaatttaagccagcaaacttatttaatttatcatcaaatgtctaagagcttatgatgcatgtcaacaagcaagcagctggtgtggcatgtgggagaatgtgagaattgagattgacgtggatggaaatatatgcaaaatcaacttggtgttcactatcaatcccaattgctcataacataatcaccaaacaacctgctgatcattcatctcatcgatgaccaggaatcaatggcatgccaggagaagccaactcattgcaattgaaaatggctagcttgtcctaccatttcgtcgattatagaccgatggtgttgtgaacgggagacgacataatttggggattacagcatgagtaaagtggaacaagagtaaagagcatatcgattttaggaggttccatgcatatattctaatccatggcaagttcacgtgctcccacataccaagttcactccatgttagcatgccacatctattccctaaggagtatgttcacctttgaacctatgatggtacattaaccaagtttgaaggcctaaatttgcaatttgaaagttcagtggcctgcattttcctctcaattatcttccgtcaaatcttataagcactttaaacataaactaaaacaaaatataatacaaggggaatgaaatgcaacaaaagtaacagtacaaaacaaaaatatccatgaattgtcatcaagaatagatggatacctgattattcccgcagtcattatctgctctttcacaatgctaaaacatccaatacaaaaaacaacatctgcctctggtaagtcgccttcatgaaacgatgtaggaatgcaaggtatggcctgaacattacatcctcgcacaaccaacgcagaaagtaatgaacttgttctgacaacttctgtctccaaatcttcttgatcaccaaatctcgcaacgactctgaaaccatctttcggatcacaactgatagatgtgattaccccaatataattgggtgtcacacataataccaatccagtaccaagatggcatggtatttgggtactttttgcattgaaaactgccagttgcacaattgaaggagctacactttgatgcagttgccttaaaaaagcatcatcataacttctcacctacagattttcaagttaacttgtattttgattttttttgtttattcaattttttataaagcaatctatattataaagtgctatgtaatgccacacactaaaaaaagcacaaactataccatacaacataaacatttcataaaatactactaagtctagaacagcaacacaatttatagaacattttccaaagcaataagccccacaaaacatttttggagtctacataaatgataacttaccgctgacattatttgcaaagcaccaattacaaattagccaatgtaatgaagaagtgcacgttcataacttgcatgctgcattcatagctaatgagagtagccctgggagtataatgaagggaatatcatgtcatcttctaatagtaaaaagggaaaatcaatgtagaataaatgcatcagattgatgcatatccataaaaaaaatgctttatgaaactcaactatcaatatgtaaaagaaacttttattgtgtaaaaggaactatcttttgtacatattgggtccagctaagtgaatcaagcaagcacctttactgttaaaagcccaaaaggtaagaacaatagaaatggtgtggatgcaacaaagaagaaagaaatcacagttgtgtaaggaccattgttctcaatatgttgattatgtttctagtaccaaataaatgccagatcataagccataccaaaattttgacagtttgacccttttaaaaaacttattccacaaataaaccatggcaaaaagccaaaaactataacaaaaaatggatattgtggtccatttttggttgtggcgaaatagattaaaatggtaatagggccatatagtattgaacgtgtagtgtgatggtaaatatacgcaaacccaagatagagccccgggttcgaaccccactgctgcatcctttttattccttttttctctcagaaagttgtgtgggtgcgcacggagggggaaaaaagaagggggttgtgggagtgggaatcgaacacaagatctttggatctagaggggagtacatttaccattaggctacttgatgtttatgagaaagagtagattttaatgtttttaacaaagtacaaaactcaagggtgagaggtcagcaccatgggcctaagcgccagggcccatggcaccgggattccggtccaattttgcaataagtttttgacgtagtctattcttcaaataagtttttctaaaaaggtcaaattgtcaaaatttcggtaagccatagccattttaaaatgcaaggagtggaggtatgtttgtcattctccctatatgtttatagatggccataagacccgaggtccggcccaagcacgacacggcatgactggtgtcgggcccgtgccggtctggcccgacaattgggccgtgcctgagctgatgccttggcacggtaggccggcccagcactgcacggtcaaagaaaactagttgagggatccaaaatagacttaattcagccttataaagtactgtccaaagagaagagggatacaaaatagacttattccagccatataacacacagcccaaagagatgaggtaggaaaaatcaacttattctatggagaagcatgatgggttgtcgtgcctttgggctagcccggcacggcctgagtcttattgggtcgtgtctgggccgtgggtgcagcccgtgggcaagcacggcccggcatgtaggtcgggccatgccggctcgactgactttggcctaggcccgatcatgcctgggacgtgccaggccgagcggcccattcgggcatctatatatatatatatatatatatatatatttgttcactgccaagagaagaaagccttactaaaatattgcctttgattttttttttaaaaaaatcagcatgccatgtacatatgtcttagaagaatcaacgcatgtgagagcatgtttatctgagtagaccattgttgattcccaatttcccatgattgcatcataatatgcagcaaggattgctaaagtgattattgctctaaaactgaattttatcctcaccattacccccaaaaggtggaaattgaagccatacattgtttttttagagcagagacactaattggctaatactccctcagttccacattataagacgttttgatccctccacctcgtgtctagattcactaacattcatatgaatctagacatatatatgaagcatatacatgaatctatttaaacccaagacgtcttataatgtgaaaagaggaagtatacacgaagcaaggcagaacgatttcactaaataggggggaaaaaagaagtacaggcaaacaattgatttgagcactaatgctaagtacatgcgcacctgaggagcaggagcagaacaaaggccgtaccttgcagcagtactgatcggagcacctcaggacaaagactgtgtcatggagcggtagagagaaagagaactgttacccggctatgtaacatcagttgggagtaaacctgagccacattagatgaaccaaagagtatcaaacaacaaacatacaccgacggaaaagcaaagattagccatcggcgaggtggagaatatgatcttgtggaaaacggacactgcctgtggagtctgtggactgtgaaagccggacacagcctatggaccgttcaccaaccctgcaagtgaagcatggatattggatagcataagacaaaaacgcacaaccccgatgagaaaatttgataaggcaaaattaggcacgtcgggaccaggaacaattagagcaataaagctaaaattaagcaatcaataaggcaacggcaacgcacggaggcaaaaaaaaaaaaaacactttttttgaatgaagccgagccagcaattggtggtgtttgtattaagctggaataaaaatcatgtatacatgtttccaccaccaaatggtgtgcacaggaaaagaaaaacagctaaggagatattatcgctatatatcctttgccccacacatgctccaaagcttaacttcgtcttttattttgggctaaagaactaactagaatttctaatcatcaagaaagtgcaaaggagcagttgaaggataagttcaccggtggcgcggcggcgtcttctccggcgatggccgatggcggcggcgcgggcgccccgccgaatgttaggtcttccggttgagggtaggggtgggaccgcgtggaggagacgtcgccttcagagggaagtcgcggggatcggagcggaagcccggcggtggcgccgcctcggccgcgggagaggaggagggcgttgggccggagtcggttgcgggggaggctagttggagtggctacgaggtgggttggggccggcgccggcggctccggctgagttcctgagctggcggcgaggtggtcgcgtgaggagttcgggagaagggagtgtagtgattataaatttataatcatttaaaataactgtgaatttcaaggtcacaggatgattatccgatggctagggacagaggtggtgtacttttgcacttaaccgcccgccaatccccagcgcccttgcctggttttttgcaaatccaccccccttaaggccctaatccgccagcgcacgccgcccacgtcatttcgttgggcctcatcgtttggcttttctcgtaataagccaaaatgtattattagaaaataaaaataaatttgtaggtaaaacttttatatatgtgttctcggtgacttaaaagccaatgctgaaaaagaaattacgttgaaaatatctcaaaattaatgtcaaaattaagtttgaaaattcaaattttggttttttctttggctgaataggccatccgatgggagccgttttctcgctgccgcccgcgcccgccgcccctttgccgccccgccccatggagtgctcctccaccctccgcaggaacgcctcgtccttcccggccaagaacagctctgggcacacaggccccgacgccaccacgttcgcggttgtgctgctgtccagggtttacgatttcgacgaaattaggtcggatttcgcgaaatttcgacattccgacgaggctcgaaagtagaaaccgtttgagatttcgaggagtttcatctaaattcaaatttaaattgataaaaaaagaaataatgaaataaaatcttataaatattatgatattcatagaacttattgggatataaatttccgaaaaaaatgatatattgtgtgtatttactaaaacttacatcatgaaaaaaaagaatttcagcaaattacctccattacaaattactgatcgaaatttcattaatttcgatcggaatttcgccaaaactgaccggttttcgagaacttatcggcaacttaaggaatttgtattcaaattttagtttatgaaatttgttcggaatttaccggttttccaccggatttcgcgaaatttcgaattccgccagtgcccgaaacggaagggcctatcggaatcgtaaaccctgctgctgtctgctgtttgttctctgcagttatcttcagtgcatgtgcataaaaaaatagcaggttatgtctagtggcaatatagatgttgcaggacccagcatcatcttcagacacttctcaaagctgagaagaggtccaatgatatggagtcattagttattcaactcactttgctgctgtaaggaggaaaaaagaggagattttgtactgcagaaaatctcaatcgttgagtgtattgccttgctcaactctttttcttgggcaatgtatgacgattcagtaatgagggcaatgtatgcagtgcaatatacttgttcctcacaacaaatacaagctatgattttaaatttacaacccagaatataaatgtgcctaacaacagatacatacatatgcacagggaaaggacgtcgcgcgcgggtggcggcgaatcgcggcgaagagcgggcgccggaggcgaattgtgggcggcagcgagaaaacgaaacgatgtgggcggcgtgcgctgccggattagggcattaagggggtggatttgcaaaaaaccaggcaagggcgctgggattggcaggcggttaagtgcaaaagtaccccatctctggccctagccatcggatgagcacatcatgtgatcttgattgagagtttccaaggttgcacagcttgcctggttttcacatgatacgctgccgaatctactaccccacttacttctattataaaatatttatatttcattaacactcatgattatttttataaattgatgtttgttgactcaaagtatacatctctcatctattttaacttttttcttcaattctgcgcggcacaaaaacttaacataatactaatcggtaataacatgataatcgattcaatatacatataaatggtcaaaccataatgattagcacttgttgaaaagcatctacatggataaataaataaattattatagataaataaattattatagataaaagtatattagttaaatggatgatataaacttgtattcgggttatatgaaacattttacccataaatataagaatttataaaacaaattgaaaagacaaattttgctccagaacatcgtgacttcgcagttgtgactgtaggataccgcacgaagtgacttctggaggaagacattcaataagcataagaatttaccaacggacaccgcacccattaaaataataattttcagttgaagagaagagaaaaatcgtgtgaaatatctaaaatacccttggacccatatgttagctctcccacctcacttctctctatcccctccgtcggcgtcgtgggggccattgctgccgacgtgaagcagcgcagattggcaagagagggaggcatcacgtgccaaccagccatggcggcacttaaaaacaataaaaacaaatcataatgattgaggaggtcactggcgtgaggagagtagcaccaccatggagagggtgttgccgctgaggggcaagcgtcacgtgttgtagtcttcggagaaaaatagcgaggggggagtgagccaagagtgggtgccgccgcagagaggtgagggagcgtcatcacacgtcaccgccaaggtgctgaatcatgagagtgagagcgaggggaaggtggggagaatgtgagagatgataaggatggggactggggaggaggataaggatgaagggatgaccgtgtgaggctcaactcagcttggtgatttagggtgtcggtttcacctattagagcatctctagcagcctctttaaatctgactcttcaaatatttatttggccagcttgccaaaacaaatgcatagttaaatttatcttcactccaacaccatctccattacactatccaatctaattgtagatcctacatatcagcatctctactatttcactccttcaacccccccccccccctctcctctctctcttctcccctcttctctgccgcaccatcagtggaatccacgcgtggacggcggtggtggaggccgcgcaggagcagggaggtggcgctagtcagcatcgccaccgccgtcctcgtcgtcacgggcataggaggtggagtccgtgcgcactttgtcgctgaaaacaactttatcaaattttggcaacaccaacttttgacaagttttagagttaccaaatttgacagcgtttaatgtgtttaatttgatgccattttaaaattttgtattgttttagtgagagagaagtttcagaactaccaaattttagtaggatagcattgatgccatcattgtttgttggtatattaccaaaatttgatggcaataaaatgaacaagccctacgtcacaactaatgctacttttcacttttcagaacgatgagaacagactctgagtatgccagctggatgcttagacctttggtgaaataaaccagacaacagcattcaataaataacgcagctgtacaacaatggtcagtggctcggtgcatacaatacgaacttccgacacacctctgcatctacccctccacccctccgtcaaaaaaaaaaaaaccaatcttagctacgaacatagacatatgcgtgttcaagttcgtagctagggtttgtctttttttgaggcggagtagtacatcacagcattgacaaagttaatgagattacagaggagcccttgcaggctaagaggacatagaggaaaggagtgaagaggccttttcatgtcaacacatgcctgaaatggatcaagaatccccttgaaagttctcatcttcacagctgaaaattaaaaccataagcaatctgtctgaggaggttttatcctacccattaatgccacagtgcatgtgtgttgtgttggattgggatacttctggtttaagaaattcggaggaaagccgaggcttcaaagacaaatggcagataggttngcatgttacccccccccccccccccctctctctccccaaaaaaaaaaaagggtcagccttcatcagttcaaatatttatcaccaaaatattgcttctttcactgcagtggccatctacaaatagcaaatctccatgaatcatcaataagataagaacatgatttagagtgtttcgaatgaaaacctgttattgaagcaattgttgtgttcaccagaagcaattcctatattcagctttgcaacaaacttagtgttatctctgggccttcgtatttcagcctatattccaaagagaaaagaaaggtttttaatacagtgacaaaaggatgattactaatatggttgccaactaacctggacagtcactttatcctgcgtgggcattgcagccgccattttatcaagaaatatcgaagtaagctgagagtaggaaatcaaacatgagtatgaactccaaatagttgggtcaagtaacagttatattaaagaccacaatgtttctcagactgaaggactttttctgcctgcagtgtcttccgttaaaaagaaaagagaaaaaaagatagtacaaaatatagcaattcaccaaccagaatggaggatagaaatgaggtgtggttgagagaagataggatcatagaacttgcagaaaaaaacaggtggggatacatggatggggattcctttttactatggaagagtaattctcagatgaaccagcaatagttggtgctaacatatttttttcacatgtttagcaatgcaattgaaaaccaaatagctcagcatcaggaaataaagttcttttttttgcctttcaactggaacttctcggactcaaagcactttgatattctcaataaaataactcatcaaagcttttcaaattcatataggatctgcatccaattcatttttcatgatcctatgataatccacccacagctctaactgcgcaaatggcaaacagaagtgctacagacaaacatcaataataatacctgagacagagagtagagaacaatgtcatcaacactacagatgatatcaccagcctcaatgctgctacaattttctggtaacacttctgatatctaaaaaaaatgtagttaagtcaatggaatgcaagaacagagaacatgctataagggcttgtttggtttgatgccaattttcgccttaccaaaattttggtaactttaatagtggtaaatgtacatttggtttggtaccaaattttgcctataatagttcagagtcaatactacaaaatttggtagtgccaaaaggcccaaaacttgccaaggttttggcactaccaatattttggtaggacaaaaattggcttcaaaccaaacaagccctaagttaatttcttgaagagggtactctggctggagcaccgaccataatgctgctcttgtgagggggagtccaggtccaatagaggaataggtgaagtgctaatcagatggcattggtctggcttcaccaagttagcctgagggtcgataattaaatgaggtatagtttccctcgcctgaatccaaaagaggatagcagatgcctacagagtggtattttcccatatggcacaggcacacagcttttcactggtatttagatgaaccatgaccttttttagttttgttttcttctaaactgatgatcttgatgtcatagaaaagttttattaaatctacagaagaatggaaaattgagataaagtttccagttgtacttattttgtttctcctaacatgatgtatcaatatgaaacttgatattttaaagaatgccgcaaataacttttttttttcacaaatggaaaaatggtccgtcgctccaagtttgcaaaacgacctttgcatatccatatcaaaagtttcctccatttgagaactccccctatatgttgatttctgtcaattctaacataataaaaccccaataaaaatcagtggagcaatagtgtttgactttggcatatgtctaccccgtataatttgtttgttcagcttagcatgctcgagtttgcagataaaaacaattacgtttctattaaaatagagagaacgagcggaatcgcacgagttgtaactgacatatcataagttgtgggggtgcttcctagttcctaatagagtggtatgtagaagggcctatgcaatttccccaaaaagatttcagaattactcataatcatgcctacactatagcttggaacaaatatatgctgatcattctagtatttttcatcattatttgagcgaacttattatgatatttatgcctattctaatccagttatgacaaaaaaagtaaactgatactgatgcatattttaacacataaaaatgtagggccacaagaagcaaacgatactttcacatcatcacatggcaaattaacactcaaataagtagatactcttccatgtatatgcaaaaacaaacctcgctctaacttgtagtaatcaaacacagccctttctgattattattggcagtggttcatcatgctctagatgatagtaagtaaccttcaaaagtagagagagaagaaaaggaggggattggctaccttctctaccacaattccagaaccagaagacagctcaggatacatgtagcatattttttccaaattgcatatttccaacttgtgaatagcttgtccccttatgcaaagagatggttgtttgagtgtcctacattcatagcgcatcacatctcttgcaaaagcattaaaacaagactccacaaatgcgtacagacatccataaatagcacaaaactttatcctacttctgttcctactactactagttattagcttcagcaatttatataataaaagcaggtaaaatttacttttaaaagatccaagagtgggtaaaatattatgcaaatatgtacttttttctaataacactggacagaatactagggaaatatttctgtggaaagacagaataaattacatagttaccaaggtcaaagagaataatagccagagaaaaccatgtcaaacaatgaaagaagagatggtactcaaggaagaaagtggtaaacacaaattcaacacgggcactgtggttatactatagcttgaaggatgctaaaacattagctaagttatcagaaaagaaaggcacccattgaacaaggatgtagttgcacccccttccgtaaatattttgtttgtttttttaaaaaaatctctagagatgtaataatatataatgttatgtgcacacaaaattttgaagaagcaacctttcaaaaccagaaaaataacaccctgaaccatatttcatgttagttttgatcgaacggagtggcttctcaccaacatgttcagtcaggtaagtttcattgttgtggacctattaagtatcatctacagtagcaaaatatgcataacaagagtacaaaccaggaaaaccaagtccacttaaaacaaaccactaagaaagtatgtctagggtgttatttgtccgattttgaaagttggggccttgggggtaaaaataactggttttgtagttgtgtgaaataatggacttcgagcaaagttcaagggccaaaaatgtacttcaccgaaaaaagaaaggaaagttgtctttctttgacttacttatcttccctttcacaatgcacatgtaatcatttttttgttcatttgcgtgtgtgaacatatttttaacatgccctacatgtatatggtttttccgaagtacgtgaatcgtataagtgcaaatttcaaatgggcatagccgcagagcggtttaacagattgagacaacaaaaattactcgcaggactaatgatagtggatcatagaacttaacaactagaaaaaacattgtctcaaactagatttaaaactaattcagaagaatccagattgctcaggtatgcaaaaaatgtacatgtgtgtggggatgacagtattacagactggcaaagtgcatatcatatcattaaaacccaaagagaaagcatacctgaaattcttgaagtgttccaagcatctcaccgcaatctcaataggcaagaatggaacagtatccttgtcgtaaaaagtgatgccgagaatcctcctttccaaatccatgacaaggcccccaatgaaaacctagaacaagataacaatatagtgaaatgaatgtcccttttaacgatgacaatgtccacacagcagcatatcgtaatgatctaactcagttgattaacctgcaatacagccacttacagagagctgttgaaaaaatatatacgtgcatgccaaaatgagtaatcattatctggaaattaatcggaactggacaaacaatcaatggatcataataataggcgcacaaacattcacaattaagtgcgagtaaataatttaaaggtatcaccatgacaaaaaaaaaacagtgcttattactaattcactgaattatcataataataggcacaaacattcacaattaagtgtgagaaaacaatttaaaggtatcaccatgacaaaaaaaaagctaacaatgcttattactaattctctgaattaataattagtagattagttggaccaacaatctaaaatacccccattaatgcatcagaagcaaatagatagtttcttaatattcagcgaaatatacatgacagtttcttaatattcagtgaaatacacatgacagcttaccatctataacaactaaccgaattaacagtatatttaaacagtccggtcttcactattgattttctagatattgataatctgtttaccttactaacaggacaagtgcagaccaaaagctcatcgcagtccaattcgctacgttcacgggtcatctccccacatctcactagtaaagtctttgacttaaagttacgagctacagctatcacaggccgacacagcatggaataacagacaggaacgtcatgaagtttcaccaaaggaagatcaaattgtggctcaatggtgacaacagctatattgtactgcagactgcacattgctaagaacccctcagtgattgttttgttgtgcagaagtacttcaatctgcagtcaataaactaaaacctagttacacatcaaattgaaagagaatgtatcaaaacaaacatgaaactgttgttatattgaccttaacatcaccctcttgataagcatcatagtcattgtcacatttcctaaccagagtagcagaggtgagtatccaagttgcagaacccacatgatcaaccattgtccctgagcaagtaaatagaacctttccatctgcggaaagcaactagtaggatcaatagctgctggtatgcgaattttgtaaaaaaaaaaaaaaagcatcaaggctacagacgatcagtaagattaccaacagaagagataagggacacgatggatttggatatgcttaaggccacctcttttgcactcaggccttcctctgtgaaatcctcttcatcactagagccatccttgtttattgcccccttcaaatcgctagcatcatatttgtcgacatccgcttcagaatcactaggatcatcaccgaacaataaactctccacatacaaagcagcatctgaggaattaaacaaacaagtaaaggattcatgctaaacataaacaaaaagatagtatattgttgaataataaagccttcacagctagaatcatctaaaaagggaagagattaggaatatgcatatagaagcaaaaaaaaaaaaaaaaaaggtttgcgataccttctgcacttctcttcttcttgttcggcataatatctgcaatctgcaatgaaataaaaccaggttgacagtgagtttcaagcaaaacagaattgactaggtaacttagccctaataaacacagatactacaatgactcccgactcaggactatctggaattcagagcagatgcggttgcgtgccaaatcaggccccaaggaaggatgtgtgtgagagagaaataccttcaccgccgaggagggaggtgaccgcgctgaggaagccccttgaggtagccaaccgcgggggaaggagacgccgaggggaggcggcggcagccggcagcagcgcccgggaccgcgtccagtctgcctcgcgacgaagggggagttacttgcttgggctaaacttgttgggggcttaatgggcctatgtgggccgactcggcctctggagcctgaggacggagaaagttcactttaggtccctcatttgtcaccgagttcgaaattcatcccttcaccgcaaaaaccagatacaacacatcccctaacttgcaaaaccatgcaaacaaaatcccttggcagtatttaacccagtttttggctgatgtggcgcctacgtggctcctttgactaggtcttcgtcccacgtggcgcttacgtagtaattcgatccgaaaaaataataaaacctgtgaggttcacatgtcagttttacacacgaaataataaaaaatggtggacccatgtgacctcacgtgtcattagggctgtcgacgagttgagctcgagcgagctcgtctgcctaggctcgagctcaatacaagctcgagccgagcctataaaatgttcaagcttttcaacaggcttggctcgagctcgactaccgagcttgatttttaagtaaaacaatatatatttcaaagataatctttaaaataataattaatttctaattcatcatactaatataagaggaaaaaataataaaataaatatatgatgtcaatataaggcatacaaataacatatttgatctcctaatttattaaataacaacaaaaattatatactgctaggctcgttggaagctcgagctcggctcgacaaggctcgcgagcttaggaagaggctcgggcttgacagccctacatgtcatactcactactctctcctctccatccccctctctctatatcctctctctcccctcttctctctatccccccctctctctctggccaagggagcggggtagacggcggctggatcaggcgacgggaagggcagagcggccctcgaccaccgctcccgggtcgacaacatcaccgccaccaccgcaatgacctggctaggggaatgggggtaggcggtggccgaatcgggcgaggggaggggcggagcggcccgctgccaccatgacctcactgtcgcttgcctcaccgtccttgtcgctgcaactgaagcatctaggctcccggtgttaattttggtaattaatgacaagcgctaattgtggactaactgttgtctttgagctatatattttaagttaggaccacgtcatatgtgcgcatcgatgattatcgatggattaaaattgacggcgcaaagcaaagggaaagaagacggtaaaactagcgatttaatttagaattgatcgaggtgtagggcgatcaaatttgctagtttatttttagtttcgccgtactattaagaggggtaatgacctagcaaagagatgattttaattgccacattaggtcattatgcatttagacttgagctctcatttctcacacacacacctttgcctttcactgggttcggcctgaccaggggcggtcagaccggccacatagtagcggtctgaccggcgtgccctggccagtctgaccggccccaagagggcggtctgaccggcgcataaggccgatctgaccggcggcgcatgcgcggtcagaccggccccctggaggccgggatggtgctgctcggggtggccgatacagagccgacgaagccgtattcggtcagactgagccgatggcggtctgaccgagccaaggccggtctgaccgcccgctcaacgccagtctgatcggccatgccgatggggccctctgacagcactacaacggctagttttctagccgttgcagagtagcacggtccgaccggccacatacctccggtcagaccgacagagcacagagttgggggatttcgcccccaacggctagttttcatgggtgggagtataaatactcccccaccagcagcacgggggttctcttggcacccaattcaattgcatacaccccttgcacctctctcacacccacttaagctttgtgttcatccatctagtgtgttagagggttgattagccaagagtcaagtgcattgcttccattatagagctagtgtggcacttgattgatcatctccacgccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctccgtgggccggctcccgccttgcccaccccttgacgaaggggacgtgtggtggcttcgtggttgagctgtggagttgggctcgcctcaacgggaagtaggaaaccggcgagtttccgaacctcggtgaaaaaatctcttgtctccttgtctcatttgattgttgcatttacatttgtgcaatttacatttctagagacatacttgagattatatcaccctaggattgctaaacattgacataggagtgtgatttactttcctagagatataattgaaccactatcaccctaggtttgcaaaacataacttagttgcttagttagagttgaccctcaccaagcctagcaacttaggttagttttgattaggtgtcatttagttttaaatcgcctattcacccccctctagtcgacatctcgatcctacagcaactcccctgtgcaggaggcactggggttgctgtcgcgtggagtcggcggggctgcaagtggcgctcgctcctctccactcaccggccaatggctatggctcgagaaacgcacttcctcctcttcctccccttactcctcatctcctccttgctcacgcccgccactatggtggccgcattcgtcagcttcaaatcatttcacgatgggggaactagagatagtggcggcgggcgagctcctgttacgctaggggtgaaaacgggtcgggttcggtttgatctcacccttcccatattctaacccatattttataatcggaatcgggtcggacacatatagtgccgaatatggatacaaactcggataatgtcgggcaaaaatacgaaacaaatatgtaccaaaatgcatacgtacactatcggttacgaatatttatttggatatcaagttgaagcaacaatcttatatatcatatagacaataaccatttaacaatttcatatatccataatacgatatattaggctattaggaccttatgaaaaaaatatggtacaatacaaaatagtagaatcaatacatagtaccagatagtggctcacagaaaataatacgagtaatatccgtataattatccgggtaatatccggattttttaccggataatccgtatctatcgcatactaagttcctgaacccgatctcgtatgctcaaataagacccgtattcggacccgatatgcgtgaaaagtcccgggtacctaaatttgtcccgaaataatgtggccgagctggcgggcggtaaatacccaccccgttttcacccctatgctatggtttccaagccatccaaattgccatgggacctatattgcaccggttttaatagttgagagacccgttgaatgtggtgtttcggttgaaagacgaaaatcagatttgttgacaagttaaaggacctcggatgaactttcccctgtggaccaaccgactgggcctcgcgctcgcgggatcgatcgatatcgataccaccatcctctcctaccgggaaacgccgcgagcagcgccgccgtcgcgtcgcgccgatctccacatcaccggcggcgacttgcgagcaccgtgccgggcgcctactgcttccggcgcgtactcgactccttgcgccaaagtcaatctcccctcgcaccgtcttctcggcctcagactcccttctccgactcgctagttcgccccgccccgccgcgcctcgccctcgcctcgccgcctgcgccggtttccatccatcccgcgacggacgggagcatccgtcgggtgccgtcgtcctgctgcctccgcctccggtgagcacccgtgccgaaacgcacacgcacctcctccctttcgaatttgcctgttaacttctgttctagatctggaaactaggttaggacaggttttcctctttgtcttgaaccttaattattagtatagcagttttcccccgccaaaataatctggggggtttcaactgtaacccccatgaccaacgttaggtccgcacctgttgcagaaccttgttttcttgctgacttcaatttgtgggttaggtttaatgcatgatgctgcagcatctatgcacacgatttcctatgccccactttgtagtgcaatcagttgagaaaaaaaaccatggcgtagaaaatgcgtgttgataatcacagttattttaatatatatttttacttcaaattgcagttggaatgcctgcctgcgtgcatatgatagtcatcggctcttatatatttttatgtcatctcaagtaagcggtacaattacagcattctcatgggaattctgtagacagttggtacttataatgtagtaatatgagcataatatatgcaatcagtagcaagtattttgttattttcaagttcattcagtcggcacataagaactgtgctttattaaaagaaaggaaagctatgccatcatgtactatgggtataggagaatatgagagatgggattgagaggagttgctgcattactcctcaatttacagaaaagagattggctgtggattttaaactccaaacatacaacgatataccatagcttctattgcatctgatcattggatagtataagatgttatgatatcttcataagctatagtatatgatctaataaactcaaaaatgcaccaaattattaaacaggtcattactcattaccatgttaagtactatcaggtactactccctccgttccacattaaaagaggttttggcctctccatcccttgtctagattcaccaatatccacatgaatttggacacatatatgaagcacatacattgaatcatgcatgaatctattcaaaacccaaaatgttttttaaggtgaaacagaggaagtacactgtttagatggccttttataaattataacaacatctcgaattgttttggctcttatccatgaaaggttcggaagatgatgagaaacaaccaaaacacacaagtagaaggagcaagcgcaactaagaagcggaagacctcatactctaactccaacagagaaggtgaacaaagtgcaatcacttcgggctcttattcttttctacactaattccaattagtgttaatactctttgttgttcattatttgcagattcgtcaccagttgtggatggttagttttattttggcacatttcatctatcttcttgtatatggctttttattattaattgtgtcaccttttcaccctgttgcaccaggcctcacacgcatattgcgcagaaatcttctcccccgtggttatcctatgccatctgagttcactggcaagtacttgtgttttgatccttcacttcctttctttattttgatatatgtttcttggaattagttacataacacatgttatcccgtgtttctttgactagatggtatgcacatggtgaataactttgaagaatcttttggagacttggatgactgcaatgaagaatacagcaaagttaatttagttgctctaagaatatctcagtccgttgtctcacttgcttcgtttaagggtaataattcactgtctcagcatagacaccaatcaagacaaacagggtaacctacacagagggtaggggataaggagttcccatctgtgtagttccatcacaaattggtaatttaaatgttagtcctgtacagggcgaacgagactgtttgcatgcacgggtacaattatggagtatggaccatctaaaatgagcattctgacttccgctagtttggttagatgcactaaagatgaaaacaagacagatgaaaaattaaaggtcagcattcagccatattttctcttctgttacttctttatggtcttagcttcatgagatgatattgttgtcacttggttgtagattaaggtgcgcctacccaatggcaagcttaccgaaggaaaactgtggaactatgatttatattataatattgctgttgtcaaaatcaagtatttcccagaacttagtacagcacagatacataatcaagggcaatctaatgttaaattatctcaaagtaaactggtcgctgttggacgtggctatgaatctggagaactaatggctacaggtgggacactgctgtacaaacctagcaaacttgactgcaaggaactcatgacctccacttgtaagatcacaaaggtattacctctcatttatttagtactatggatagattatgattgcggttggtttatattgttaatatgcatattattcacgttgaaccgccttttaaaaaaagatcatatggaaagacattaatagtgcagtttaaaatggaatctgttatgcagcagttgttcaccatcattttattttgttacaggctgggattggtggtccccttgttgggtttgatggaaactttgttggcatgaacttttgtgataagaaggaaactcctttcttaccaatcaatataattcggaaatgtttaaagcactttgatatgtttgggtatgttttctagttcttattaatgtacttccaataatcttcacttgcaatcatgtgtgctaatggacaaatttgttctccttgaccgtccactctttgaacactagcttgattgtggagagattatgtcaggactcgtgatggaaatacttgttggcttgtttagttgatacttagactggtagtttattgcttaaataatttggataggtcaaaactcaaaaccaacattctaagatgagtcatcatatcctgatcaatcaaatttgcattgccattttcttttaagcgagttgtagtgaatgcaaaaaaattgtattggataaatgctgtgagctcctcagtttcctttcaactgtcagaaccatttttactaagcaagaattatgaattactatgcagtatgactcaaaagctgaccaaccttagtttcatggcttcatctttcccctgagatccatccacccttgagtcattgccatctggcactactcagtgcaatgtttatgcctattatgaattagaccattttggttggtacttggtctgaaagatgaaatatttacaaataccatcgcatgtgtcattgacatgtgggccctggtccaaagtgtcattctcacatgcaatggtatttacatctttgtgatggtacaaacctatttttctcaatgaatgattttcataacatttggtatctgagcagttgattcatggcatttggtatctgagcagttgatcctgcacgccttgtactgctaattatccctttgataaagcattggctgtatgcagaatacccaaatggccgtgccattgctgccaatatgttgggatttgaggattcctgagtttgacttattgcatgtctcgatttcctttaacgtgccaataagttatatacaacattaagatgaatttacacaatagcatgaataaacaaagacaagcttctataagttttggccacatatggtcgaattcggcaaccaaagtttacatgttttcctatatgtcatggaatatggttcagtatatttttcctgtgaaattcctactaaatgaaaccaatcagggcttcaggactaatagaaaccccaagtgtgttacagaagagcatgaataaataaatacaaatttctgtaaaatttggccagatatggtcgaatttggcaacaaagttcatatgttatcctagatgtcatggtacacagttcactatttttctttttgtaaagtttctactagttgaaaccaatcagggtttcaggactcagagagtactccagtgtgttaaatccttcagtaagctttaagcaagtgagatgtctcatattatttcctttttaactttggctagaaattcgatttatcatgacaggagctgatttttttatcttgtttcattgattatcaaatgtataaaatgtgatattgcttgtgcattacatgctttctctggtggatgtaccaagattttttttatggtacaacttttgcattgttgcggtgcaattgtacagccctgtgagatgccaccccatggtttgacttggacaatgctgttcagtggttcatttgttgggtgtaaaatagaatggctcagttagtgataggtgatccatcgcatcacaattcacaacaagcaggacatatagatataattttcctgctacctcagttttccctttgtgatggctgctacctcagttttccctttgtgatgggatctacatccataaacatcagcagcacactgctctgccaccttctcggatgttcagcagtgccacaatcgctgcatagcaggctcgttggactgccaactactgagaagaggaccgacaatactcataatctccataattacattctattaatctgagccgccagactcagctgtttctccaagccattagcagtcatcaagtgtagttgcagtccccatactgagcaaatcactgttcctccagcagtccgctagtcccaaaactgcttagcctggttctttacttatgcgggtcatttgcacaaaatctatttgatgtgttgaacctatatgcaattttgtatagttatgttttctgtattgctagtttattttaaaattattcaatgtagtccgagtgcctcagtctaaatatttcaatcatctgctaaattttgagatatatgcaggagagttgttcagccatggcttggcctgaggattggatcactgaaacatgaaaaactggatatccgtgaacaaatacatggaagcttctccaacacaggtggcatttatgtaaaagaggtgaatatccattcaatatattcgacatacaccagtttgctgcatttttgttataatatttctttttttgtcctattttcttcattacactgcttattgggaccaaaattcaatttctcagaaaggaacctttagtgtaggtgatccagcccaggactcggttgataagaattggctgtattccaattactcgcttttacttaaattatatctcaagtctaatccatagcaatagcaaaatacatttttataaggcatgattaacgcaagcaagaaccatcagtaagcatcgataaaaaatcattaattaaataactagggcaccatggtgcctctgtacacagaaagtaggtatttttttttcctaggtatcatgctatagaaatttgtttcttttttggttctgggtataaagtttaacctgtttagaagttagttcaagcaagtttgatatgaactttagaactatatataacgctttcttttagtgagtgttggtttgtaagtatatgctgatttctttataaaaacaatgaattcttgaaaactctttcaattgaactgttgtacccaaggttgtcatgtcctaaagtctagttgagtcagccctctacagacttgcctaactatcaaagactagttgttgaatgacttgtcttgggctaaatactacatatgtaccagttgcctctattaatatgatgtcctctcctcacctttccaccaggcctctcccaagtgaggcccagtttgctccttagtggctcattgtttctgcctttgctccatagcgtcttctgctgtcaacagtggcggagccatcgggggtgccggagggggccagcacccccctatccgaccccccctcctctacgtataagaccaggtataaagtgtcagttagcccattagcaaatctagaaaaaacgtcagccaagcaagaaacatgatctataaaattaattaatgagagagattagagaagcagcgaatgcctcatgttcatcacttcagttttgcacccgtatgcgacagcgatgcacgcacgtctccgtcctcccatcctgtcttgccgttgagcacgcaccgatggctgtggcctgaggtctgatctctcttacaatatagcaatacctaaatacatgacctttagtttatttcctatccctaatccatagattgtagtcagactgagtactcagtttgtgatttctcatcttttcaaaataaaatagaagatgcttatttgtgagattcttggtagtttacgttgaaacgatttagcaataactaaggactagtttcaaactgccagtgatattattaaagagctaaaatttaagttttttttaaaaggactagtttacgcgttgattgttatcgacagtgaatatttggcctcatttgctatcgacacttgttaggtcctatggcttattcctcaacacatcccccccccccttcacatcctggcttcgccactggctgccaacaagtcaagttgcggccctcaagttgtgcctccctggctgtgtgtataccctaacaaagagaaatctaaaagttatagtcaaatcttagttgaatgtgcacatttgatgtcatgttgccaccttcagctttcttgtattccataatccagacaacgacaattcatgggccattaaaagacttcttcctttcttgcttacaaggtaccatggcggcccatgtctcttagtcctatgcgtctctgaaatcactatctactattcattggttcctatttttggcttagagaatggacaagtatcccagtagtttcgttccagcaacatttcagtctaaggtacctacaagtgggaacatgcttactagtggatttagggagttgtgatattggcatggttagctgtaaactttaatccttaaaagagggttaacttgagatgagatgaaccttcaaggggagatctgttaatggtgaataatttcatgcttgcattccaggcctgaggaagggatgtaacacatatgattgacatagtttctgatatatttaggagtatgggagttgttaccctgtttgtctcgattggtgtctatgctgagacagtgagacataaaagatgaattttgctatggtgtgcaactatctgaactaggagtgatactcctggggtcgctgtagttattttcttgtactaatatcactcacatccaatacatgaatgtggcattccatagaacacttgcataagatgaggcgatgagaagcagcatggtttatgaatgagtttgatattgattgataaaaaaatcaatgatagaaagttgggtcattgtactgatctggtgaggggatcgtgtggaaactggcagattacttgttttgaattcaatggattattttagtagtgaccagtcaatagccagcgaaccactacctggccttttgtgtgggcggtctggtttcatatataacactctggttggtactgttcaatgggttcccttatgtgtatctctttttttaggttcgcttttatctgagatcatagctgcaatgtggcagaaaacttttctgttttctgatgatggacggccattttttaactgctcctattggttctcatacaaatttcgatcatttatccaaatcatttttgttgttttcctcaagatggtatatttaatttaacttgcagaatctatttcgttggctatttaaacattcataactttcttggttaaatattagcttttcataactttgtttgaacaatgataaaatgaggtatccatgttagctttgatgccttgtcaagtgctatgctaaatcctacttgagttagaacaaaaaaaaggcttagcatctatcttgtccaaataagcgggttgactgtgaacataattagggcttctatattaattttttgtgtagtacttacttcaaaatttactcgataggtttttgatggatccccagcagcagattctggaatcaacgttggtgatgttattaccaagcttgatggagtcgatctattccatgcacaagaggttctgtttcaaaagttctttgcctggaaattctagtagttaatcttaaaattgttttggaaaatcaaactgatttttcattgtggttcttctgactaaaccatttgcattttgtcccaagcaaaatctactagccaaactgttatagtgctattacctgttccttccattttattattcacatccaataattttcactatgtgaaaactatactgttaagagttcactgtgataatatattgttttggtgaacatgtgaaagatataagttcttttcatgatgtgaagtttcactgttagtagatcgctgcaggattccaggatgtaacaaaatgaaaaaaatccagtgcatgtgtataatctgttgtagcataatgtttacttactgcagactagagttttcttttcagtgcatgcggtctttttgttggatattttcttcataattcaatttaatatgtttactttcacaagtgagttacaacttacaagttcagagtaaaacctagcatgatgacttagtgttttccatctttttgaaatagctcaattagtatctggtaccattgcaataatcttaatttgcatgtctgcattttttttgggtaccatttattttgtaatgtaggcaatagaagtcaaaatgtgttggtaagataaggtagtaacgatgtctttacttgctgtatgtatgcaaaacagaataatacatgtttgcatagtttccctttttgatggatttcagctctaatttttcttatcagttctatgagcttattttggggaaatcagaagatattttgcgacgtgatgaagagatgcttttcaaggttagctgcagtgcatgttctaaggatttgttaattgttataacatgcgtacattaattattttttatgacattctattgcatatatggaataggtgtctattctaaggccaagtaacggtttaaccttccgtgcaattgtcaatgctgaagtggttgacatgagtaggaagaacaggtttatcctaacgctctacagctagtcttgcaaatttatgttctaatgtttgtattatgtctcttaattgacagatggcctgtacctaaggcggagtggctatatccatgtacggacgatagatgtgatgaaattgtcgcgcctgatccgatagttattcgaacctgtgaagatagctattatttacgtaaggatcttatttcttacttttcactatattataatagattaatgaactaaaatgcgtcaaatatataacattgatatggcctctgtcaatttgaatgaatttagtctgtactgcagcttataaagctgtcccatactatcagtctaaactgcatgaaaaccacactctgtttctaacattttttcttgttacatgacgttaatgttttacaatgtgtttaaacactatttttttgccatatctttcagccgcccttgatgagtctgaactaagactatattacggtgaagaatgaggtggagaaatcttgcattaatcgagaagaaatcttgcattaatcgagaagatatgctgagatacttaatggaacatgcaccgcaagtttttgttgacattcatatttggcaactgaatagggctacaggagtgaaaaaaaattgcatgtctactaatattagcaaattgcatcctttgccagctgagtaatatgaattgtgttaatgcggagttgttccagcaagatgttttgtttggcttttctgtttttaacaagtttatgaaagcttgggtagtatagcatgatttataaattataagccttgtgacttgtgagacgcaagtcctatcgcatacgcaaaaccctagccgcctccgcccgcatggccgcatcccctcctccctcgtctcgccctctccctctctcgccgccgccgccgcctccgcttcgcgccgtcgctatcgtcgtccgcatcgcctcgcgcctcagcctccgcctccgtcttcccctagcgccgccgcctccacctccgccgccgtcgacgtcgccgttgccgtctctgagcgcctccacctccttctccctcgcgtcgccgtcgtcgccgagcgcggacttcgaggcagacgcggagaaagcgacgaggcgaacgctcctctcctcttccactctcgtctctcctttgcctacgaggagctgtgcctcgccgccatcgtcatcgtcgtcaacctgccgccgtcgtcgtcaactggccggcctagccgctcgccgccatcgcagtggccagatctgatggcacgaactcaaggccgcctgatctgatggcggtgagctcgtggctgccgatggttaggcggttggtggagcaaccattgtcctcccaccaaccggcttcaccctttccgccgccatcgacaccttgtcgctgtgttggacgaggggctccgcctcttcacgcgcagccagccgctgcgtccgatagaatcctcctcacgcgccgcgaaccatcgatggaccagctgaaggagctcgggtgggccaagcggtggagctcgcagccatacgtgtcgtgccgcacggtaagtgctatatcttctcaagcaccaagcgcttcgaatttgtagttgcagagagcattctgacctgcttctattgtcaggcgtcaggtagagttttgggtcaatgcgattgcattggagcttgaattgattggtgttttatttatgaactgtgacagacatctctgcaagagctcaccaggcttgggataaagcacgtggagaacctggtgattccgagtgtcagaaatgatgtaaggcctgctaagcttaaaaatgtatttgtagctttgtttagttatttggaaattgcaatggtgcaacagagcgtgatgatttgatggggattctggaatcaagcattgcaaaattgcaaatgcagaagaatagtagtgccataatttgttcagaagcatagtcccccattttccttcttgtgatcacgcaggcagcattttttttcactgttgtcggttcaaccggattcctacccattcgtgcaggccagcttagtagggtttttccttgctacctcctctttgtgctactctggattgataaaaataatcttttttcccttacaagataagtgcattaggcttcggtcacaggttcctgcaaaataatttttctgttgatattaataaacatcctgtgatatataattttagcttttcaaaattctctatctcaggattggggctttttggttccttacttgattggaagcatctcattgatagtattagctatcggaagcatttcaccagggtatgtgtttgttgtctctgctaataagcctgtgaaagttgggaagagccggcatcaaacaatccagatgtctgacatattctaagattctttaaatggatattcaagcagcaaaacttatcagcttaattaatttaatgttatgtcactcaacatagactacttatggcatgacaaataacactatctgttttatgaatgctcaatgaaaatatgttgcaactttatcaaggatatattgtaattttccattccatcatcacagtcttctgcaagcagcaattggcgcatttttaactgtttttcctgactatcaagacagagttgctaggcatgaagctgctcattttttgggtatgtctccagttctgcaataggagtatgtctgaaaataggttttttactgactatagtttattgaatattgaagtgccttaacaaccaatcgtgacaacagttctggagcagttttagtataatggttaatgatgatattgtcattgtaaagaattatgctgaactagccatctaggtaaaggtaaataacattgatcggaagaatcacttgaaatatctgaagctaacttgagtagaactaaagagcaatacaaaaatattttttgaagctaagctaatggttagatgagctggatatgaactaaggctgtcaattggatcactccattagatgcaagacaatcatactgacctttcagattaattaagttgtatattctcagatttttcaggcccatagacagttgacagccagtcagccactgaaaaagtacactattactagcttagtttttcttttcctacttctacttgacagattaagtcttgttttttactatatgcttttaacatctatttttggaataatagttagctgccttaggatgtaagccactagtagttttccttaggatgtaagccactcctagtttcttaggatgtaagccactagcctataccttatggtgtaagccactagcctatatatatgtttccaaccagccatggttgatagagtggagaatagaaattaaaactagccccaaacctgtgttccttttgctaacactacttggtcagtgtactacttaacatttttatataaataatatcgtggttgtgattgggcatctactggaaaagaactggtaggtcaatgaatccattacggtgcttgtgttgcagggatagttctctcgtgttgcactccaggtgtttgtagttttgccttacggaagagtagtttcagttctgctccatggcttgcagtggttgattactaggggttgatcactagaggtgtgattcatgcttgtcagtactggtaagaaaattcacatattcctgtcatcctgtgtttagtgaggacttcttcttcatctattacttccactgatcagtcttcaattttgg

SEQ ID NO: 73744 - DNA, 11290 bp, Oryza sativa
  unsure (1)..(11290): unsure at all n locations
tgcgggagcaaatccgtccgtttgaatgcgaggcagagaggggaaaaaggggggaaaggaagaggggatcacggggagtaattcccccctattaatttcacgcgggggtggcgggatgcggcgtattcgccggcggcggcgacgcttggcgcatgtgggcggcgggaacgccgggaggaaggggatgatgggtgggccccacccgtcagcgagggtggcgggcgggcccacccgtcagcggcacgcgcgcgggagaggccgagtgggccgcggggagaggagagagagggggagggagatgggccggattcggcccaagagagggaaggggaatttttagggtttttctttttataaaacctttttaactttgtttatttcttaacaattattatttgtgctctgaaaattccactaaaatttatttacacattttaggcttttaggaaatatacaaaaatcctctaagccttatttgacttttaactttgcacattttaatttttggaagctttcacaaggattttaattattctaggcataatttaaaggatatattttagggtcgttttgggacgcgacacctgggaattcattatcaccctggaaaggctaatgttgtagcagatgctctcagcgggaaaggttattgcaatgctacggaagggcgacagttgtcattggagttatgcaaggaatttgaaagattgaatctgggaattatcagtagaggctttgttgcagctttagaagcgaagcccactctcattgatcaagttagagaagctcaaatcaatgatcctgatattcatgagatcaagaagaatatgagaagagggaaagctatcggtttcttggaagataagcaaggaactgtatggttgggtgaaaggatttgtgtcccagacaacaaagatttgaaagatgcaattctgaaggaagctcatgatatgctatactccattcaccctggtagtactaagatgtaccaagacctcaaggaaagattttagtgggcaagtatgaagcgcgagatagcggaatatgtagcagtatgtgatgtttgtcagcaagtcaaggcagaacatcagaaacccgcaggtttgctgcagcctttgaagataccagaatggaactgggaggaagtcagtatggatttcatcactggtctacccagaacgtcgtcaggtcatgactctatttgggtgatagtcgacaggcttaccaaagtggctcattttattccggtgtgaaccacctattccggaagtcgtttggcggaattgtatatggcaaggattgtgtgtttgcatgttgttcctaagaagatagtatccgatcgaggtaccagtttactttaaaattttggatgaaacttaggaagagatgggttccaagttgaactttagtaccgcttatcatccgcagacagatagacaaaccgaaagggtaaatcagattctggaagacatgttgagagcctgtgctttagacttcagtggaagttgggataagaatttgccttacgcagaattctcgtacaacaacagttatcaagctagtcttcaaatggctccttacgaagcactgtatggtcggaagtgccacactccgcttttgtgggatcaaacgggagaacgtcaagttttcgggactgatatcctaagggaagcagaagagaaggtaaaaatcattcaagaaagattgcatgtggctcagtctcgtcataagagttatgccgacaattgccgtagagatcttaaacatatcctttgattcttgatccaaattcttccttttgatctagccactgatctaattcctgtggcttgatttccttctcggcacaagaataatattactacaaacattgtgaataattgctcttctgctaagataatagattatatccttgtcatccaaatctcctattagcctcaaacaattctttgaaacccatgccatatattttgaggctaaaaatcctatctatcttcctccatttattttctctccctctcatttgagtgcatcaaataaattccgttatattctatctctcaaaatattgcactcaaactagaaaatatctcttttggaaattatatccaaatataatttcctttcaaaattccctattcaaatttcttccaaatactaatctcatccaatttctatcatacaaataacctacaaaatttagaattgatttctaaatttaattgggctaaaatccctttgtctcttccttttggcccatcttcctcttcggcccagcccaggcgagctgccccttcctcctaccgtgggcgcatccaggcgcccgcatgcgccgctactgacgccgtgcacaactcagctaccgctgccgacatattgccttcgatgccaagcaatcgccgccaatgtcctgccgtcgccgctaaggcatcgacgncgacgtcatatgtcacctcacgccggcgacgtnagactatggagcaaaccgacatcttcaccaatcacaagccacaagccgtgccgtagcactttcttttcacgntcgacgcaccaagaccaagctcatcttttgctttacaaccgaccttcacaaccgacgtccgacgcctataaatagaaggccagccctccccttttctccacatatgagccgagctcctcgagctctctctctctcctgttatgtctagccaccaccggccactgtcgatctccctcaccggagtgtttctggccaagcccttgcgccatcaggtttgcctcgatgaggtgaactcattttcctagtttccccttcctttccccttccgaaaccaaccatcacagccacctccttttgttgtcggagcaagctcttgcctgcgccgttccagcctcctctctcacttcctctgccgactgtcaccctccccaggtgcgcgtcgctcgggaacatgtttttccgccaacgtcgcagcctctcaaccaccggagtatcgacgcccgtcctgtcccttctctctgtttgttcgtggagaaagagagaagaagcaggaagaaggaagaagaaggaaaaagaaagagagaagaaaaagaaaaaggacagctactgacaggtgggcccctacagtactatttcacattttctagatttaattcaaatcctattctttagaagcccatatctcctaaaccgtagatccgattccagtcaaacttggacctaaattcatctaaattcaaaccctaccttttgatactaaatttgctatttaaatattttatttgaatttccttgatttatttaaatgccatttgcctttcaaatatctcctgttactccaaaataccctttagccactaaaagccgccggttagaactttacgccttccatggagacgttcgcggtctattggccccgacgtcgaaccgttggttgtaaagcccagcaaattccaaaaccaaggtcgaagtgctgctccgggtatcctacgcctcgatgcgtacaactgtcggagcttcattattccctcgacctccacatcacgccgcacagttagctctcgagctctgtgtgatcctagccgctccgccgccacccctctcggatgaggcttattcagaattcttgcaacttcagggggttctggacaccttgaacttacaatcagggatgggggatgcttggaattttatctggggctcagataagtacactgctaagaaattctataagttaaattattcttcattgcaaccccccagacccatgatttggctatggaaaacaaaatgtgtcatgaagatcaaggtctttgcctggctaatgttctgtgatagacttaatacaagagatatgctggatagaagatattgtgccaaagaagatgatgatctcacatgtgttttgtgcaatgcgaactgcagagagacaagactgcacctcttctttttatgccctttcagcatcaggtgttggcaatacctgggaattgagtggaataacaatttggagtttttccaaatgatctctctagcaagaatcaaatttgctcagaagggtttcctggaaattttctttttggcagcttggcacatctggaaacaaagaaatggcttcatatttcagaacatccaaccctcttttcaggcatggagatctcttttcgttaaagaagttcttctgcatatgtgcagaatgaatgaacctttaaagcaaactgtttttaattgggtacaaaccttatagtatctctgtgtgaaccgcatgtaatatttgtaaccttgtaaatattttgtttatttataaaactacactactgggcaaagcattggcagttttcctggtcaaaaaaaaattgttagtttcgggtcccgacaggactggtatcagagcatatgtttgactataggatgaaccttaaggattactgactaagctaagtttgaatttatttcaagcttacctttttaagggggtagatttaatccacgagcatgcattataatatcatttgtgtatttcaggacaatggcagaagtgcatgagcaagaacttatagaaactgcaattactatccacgataatgactgcattgatcaactaatcaatttgatgactaaactgaagataaatgagaagccggaattctattcacatgcctatcaacggggagaacgttgggaatatgatatgaccgtgaagatcaatcctccacgaggtgaacgtgatatgtattacttttgaacacgtcataggcgggataccgtgcgagctgcactatatgatgtgtccagagaggcttttctacgtcttaatcatatctaccaagacaggttacaacactctcgctattcttatcatcgggcgaagattattgtaccctccagaatgtggattatcatgaacaaccagtaaaagcaactatgtccatctggatggaagccgtggatgatatgtatgaagaagctttggaacatatggacatacaacgtaaacgtttggaggaagctgaacacagagaagctgttctcaaacacaaatatcgtatacttcatgaattatatgaggaaagggaaaaacaaaattctatcctcaatatttgtgttgcaggagcagccttctgtcttcaccaaattccaagtatgggtagtgatgacgaagacgatgaaggtggtatggaaggacatatctcaccagtacgtgaaggtgaaccacatgggccaaaccctcaggataatggtgaagaattttacaaggtttaccaccatcaccaccaccgttgtatcctattcattctgatgacgaagcagaagaaatgcattcagccatggatatcagtgaacctagccaagaacctaaaatactcaggccaaatcgggtgtttcatatcaataaccaaaatactgccccaatttggactgaatctccagaggaagaggaagatctagaagaacgagagcttgagatacaagaacatctttctatacatgctgatgatcaagaaaataatgaagacccctactcatgctctgctctcagtaatactgcatcaacttctgcatctcatgaattttcacacttcgaacctacatcgttatttgctaatcccgcagaaggcagtggtggatggcttgacgaatagaagttatagatagttaaaggtcttaagtgtagaatagttagtgatcctactcctctctaacttctatgtgtgattaccccttcttttgtggttgtggttttctttggtttgtttcttttgtagcatacaccatgtacaatgttgttcataaataaaatctatgtttaattatggatgttgactcccctttgagaagatatcaattaccccattttctagatgaatccgggcaatggcagtatgggtgaaggagatacaggagaaatcccttcaccaaatcctactaccttggcagaagtaatggcaagacaaactcaattattgcaagccatagcacaaaatcaaggaaatataggttacagcgcacatgcagaatttatgagaattaaaccaccgatcttctctaaatctgaagaacctatggatgccgaagactggctaagggctattgaaaagaaactaaccttggtcagaacaaacgaacaagagaaggtaacctttgcaacccatcaattagaaggaccagccaatgaatggtgggaagcatatcaagcttctatagaagatcctacacatattattacatggatggaatttactacaacttttagagatgcttttatacctacagctgtgatcaggatgaaaaagaatgaatttcgtagattgaggcaaggttttatgacagtacaagaatatttgattaaatttacacaacttgctcgatatgccgcctcggacattcaagatgaaaaagaaaagattgaaagatttatagaaggactacgtgatgaacttcgaggaccaatgattagtcaagatcatgaaaattttcaaagcctagtcaataaagtggttaggctagaaaatgatcgtagaatggtggaaggactccctaagagaagaatgaatttacaatgacaatcactaactagaggttcactacaagttcggaggccttatccatttaaggcatctctacccaatgcaaggccaggcatgccaccaatactaccaagacctggattaaaaatggaagactctccttgttatgtttgtgggaaaattggacattttgcaagactatgccctaatcgtcaaaatatgggaggccaaacttcttatcagaaaccatctactacaggttttataaagaaaaatcctccaataattaagagtggacataatcttggacgtggtcaagtacatcatattaaagcagaagaagctcaacaagatcctaatatattgatgggtatgttcaccataaactctaaaccagttactattctatttgattctggtgcctctcattcctttctatctgcaaaagccaattggaatcagtctttacctaaagataatttagataaggctgtgctaatacattcacccagaggaaactgtattagtatcatctatttgtagaaatgttccggttaaattaggagatcaaatatttttaattgacttgatggtactacctacccaaactatagatatcattttgggcatggattggttagccaagaataatggactgatcaattgtgcaacaagagaggttatccttactgatgaacaaggaatgaatacaaggataatagttaaatccaatctatctatggaacaacatatgacagacatttgtatgcttaaaccaaaagaagaagttccagtggtgcaagaatatttcgatgtatttcctgaagaactaagttcattacctccagatcgggaaatagaatttattatagaattacttcctggaatggcacctatatcaaaaagaccctataggatgccaattaatgaattggaagaattgaagaaacagatagctaagctgcaagaaaaaggctttattcgaccaagttcttcagcttggggagctcttgtattattcgtaaagaagaaagatggaagtttaagaatgtgtgtagactaccgggctttaaatgaagtagctattaaaaacaaatatcccttaccaagaatcgatgatctatttgatcaattaaaaggagcaagtgtattttctaaaatagatcttcgatcagcatatcatcagttgaaaattaggcaagaagcatttggattaaccaatgcccctgcctatttcatgaatcttatgaacaagatatttatggaatatctggatcaatttgtggttgtatttattgatgacattctgatatattccaaaaataaggaagaacataaacaacacctacgaatggtattggagaaattaaggcaacatcagttatatgccaaattcaataaatgtgaattttggctagacaaagttgcatttctaagacattataactaaggaaggagttgccgtagatccggagaagattaaagcggtaatggtatggagaacaccaacctcagtacctgaaataaggagtttcttaggacttgctggatattatcggagatttattaaagatttctccgctattgcaaaacctatgaccagattacttaaaaaggataggaaattcgaatggacaccagaatgtcagagtaattttcaaagattgaaacataagcttactactacgccagtattaatcttgccagacatccaaaaagattttgagatctattgtgatgcctctcgacaaggattaggatgtgttcttatgcaagaaggtaaaatagtagcttatgcgtcaagacaactaagaccccatgaagataattacccaattcatgatttggagttagcagcagttgtacatgcgttgaagatttggcgacattacttaattgggaatcattgcaagatttataccgatcataagagtttgaaatatattttactcagatggatcttaatcttcggcaaagaagatggttagaattaattaaggactacaatttggaaattctataccatccaggaaaagccaacgtagttgctgatgccttaagccgaaaagctaattgcaatctacaacaagaaataatatcagaacaattgcaagcagaaatgcttaaactaaatctgggtattattaagtttgaagaattaaacactttggagttaaaacctaccctaatggatcaaataaaagaacatcagaaggaacattctgaaatacaaacttttaaggaacgaaaggtacaaggaaaggctgcagatattaccgaagacctggaaggaatattttggtacggagatagaattgtcgtaccacaatcaggaaacttgaggaaggtaatactaaaggaagcacatgattcagcctactctttacacccaggtagtacaaaaatgtaccatgatttgaaagacttatactggtggccaaatatgaaacgacatattgcagaatatgttgcactatgtcatgtttgtcaacaagttaaagcagaacaccaaaagcctacaggattattacaacccttacaaatacctgaatggaaatgggatgaaataggaatggattttattactggattacctaaaacttctactggatatgactctatatgggtaatcattgatagacttacaaagactgctcgattcattcctgtgaaaacaacttatactggagcacaagttgctgaactctatatgacaaggatagtatgtttacacatagtgccaaaaagaattatttctgatcgtggtaccaatttacttcacatttttggcagaaattacattatgaattaggaagttatctggatttcagtacagcatttcatccgcaaatcggaggacagacggaaagactaaatcatacattagaagatatgttaacagcctgtggtctagattttgctgctagttgggacaaatgtctaccttatgcagaattttcatataacaataattatcaagccagtttaaaaatgtcaccacatgaagccttatatggaagaaaatgccgaacaccattgatatggacataaaccggagaaagatgtatattcggaacggaccttttaaaagaagctgaagaaaaagttcgactgattagagacagacttaaagtagctcaatctcgacaaaagagttatgcagattctagacggcgagagttaacttttaatactggtgattatgtttatctaaaggtttcacctttacgagggataaaaagatttaaagtcaaaggaaaattagctcctcgttatattggaccatatcaaataattgctaaacatggagaagtagcctatcaattggctttaccagattatctatctgatgtacatcctacattccatgtttcacaattaaagaaatgtttacgtattccagaagaagaaatatcagtaagtactgttgaactgaatcaggatttaacttatccagaataccctatcagaattttagaagaagcacagagaacaactcgtactaaggcaataagaatgtttaaagttcaatggaatcatcatacagaggatgaggcaacttgggaacgggaagattatttacaattggtattcccgtatcttttcgaagactcctaagcaaatctcgggacgagatttctttaaggggggtaggtttgtaacatcctcaaattttaaactaaaatttgactgcatcatgctgacttttgattaatttagtgtgtttcaaaaatttatttggttcctaattggttcaagtattacttctttagaaccctactaatttacccaaattattccctttattccaaaccctagtgaatttgagcaaattctctcaaatttcaaactatagattatttccttagcttatcctaatattagtgaggacttgctatacttcaaaccctagtgaaacccttccaaattcatagattaaattcattattttctacggaaatattcaaaattctgaaattgattgttcattgcacataaggtgttcggtagaatgcctagcccaactagagcagcccaatcccctccaatcttgtacaaagtctagaattgatcctaggggaccacaacccacttaaaaccgtggctttctttgcctcttcctccccttcacgcgcgtggcccgggcatccgacttagtcgcgcgccgtgtcgctgcgcgtcggcctcggagccgcttgcgcgtgcccgacctccttggcgcgccgtcgcccgtccgacgccatcaaccccactgccactgcaccaatcgcaacgaggacaaagccaggacgacgaccgccgcacgaaatcgccgctcgacgccgtgcgctcctgtccaagccgccgccgagtgtgatttcgtttctatccggggtgaatcgcgccaattcttgccgcacggttggattgaagatagacggtggtatcccctctcacaattcaaaccattcacccccgagccggccgttttcaccctcgccgccattgcgtgtcgcgcctggattggcgccctcacgtcgccagccgattccaaccgcggtcaagtcaatccttcgccggtaagtatttgaacgtggcctcccgccactcaaatcgatcttacccgccctctcacagcctctgctgccctagctctatccaaatcccgagctcatccatggcgatgacggtgtccgagctcatccgctcctcctagccctataaataggaccccaatcccttccttgtccatcatccatcatcaacaatcaaagccctacaaccccgaagctctgcttcg

SEQ ID NO: 73745 - DNA, 55465 bp, Oryza sativa
  unsure (1)..(55465): unsure at all n locations
agatttttggtcattagggtaagttcaacacgcagtgaccccttgctgtaattacacaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttctagattttctcctctgccaatatctgccattactggcactggaactggagagctccttgatatggtgtgttcagagctaagtaattttgaggtactgaacttgcttagtttgcccagaggccagggaatgtttaattgtgtatgtctatatgcatgcttgatacccttttctgtttatggttggtaatggaatcattattataattttttgttgcaacactaaaatgttactcttggctgcggaaacaactcaagtattgcttctgacaaatggatatgctaacttagtggaatatttcactctctttcctccagtcctacaaacctagatgaatactgctagaaacacgtggtgtggtgacaccttgttatatccagcctacccattgagcttctagatccagaaccttgaatcataagttgtggtgtttgtcttttcagtagttctttaaaatagccttctcctttccaattttgattcatatatggaaatattttgtccattacctcacaaaatgttttacaggaactggatggagttgaagaagatggaaactatattcctgctattgccattgtcggaagacctaatgtcgggaaaagtagtattctcaatgctttagttggagaagatagaactattgtgagccctgttagtgggacaacccgtgatgccatagataccgagttcaccacagaagatgggcaggtttgttcagaatgcttatgaaagtttaagtgaccaagagcagcatcattatttcattattgaccctagctatgtccacttttcatgcatctttcatctttgtagcaaaacacaatttgaattggaagaaagaaatttacatctcataggaaagtaattctaatttgctgatattgcaatatgctgcagaagtacaaactcattgacaccgctggcatccgacgaagggcagcagttgcttctgctggcagcacaacggaaacactttcagtaaaacgtgcatttcgtgcaatccgccggtctgatgtggttgcccttgttgttgaagcaatggcctgcattacggagcaggtatctctaccccatcacatgcacatgtgcacccccaaacaattcaaagagatgttgtcttaccaatcttttctaacatggtgaatttctgtggtaccaaggactataaaatagcagaaagaattgagaaagaaggaaaagcatgtgtaattgttgtgaacaaatgggacacaatcccaaacaagaaccatcagagtacaacatattatgagcaagatgtaagagagaagcttcgcatactcgactgggctcctattgtttattgttctgcaacacatggcagcagcgttgacaagttaatcccttaactttattttttactccgcaataagcatttggtacttcactactatagcatttgatggtttaagctaggctatttgtagcttgtcggtgttattgtctattttcctgcataccagacctgaaatttaagctgatgtcattaaggcattaactaatgtttcatgctgaatcttcatgttcctctgttatctcccaatttcttgtaatccaactaattgcattgcatgtaggagattgttaacttcactagatatgtttttctgtattggcattgtaattattctttatacacaaatattcctcaggataatttctgctgctgcactagttgaaaaggaaaggtctagaagacttggtacgtctattcttaatcaagttgttagagaagctatagcattcaaaccaccaccacgaacaagaggtggtaaaagaggtcgtgtttattacacaacacaggtagcttctaacttcttattgaaccattctgtttattcctcttaagccaacaagtttatggtctcacctttcaagtaagtcgtaaaggtcactagcgttctcttgatctctactacaactaaattttcacttccttgtatgtcaagtgaagtccttaaatcaaatacagctccttaattcatttttaagtatctgaagatatatgattgattgaaactggatcccttaaagaagtatttcaaagtcagcaaaggatccactggttacccacttcaaagtatatttgatacactcactgtcctaagatagagtagtaatatgcattctgcaatattatcagggccctttgaaatccgtactgcttttagatttgtaaagttcaccttggggaaatgttttcatgctttccttttattttcgcaccaaaggaagcttattcttaacctgcaggctgccattcgtccgccaacgtttgttttctttgttaacgatgcaaaacttttccccgagacattccgtcgttacatggaaaagaagcttcgctctgatgctggattcccaggaacccctattcgtttattgtggcgtagcaggaagagaccagataaaaaaggtgagtcgatatcaaagtgcccacttgcataatctcaatgattttaactgaataatttttctactatcatacctgcatgcatagaattagaaaagattattttgtgattgaatcattgaaacagacagaacgacaatgctagataagtgaaaaaacacagaaggaacaaatattgtgctatcagcaagagagatttttgcagtcccattatatttgatttcaccaatttctatgatatatgtaggtgtaccgtgcacatgataggttaaggaccttggtccttgtattagaacaaatataatgctaatatctgctgaggcttgtagcatcaaggtagttgaccaaagtaataagaatacaaaatatcatgtgatgatagaacatatagaaaaactatttaattgatctgggtatatccaacaccgctatgaatttcatattaggagtaatgttttgtgctctaccatacctgctgttataagtcatatgatgatgaggttaaatagaattgtcatactaattactccatctgttcttggcaggtaaatctgcagacaacagcttgcagagctcagtaatcccaagcagaatggcgttagccacatgagttacacatgcttttcctttcttgagagcggaaaaagggagagaatacagaatgctttgcctgcattttttcccaagaggtcaagactgccggtaaaaaaagagtacaaattgtatatgtagtggacgagtactaggactggaggtcatctactaggtgttgtgactacatggtgctagtataagttctgtatccttggatgtctaggatgaccagcaatttgccacgtttggtgctctgacatttgcttgtgccttggacgaatactgaatagtactctctccgtttcaatttcaggttataagaagttttgactttgatcaaaatcaaactacttgactaaatttatatacaaatatagtaatatttataataccaaattagttttattaaataataattgaatatattttcataataaatttttcttgggttgaaaatgttattatcttttactacaaaattagtcaaacgtaaagcagtttaactttgaccaaagtcaaaatgttttgtaacctaaaatggagatagtagtatattgcgtaccggaatttgccacatcggtgcctccacatttttttaacgtctcgcaacaatgcaaagttcatattcatattgatagagtaagaaaaaaagaaaaataacccacacccatgcaccgacagctccaacccaacaaacctaggagaaaaggctagcaccgaactggttgtcgctatgcatgaccagtcgctgctaggccaacaaaggaactatatccgagaatgtccaaaatctaaccctaacaactgacaccaagcccactctagccacctcttgagattgagggagagagggggtgagagagaatgttggaatgctttcccccctagcccttcgtcatgtccaccttgcataagctagagcgccgacacaaggggacatgcatctagagcaagcttacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctcttccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtgaatacaataatcttttgctgcagttgtatcagctgctgttcgatttaaaagagctaatggagctttgtggccaagctgataagatccagagtgaggtgttccttaaaaaggcaatgaaaaaagcttgcagagattctgatgatgctgttgcagacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttctgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccagctgtggcaatatgctcgttgtatatgaattagcacagagagtggtgaatatgaaacttcctgttcttgttgatatttcactttatgttttaaattctcggcatcactgcttgtgaaattgttgaaattgtcctggttattcttggattataaatatctgatgacttttttgtttctgtttctatttttctataattttgaaatgtaataagccttcggatatttttttaagggccctcttaatttgtaaagtcttctgtattttgtgatcataacaaatttcttgttcgcggatcggacaagttgtccaatctttttcaactcgatgcattgatgtcagtatgtttggttgtggacagacaccgtttcggattggatatcatccgacaaccttggtcttcagtgcccgtgtctcgtttgctttatttgtttcggacgtccctgtcgcttcgactccgattctgttaacttcaagcgtgaaggccctatataatgaatgcacttgttcgcttctctctctccctctctgtcaaaccaagatcgacgctctggttgctttgttaagtctgcacagggaagagaaaattgtacgagttaactgatttgggcaatggaaacctcaggctctgacgagatgcagcagggcgtaaaggttgatacgactcgggtcatagagaacactgctagcaccgtcgacagcgagacgcccgtagagcaaaagaggagaaagaaggtggaaacggagtatgtcctcggtgggaaggatctagagtttatcttgtcatacgaggacgatgaacttgagacatttgatgaggatatgctcaaggaccaggcaatggtccggcaacagattgagaattttggctatggtttcctccatagctggagggaagttatctgcactgatagtgaagaagaagatgaccccgtgtccgatgatgatgatgatgatgaacaagatgacttcttcaccaatgatgatgatgatgaccagcaaaatgtcgaccaaatggataagaacatgtatgctgaggcctgaggggctaaaaagctaaaaacgatcacaatttgtacttttcttacaatatatattgcatgtcttaacttagttattcaattgattcatacctaaaaaaaataaattgatttattgtcgtatatataactagatctgatttatttctagatatattttgttcttcatattattaaaacttggtgattctttactttttctcctaatttataacaatattggatatttatctgttggataaattctcctgccatcttcccctgaaaaaaaatatatgttggataaattagtttatagcatctactaatcctaatttgctatagatagcatcgaaaggtttggctcactttaatagtaccaaaagttggaggcgcctataaatcgggcgcccgatttttttatcaaaagtttcgaaaccctagctccccgatagcgacggcggcgccgggcatgcctcctcgtcggttgcggctccacccacttcaggaggagaggagagagaagagagggggtgaaaataatattaggagagtagaggaggtgaaaaaaaattgaagtgctaagagggaaaagagagaggaaggaagaaaaaaatgtggataattggggtattttcgtaagtgaaaatatgctcatttttacatgtggcctcttaagaggtccgtttgcgaaaataaattttaaatacgggtctcttaaggagtcgtttatgaaaatagagatcattatttagacccgatcaattacggttcgcttgcaacttattagggtttatgtacggaaaaatcgtttctacaatagtgaatttttaattttaaaaataaagcatacttattttaaatctaaacggtaacagtacggtttgaaaattccagctcacgtcgactgtatatctgcgtttactcggtctcacatccgacggaattgattccgatcacaaatcaattgtttaatcctgttctattgagctaatcagattctggtttggttaggtatcctgattctgttaagttaagccaacctgattctgttttgtttagatctaaagatggtctaatatatactacctgcataatcagttcctgctaatctcaaaagcaagaaccgtgactactccagactccagcctagcgagaagagagaaagagagagacagactcagaacagtgacaatttcagatttgcaagaagagacagcaggagtaagccaaccgattaatcgatggaaacattcagctgctccgaaaaattgcagcttgatgcagacgttgatactttggttgtcgaaatcacagccaccgtcgtacacaacgggctagccacgaaggtgatcgagaaagaagaggagaacttgaaaaagaaaagaaaatgtgtgaagaagatgcatggtggagtttgtcattgatggtgatgacttggagtttaccttatcatatgaggaagatgaacttagcttccttttcgagaaaagcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaattgcctatttagaaaaacaccattactatccatcgaatcagtcggatgccactctgctcttctacaattggaaccgtaccactccgtcatgggttgacagaaaccgtgacggaatgacttggttccaattttagaatagtagagtagcatctaaccgattagtaatagtaatgatttgattttgcttttctccaatcctacaaaactgggaagcattgttctgcttagataatctacactgatgtgacaatttaacgccgtttgtgtaagttattaaaactggtcttttttttttcagttgggaaaagatggaaaggactgtagtcctgtgaaattcaaaaacaggatgactttgttaccgagttaaacaatcatttgataactgtttaccagacagcactcaagattagagaaatgattgaattgtgtgagttttacgcaaatatgtcaaactccaagaggaatgccattcctgcaaagatgctgaagaatgctcactgtcaggaagattttggtgtccttgatttaattgaccaggcgcagaaaaatgacaagtttttttttgctaacattgctgtgaaattgaagtgtttgctgggacgtctttgtactgcaggttacaaactccggctgataataatcaaaaacaatggcaggcctatcaatgatccaatgtcattagattctgctagctaggtagctccttatgattggaagtagtcctgggaatgctcttcagctttgatttggaatagaaaacaatgatagatgctcagtctccttccttaaagacctgtgagatcttcatattttctatttccctcttgtgtgtacaatcttctctttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttataatataaaaaaatggattagtatattttcagttagttcttcaattgatttgctatatggtggtgtcgagtgtgatagtgaaatcatgggtgcaagattacttcattcatttatcagcgttcaaatcccgatattcatccccaggtaaaccccatatataagattactgtaggcattcttgattggtccataggttaaagttatgtactccctctgtttcaaaatatttgacaccgttgactttttagcacgtgtttgactgttcgtcttattaaaaaaaatcatgaaatatgtaaaactatatgtgtacatgaaagtatatttaacaatgaatcaaatgatatgaaaagaataaataattacttaatttttttaaataagacgaatggtcaaacacgtactaaaaagtcaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgctcccgccttcgacgtcacatatcacgatgcgcttgcgagactgaacaaattaagctggagtactatattatcatgttgtttgctgcacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccagaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataaactgaatgatcatgttcagtgttggtccatatccatcttagttgtagtgtagggggaattatagtttctccttcatttatcagtataataataacagctgtgctactctgtggtttgactatagttctcttttagattcctgctatggtttgattctagtcgtgctatgtttttatcttggtcagcattgatctatcatcatggttcagggaacctgaaagtgacctagactgaagtcacagatcagtagttttgttgactgctctccctgagataatttcagtagtagttctgttgactgcttttttttggacacctgaaaaatgttaggttataatttggaaccccttgcaaaaagctcgcctgaaatatgttaggcctaatttaaagaagctaagctgatctctgttgacatgttttctcctacattattcagagttgcatgataaggattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagtactttaaacatgaggtagacgtaggagataataacatcaaaaccaatagcacttattatattatttagttgtatctggtagaagaatacaaactaatgctagagttgacaacttttttcttccttaggaacggatttaaccgatttgcatcctattaaatctttaggcttatagaaatgatatagccaagctatatcatgacaaacggtgataatctacggcttgaggcgcctgataaaacgtgtattttatattgaaaaggatgttttcgttcagatattgtgttagtattttaacagtgttgctgctaatgctgatctgttatgctaaacaagaaatattaaaccaaaaactgataattgagattgagttccataatccaacacaggaagatactacgacaactagtaggtaaatcttaaaaaaaaaaaaaaagaacgactcgactgctaatcagcgaagtgtatcagcacatcgcttagtagctaattcagcttgttaacttttcctccattgatggaaacacccggtcgaaaccttctttgaccaggatgaggagcagggaaatcttcagcgcctgcaggagaggattcttggtcgccagcaggtaaggtttcttctccatcagcttcaccagaaggtaaggttttttctccatctttacctgcagatcgattcttcatcttcacctgcagcttcgtagcctttctgataagcgtctttctccacatagcctttctcatagtactgtttcagaacattgtctctcgctctcatatgccttgattcaatccggtttatatcacggatgatcttagcaaagtattcatccatatgatccccaaccttaaccatcctcctcacgaaactccacggtttggtaccggatgtggctatcaatctcggcttgagacatcaactccttcttcgtcgccgtcgtcttcttctttttcccttccgacgaactgcctgccatggtcgtcggctttttcccttccttctctgctgctgatgccgccgttgctttcttcttgccttgatcggaagagcttgacatgatcgctggctcgcaaatccagatgacaggaagcgcaccctgcgatcgattgtcgtgtgatttggttatgaaaaaacctgacctcgatacatctgctgcatatttattggttggtagctccagttcacaatcggagtcggaacctgcccctgccgatattcccaaccggaatcggcagagcttcagctgcccaaatctagtttagtttagggtctggattaggcatgactaatttttaggaccaagtttgggtatcggttggagacttgttttaaacttaaaattccaaaattagatttttaggaacatgtttggatatctcttggagatctctaggtgacatcatttattattgtaaattaattttctagaccctaaaagtactcaaaattgtgtctcatccagcctagattcgaagaataaatgtctcatctaatcctaagttggtatatactcctattttggaacggagggaatatatatttaatttttgggtgtaatttatgttatcctcctggtcctagttttgaaataatgttttgatcaccttaatctttcaatgttctatactgtattattgctcaattgattggagcatttgtaatagtacaatctcaggcagcacggaaacatcctaatatgcgtgcctttgaacaaggtctaagcacgtcatgagcaagaaaaaaaattgtgagctagcaccttatattactcagaagcatgccatagaatcaagctgcaaaaatattacacaactagaagatgagaagatgtcagtgagggctttttactgattatcatcgtccacagatgtgattgcaatctccatcttctctttcctcaagctgtctgcaagcttcaatggccgaagttcaatggtggctgctctcacgaaaccatcctctgcattgtccaagctgcgttcaatcaccatgcttgaggtactcatagctaaaacaagggacagacatttgcacaaactcatagctaaatagatttgaggccaccgagtgcttctgtgctaaagaaatacgagtaactttatatggtatgtttgctaatatcaagtgtttgttaataggaaaaagtaagctacattctgtctctagcacaactaggatccattttattggaaaacatcagaccaggctagataaagctacgaactgagcaacatagtactcatgcatgctaatgtgacagaagcagtatgcatggaatgaggtgatcatgactaatgacactgattgacaagtatgtacttaaattgaaaaggtagtaccttgcaatccaagcagaggtcgtttatcaggccttttacttgtgaaattaccccagcaatttgaagtctgacaactcccgaacagaaaaggcctcaaattttggaccaatcaagttcagagcacacataaggttgcaactcacaattgttaatccttgctctgcagaaagttaaccacaaaagatggtttgacacgatctgctcgatgaggtacaagaacattcatcacagccttcttgtttaattcaccaccaactgcaacatttgtaagcacaaacataccctgaagagaggaaacagaaaggccaatgactaactatgatttttgcattctttttttcagataataaatagtatcacagttaagaagcatgcatccgtatgaaaacaaaaaaaaaaatacactgttttattggaaatatttccctttttgccctccatagtttaaaaacacatatgaaaaaaaaaagtatagataaggtaagtcagtatactgtagtttaaggaatactgacctgtatgcacactcctaaggcatatgtgcattactcagctgtcttgaaatagcatttaaaatcatgccatcttcaccaataacataattaatggtgtccacatatccttcaacaaaattttgctgctgctgctgcacctcttcaccctactatttcaccattcgctcaaacgctcatgtgaatctatctgaaagtgccaagacaacatccttgacctcatgtattttgcgacaagggcagtgacggtaacaagctcaccgccactgctgagctgcttgacatgagaatctgtgctgcattgttccccacagcagcacagcatctgtgcccacacctggcagatcatctctagcgtgccagtgccatcagcaggcgagtcttgccggtcgatgaggaatgcaccaagcgagcatcctcccctcaacatcttgtccccaagtctattagtatttgtacaagttaatttaaacttcggtttagagctattcgtcctcaatgcatctgcgttaagttgtagcaagtggagcacatcctcagctgtgctgtacctcaggtgacgagtgatagcatagcacagcacaagataatcattgcggctggcatcgggaggcagcatgtggggacgtgatgcaagcaggaaaagcatgtgattggacagcgcctgagccgtttccataaggtcagcagctgaacctgaaccatcgactacctctggttgctcctctccagcagctgaacttgagccattggcaacctctccttgctccccttcagcagctgaaactgaaccaccgacggcctttgcttgatcctcttcagcagttgaacttgaaccactggcagcctctgcttgcccttcttcagcagctgaacctgaaccaccggtggccgctgcttgctcctcttcagcagctgaacctgaaccactggtggcctctgcttgcttcttctcctgatccttgtaccagcacaggtagatctcagtggcgatgtgccagatgaggatcctctgctccatcttggactcagcaacccaggctgggtccctgtacaatcctctgctttcaaattcctcctgaccccattgcttcgccttcatggtctccagcagcagctgcttggtacacgccgagatggggatgggcaggcccgagtaagccaacctgttccaccagtcctcgactcccatccacctcgcaatcttgctgcatcggctggccctgctgtgcacgcacaactgaatcaggttgagctgccccatggagcgtgaccagctgcgcctcctcctccaatatgccgcacggaccagccggcggagacaggcgggtatgtgagcaagaaaattacacacattacttccttccgatcccttctttaccaggagtgcacatgtccagctcgagaacatggccctcaaaagtgacatagtctccaggatgacggctccaacaaagaggacatatgtaacaatgacatctgctctgctgtaaccattcagcttatgctgatgatgatttccccagactagtagtatattaaacagaaagaatgcaacggtggtggccagagacgaaagcactcggatgcaaaggccataccaagtgtgtgtaatctcagacttggtgtagaagacgtcgtggaggagggagagttgcatctcagccaccttgtacaactcgtcctccccttgcaatcgtgatccttcattcatggggccacacaaaaacagacgaggtaatggccccttaaacctatccttggcaaaatccaacaataggtgagcatttaatagcaaggtttctgctggatccaagcgacgtatgaatgactcaggcaccatttgagaaaatcttcttctcgctatatcactctcgtactttccagttgggctactaccggcacatctgagcgcccagacacgctccccatacttggcaacacctaccattaacatgaggatggtggctgacaggagaagcaaggtccggctgtcgccaacaatgactatggaggacccatagatgacataggcagctggggccacctgcacaacaagcgtctgcaggtggcgcagccacagccggttgtcctcgatggcgtaggcagtgattttgtcctgcccaccaaggtgcagcagcaggaacggtgcccagagtgccaacagctcatgctctggtgacctgctggtaacagagaggtggccaagcacgtagatcgctgtcccgtcggccagcatgtatgcggaccatataaaggcccttagcacgccagagtcaatgtaccggcggaattctgccaagatgaggagtgtgacttggaccatgaggctgagaagcaccagtgcttggagagcccattctttccatgcagcgctcacagcctctgctcctgccatcgatttctccaccttaacatctgaaatgtatacaccaatcgattgacataagtcaaaactacataatatttctttttagtttatcaacactatcaaacctaattctgatggcaatctcaagttctaaactcagcatccaagcccaagcagaataatgacagctgagggggtgtgcttccattctgttggactttcccttgttccgtatcacatgttccgggttgttgtttctttaattgtggttgtgtacatctttattatgcagagaggttgtgagtaaacttttgtgtggttgtacttgtattagctagctgtaataatgagagtaataaagctcccttttccacaaaaaaaaaaaactactatcattataattgttgtaaaagcagactcataccctatttcagcctaagcattcacattgccatgagaacttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaagaatcatataagagaggccatcaacttacttctttggtcagatgaatcgggctatcgagctttgtttcgttggtagaatgaataccgatgggatgatctagtcttttttgtttggttggtagtatgaatatcggattgtaccaccccttcccacagttgttgagcttatgattaattatccatccatttgacagtgacacaagcaaattgcggtcatatcagaaacgaaattatgcaccgaggttggtgatcttatgacttattatccatccatttgacagtgacacaagcttcacattccagtcaatgaacatattagaaacatgttaaataagaaatcatccatttaacacaaggttcacagtcacagacaccctttttttttttttaccaaccatcgattcgtctacaagactacagcaacaaatgcaaccaatccttcttccatctatccattataccatccatccacgaaccaagtcagggccgcaaagggataatcgattaccttgggcggtcgtggggagaattttcagaatataacacccaatacgcactgcttataggatttgtcacctaattcatactactttcagaatacaccactagagtacgaattttcttcgttccgtaacactccgtccatccaaagacgcccgtcgtcagttcatccatctctcgccgtttgcccgcacgaatctggccgccggcgagctcgtcctcccccacgccggcgagctcgtcctccccacactagcgagctcctcctcccgcacgcatctggcgagctagctcgtgtcgtccccgagctcagccgccgccgcaccgggctgccgccaccgcgccccgagccggcgccggtccaacctccgccgccggagctcgaagccctctgccctccaccgctgctcccctctcctccggccctccaccgcgtgcgccgatggcggcgacggacgagcgacggcggggccgacgcgggtgacgacggacgagcaacggcggggctgacgcgggcagcgacggaccggcgacgccggagctgacacgggcacgagcggcggtggactgacaacggtggcgccgggaggacggaggactgacgctaggggacggagtgtcacggaacgaagaaaattcgcactctagtggtgtattctgaaagtagtgtgaattgggtgacaaatcctggaagcagtgtgtattgggtgttatattctgaaaattctcggtcgtgggagagcgaaggagggttcgccggcggccggagatgcgtcctccgatgccggcgcgcggaggtgcggcgtcgggcaggcggtgagtgaggacgatggccgggcgcgcctattggatctatcatctacgccgccgttttttccgaccttctccggcgagccgacgagataatgacagctctgctccattggtcaacgagtcaacggatttcggttgtgacttgtgagtactactatggtccatccataaaaaaaaatttggtatattttgactttccaatttaagctttgactaataattaaccgcaagtataatggcatactagtataaattaactataagcacacatagatgagataagaaaagaataaaaaagaaagtgggctgcagatttctatccagctacaatttcaaaatgttgtgtgtataagaggtgagaccatatattaataatatagtatatatttatatgcaactattgtatgaatgcgctattaaattagctatagatgattctcttagttaacgctatcgaaatttaaaataatgttaggatcgttcgttttatttaaaaaatttatgtaattaaaatatattttattggtagttgtttaatcataaaaatagtttaagcatgatttatatttcatatatttaaaaaataattgaataaaatgaataggcaaacgtgtatttaaaagtcaacagcgttaattattaaaataaaaaacggagggagtatttaggttttatcattattattggattcatgttagaaattacgttcttgtgactgattttgtaaatgtaggcaaaattaaaatacatcaaagcttttttacggtcaaatctttttacatcagaatacaaactatattaatgataagctttgttttctaaaagtcaaaatatgccctatatctttgaacagaaggagtacctccctttacaatatttgcacaagtactgcctatttatgaaatttgaccactcatcttctttataaaatattttataatcaactaaaagcgcagcattagagaagtgtgtttatatcgtaagtattataggttgcaataccctacccgcaccacaaccaacaccccaaagccatcgtccacgacatcgtcgtcctcgccgccgccaccatcatcgacatgcaccacctcgtcgtcctcctcttcctctctgcactcgtttttgtcgtcgatgtcgaccacctccccatcgtcttcgtcgtcatcatatacctcaacctcttctctgtcgtcgttgtgcacatggttaaggcggccaacatcatcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatacatatatatatatatatatatatatatatatatatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacaaaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtataattaggctaaggctgaaaaatataggtactactatcaactttcagaaactaaattttggttacttataaggccacacgacgagagcaagattgtgatcaggaatacccagaagcatgtcaagagtagtatctttattgagaagcaaaagcaagcggcaaaaccattacacactgcttgctgggcaccgtcccatggccgaacgtgaaaaacatagcccaagagagtagtacaatttacagcagcagtagcatatctccctcaattatacactcaccactcatcgtcacagcacaagcactaggtttttggtcatgctaaggaatgaaatttctccagagctagcacctaaaacctttttccgtttcggaggaaatcagctcaggttttctgacgtggcatggttacaacaaggtttcttgcttgtttctgcaagagaaaccagtcatggtcctcatggagttcaccaaatttacaatgacaggcttggaggcgacgagaagatgtcggtgaaggcttttttttactggatgatcattgttcacagttcatggcgcggattgctgatgcgaagagatcaatcttccatcttctctttgctcaagcagtgtttgattctgcaagcttcaatggcccgaggtgcaatggcggctgctcacatgaaaccatcgtcggcattgtccaagcagtgttcaagcaccatgcgtactctaagctgcacaagggacaccttgggatgttagtttaagcacaaaccaaggtttgtaaggttcaagaacatatgccgacaaatgctaaccaactaccagacatgtttgtcatcttgcattatttttgttttattggttttaatcaacatccttatatataaacccatttgaggccatcgagtgcttgtgtgcttagaattttgcaggagtagattttaactatttgttttcctatagagtatttcaatatgtgtaaatttgctaatgtcaaatgcttgttcatagcaaaggtaaaatgacattttctttgcccaatcaagaatatacaatttagtgggcaacatcaggctaggctagataaagctacgaaccgagcaacaaaagtactcatgcatgctaatgtgacaggagcagcaaggatgggtggaccataaatatctaacagcagcaatgaagtaatcatgacgctgattgacaatcgtgtgttttttcaagctcaataaataaaagaacaaagaggtaccttgcaatccaagcagggatcatttatcatgccttttacttgtgaaattaccccagcattttggagtctgacaactcgaacagaagaggcctcacattttggataaatcaagttcagaacacaccacaaggttgcaactctcaattgtttgtccttgctcagcagaaagttaactataaaagattgtttgacacgatctgctcgacgaggtacaagaatattcatcacagcctccttgtttaattcgcccccagctgcaacatttgcaagcacaaacataccctgaagagaggtaacagaaatgccaatgattaactatgataataaatagtatcccgataaagaatgtgaaactaaaattacacggttttgtcagacaagatgttccttttgcccaattttaaataaggtaactcagtataatgtagtttaggaaatactgacctgtatgcatactcctggggcaggtgcattattcagttgtcttgaaatagcatttaaaatcatgccatcttcaccaatgacataattaaaagagttcacatatccatcaacaagattgtgcaccagtgccaaagtttgttcctggacaaaatgttcagaatctgcaagaaatgttgcattagcagtgtggctgattcagcaatgacctaatatcatagctgcacatttagacttaccacatatgaggcttgaaagagtagataaagttagttccttgagaataaagtctttatcctttggattcaaaaggaacataatattcctaagagcccacacagcttttaatctcaatgttggatccatagacttggacaaatgaacaagctgggagacagccccagattgaagaagaatcgatttcctgggtgttaaattcacagcaatattgcaaatagcaccaagggcagcaacctgtaataccattttgtgaacacagacatttagtagatattctacaaagtcccaagggattaaagacctaaaataatgacgtttcacaatcataatatagctaatgtagtgtcccttaagtggaaaggttgctcaaataaaatgagtccatggtaggtatgaacgaccaaaagagtttctcctaagttaacatcttactttttaagtcactaatacagttgattacttagtgatatgtaggtttacaatctaacacgaaaacagttagtacaacatgatgctttagaagaattacagtagagcccatgatgggcagaaagaaggtaaaattgcagagaaatcaggaaaggaggaagctgccatgcttccaagattttcctttcaaaaacccattgaccaaccctctacaaagaaggaaggcaattccaagcagtgtttcaaaatttgttttttgaaaatttcttggacatggacagatagtcgcttactggtcaaatctgaccaagttagaactataactcgacttgattgaattgctcaagacctttttattccaaacaacatataccaccaagtacttgccagatcatgtaaaaaaagaagccctaatctattagaatcatgcgctgtccagcaggagctggccagttccttgtggtttctgaaaccatgctttcaattacagattcattgccccttaaaaatgatactgaaggttgcttcacaattttacattacctgaactgacatagacgagtcatacaaaagctggactagtggggcaataaatgtatcacaggataatttcccagcactaagtacctgaaattaaacatatcaactcaaatcatgtaagatgaacacataacgctgaatatacataaggagtatgtgtcttaccttggatgacctagagatattcttaagacatgaacatgctgcaacacggatatcaacagaagcatgcttcagtgcatcaaggattaaggtagatgcctgttacataattaatttgttagtcacaaatgtttgatcaactgacaatcataaaatccacctttttcatgctactacacgccaggagcccatggagtcagtatattttcttgtcacaagttgcttaacaataacagtagatgaactctacaaaattttactcaaagggcaaagagcagcaatgatcaatataccattcaaagtcctgcacgtacctgaactgacataagttgagatcttgattcttccaattttgagcaaagttcagctaaagcaagcaatatggtcactgcacgccttgactccaacgaatttgctataagatggttgcttaacttctgaactgcgtttgttgagagtgcttgcttctgcagttccacactgtctttgatcaaggttgtcaatgccaatggagcatcatctcctacatgaccaggttcctcgatgagctcaagtaagaccaggatcaacttggttttaatttgtctgtcttgaaagtgacagggagaagcatggctaagcgcaatcaagcacaaacaagcaagtagtcttgtgcgtgggctccgatcatgtattaatgcaactattgagcgcaaagcttttccatggtccagcagtgcaaatcttgaagcaacttcccagttatttcttatgattgcagtcaaagaatctaagcaagcatcccgtagattcatggagcctccaaaatggttaacaagtctctgcggaactccagcagcacatagtgctaattgttctgtagtgctatcacaagagtgagatataatattggcagcaagctctgtgacattttcattctcgctgttcaaaagggtaagaagaaattccatgtttttctcattattgttgacatcaaactttggagctagtttcgattgataaatcattctcagagcacgtgcactagcatcaacaacctgtaatcagaatataacctcgggtcagatcatattattattattattattcatagtatgcattaatggttataaacaattcaatataacatgaaaataatcagaatatcagatagcaccaaaacaccatgtttcaatgaagagggtgcttggatatgaactcttatgcattcatgtattgttacaagttcaactgtacaaactagatgcttaagatagcatttagttattataaatgtttccaaaacagaatgttaaagcgaagcccagaagctagctggttaatccaaagcagcgagtatccctgctttgaataactgtatattgtggcctttcctggttatttatgtccttaatatgaatgtgcaatcttttttcaaatatcaatactagacaagataaggagcaaaataacaactggcaaatcattttttcagataaattggcatcccactatcactgttctaaaaggccccaggcatcaccatactggttagcacctaatatttgtttagcctgactagtcagtgtaggaactagacaccaccctgctgcatgtatatgcctaacgccttttagaacagtgctatagcaaatcttgaaagaattaatgcctgacaactcgacaagagtggttagggaaggatgttagagatgggacaatagagagctaccaaagtagcttgacttgtttcatctctttttcttgtttcaacccatctaccatgttttgccccctttctaattgtcacttctgtaacacaaacagctgccctatgcctcatcatcacttcctccaccttgaagatgcaacaaagggagagactgaagggaggcgacaagcaacatggggaaggaggcagtgggatgtgggatgtggtggtaatagtggctaccttgtttggtcagtaagaattgaatagggagggatggaagaggtagagctataactagtaattggggcataaaggcacaatgagcatatggtttgaggtatgcatggctgtatcttcaaaatactggagctgatctgggagtagctgacaacaatgtaagtatacctccccgaagttgtacattgacttgtcaccatatccttatgcaatatgtacttctataccatgtacttctataccagtaaagttgctaggagatatacctgggtaaccaaattttgagctacaacctatgcaagttacgagttaagtccatgtggattgtgttaggatgatacaactatcttttctagctcatacaaagaaggctttagtgattcaggatattcggtgttatggaagaatcacaagtttgaattgcctcatgactttgtttagtgttaagatttcttccttaaagtttccttcaactgtcaatttcaaatctcaaataaaaagggcacccacatcctacctggcaatcaagaacttccagttacacagcaaaccaataaggatttcagcacaaaatttccctaccaagaaaccattgcacaaaacatcacactactgccaaactcttagttcaagcatatagtatgagctacagttttaccatgacccagaggaagctatttaaacatcttatttcatgcttacatctgtaaagccaattcagttatcagttcagacaaattcatcatgaaactaacacgaaacagacaactttccagcacattcatccccaccactacacctaaccattgacccactaccaaactctgcacatttcaagcataaattgaacaataccttcagtactttaatcaaaaaaattaaaataaaatagagagaaaaggacattaaaaaagaaaaggaaaaagaaatgacaaccaccagtacctctcatcttagctaaaccgacagattagcctatagttcagatcaaataattcccctcattccaagcaaaacccaaaccaccaatcatgatccccctagtacaaatttctttccaaccaattcacaaagcaactatcgaattaccacatttattttcatattcttactcacctctaaaccttatttaccaaacacattgatgacacagtaaaaaaaaatgcattcatggcaaattggactagtaagcaaatactcttcacatcgcaccagtaaatttttctcaccctaaattacaatatcagcagtaaagaaaaatcgttaaccaatctaatcactaattcttcatagtatcaattcagttgccatccaacttttcctgttcccaaattgcaaacataacccaaattctacaccatatgattcccaagaaatcaagcaagaaccagttgcttgctgtctgcttagttccgagcaagtctcctctacgcaacagatcttctcccagacgaataattaatccacaaaaaaggaaaacaaatttctgctaggcgagaacaaaagatttcacgcccgatacaaatcggaaatccatagaagtgagcaagcaagcgaagcaagagaccggctaccttctcgtcggggtgggcgaggagccgcgtcaggtgggccacggccccggcggcgagcacggcccgcacgccgtcgtcgacgccgcacgcgaagctcccaacggcggcggcggcctgcacgagcgcggcgggggaggccccgggccccgcgagcgccgccacgacggcgggcacggcgccgaggcggaggtactggagcttcttggtccggttcccgatgatctggttcttgatctcccgcagcgtgcgcacccggtcgtgcttccccttcttcttcccttctccgccgcctccgccggggccgcgccgcccgcaccgacgggtcggcccccggggggggcggccagcctcgccgtcagcttcttcggcctcgtgcccatgcagtaggacgcggtcggcgacggcggcgaggcctaggccgccgtcttctccggtcgngcaccgtcgttcgccgtggccggcatctggtgggggagggtgggcgaaaggtgtttgatttatttctcctcttttttttttgtattttccgagcgattttttcctctttggttggtatttttatagagggagagattgagaaagaaattggcttgggttggaagccctaagccaatgggataacgccacgtggagtaaatatttcattattttgtactccctccattttacggtttacgacgttttgactttggacaaaatcaaattactctaaatgtaatagtatttttaacctaagataaatatattataaaaatttattcaattatatatttaatgaaactctgctagtgttgtaaatattactatttttttctacaaaattaatcaaacttagagtagtttgaatttgaccaaagtcagaacgtcgtataacctgaaacggagggagtatctctttacaaggaataattaacgttttaaaaactttggctggtaatgattaacaaattagcattagtgtgagctagtgtgtatgtgaagttgttacaggtggttaaataatttgggcagatttagggccaaatattttcctcttatagattataaattattgtgggcacgctttcgaaacttgtaaacgggatgttttttttatgaaaaagatttaaaagtgattagagtatttttaaaacagctttttaagtttgaagtagttcattcatcgttttgtagccctcagatgtcatcagaaaattagaaaatcaaactagaccttattgcagagttttctttttaaagtgttttgtttgttagaatttttctccaaaggcggctgcaatttgtactccttttttgagaaacaaattgagaggtgttgacgtatgcgaatttttatgtatttttctacagtatttttctcagtattgacagctatatgcatgattggatgatgagtctcacatgtggttttaaactcttaatcttcatgctcccattgtctgtatctgcagtcactgtcatcctgacccaagcaaaaacaaactaacctagaaaaattatagcacaacccattttatttgtgaataaataatcctacatgacagattgcacttgatagtgactgcagagaagggaatacttcaaatacacatgggtttttttaagctacatgtaaattttctttacaaaatttctacaaacaacgatatcagtcgtttgatttatttagatggaagttataccaaatctagatgaactcacacatgcctcgtcagagttagtaagaattcagtaaaaaaaaaaacttgtattcatgtaaggctatgtttagttcaaactaaaattggaacgatgtgataaaaaagttagaagtttgtgtgtatacgaaagttttgatgtgatggaaaagataaaagtttaaaaaattattttggaactaaacacggcgtaagtaatccaaattcttgatttcaaggtacagcttcaggtttgatgacaaccatgagcctcctatctatccattttgccaaaagcaagatgtcggcagagaaagggtcccacatggagatgcactgacgctgaaagcctattctactatgtgcctttttctatattagccttgcaatatcaacattttttttcatggaaagatcttgcaagaaatccaggcaaccatgtgtgtgacatgctggactgtttctagtaaacaatgatcatttgatcctgattactggtctgaagaaaatgacagttgaaaaaaaaggccaaaatatcttactgccctgatttatagcgaagggaatcacagacggataaaaggttagtacggtcaattaactattaactaggtatcagtaaaccttggtcataaggcaaaagaaactactgctattaaatagggatcgaaaactattcccattatctgaaaagatggctttagaaaaccgatccgttttcatggaaaccgttagttggttttcataatgtgttgatagaaagtcgtcgtttttttactagttttattggttttcggtaaaccagtaagaacggtttttattttcaaaacaaaaaaaataaatcctagtgagaactgaacaagcaacttataaaagttacttccccttgaactatgcctgaagctgacagctcgatcaactcaaatccttttatcttttttaaaggaaaatggcaggagctctgcctatctcaaatccaaaattcaggtgcaagtctgcaagtacagcggtaatatcattcataatggcttcttgggtcacactaactccaattcatcacatttttgttaactgagttcacattaaggcccagtgtcctcggaaaaaagacggacaaattatttttgcgtgcaggttgcaattgaacaaacaacaaagaacatatttctgaaaaggctgaacttatgcgggcaacaaagttaggtctggtttagttcccaactttttattcaaacttccaactctttcatcacatcgaaacttttctacacacataaacttctaacttttccatcacatcgttccaatttcaattaaacttccaattttaacgagaactaaacacatccttaatgtaagaagcaagtttaacaagaatcatctgtcaccaattcaccatctccatagtcgagactcgacaaagtaatctctgcaggatgcagaaaatcattggaagaacaataacaacagagggaaatatatgacagtgtttcataacagaacaagcaatgcgtatttactttagcttagctcaccttttacctttcaacctttaaattatgtgtttggctttctataaaagccaggcctgaaggcctctgatctaaaaagtacctttaaattatacagaaatatatcatatctcaatgtacgcaatcattcaccaaaagatggtcacgaagaaactagtccaggtgcattggattgatcaacatttgccatatcattcttcagcttcttttggattttctccccaatttcagttgctcttaaaatgtgcaatttttctcagggcgtgtactttttaaatgaatgaaaaagaatgaatttctactcttgaattttcgcaaaaactttctacatatgaatttcttaaaaaatgttttaaatccatttttcaactttataatagttaaaattcatttatttctactcttgaataataatcataaaattattaatttattgagcccttcagctatatgactgtacatatgaccaaacatatggatcaaaattcacacattccatggtacatcaatcatagtatgagcttatactaaaaaagctctacaaaaaatgcctctttatggaagcaatcaagagcctcaccagcctttgcttgagagacaggatgcccaaaaatccagaataatatggattcaatgtaaagctgtctggtagataaccattaaatcatgggattcaatgttgttgtagacatgtgcataatacagcttctggttctaatcgttctttcgctttcatggggaaaaggctgatgaacacatcacacgaattgtagctacctaaaccacacgatgtcaaactgccaatgatgcaaaagaatgaaggatatgtcccaattaatttagtggctgagtgctccatgtagcatactaattgtatactccctctgtactcataaatgaagtcgttttggacagcgacacggtctccaaaacacaattttgacttcttgtttctataaatatatttattgaaaagtgatatatatatacttttatgaaagtatttttcaagacaaatctattcatataatttttacattttcaaactcaataactcgagagttattcatgatttatattttcaaggtttgacttaaacattgtcataaacgattttctttacgagtacggagagaggacatgatttatgattaaagtctgttgaaatcaatcatttggaacatgctattatatgttttttttaacttactcagacttctctgtaatttttttctggttccatcactgacaatgatttatttgctagccagtagggtccggacacgtgtcatattaactggatatgcttatctcggagcatgttgagctgctgaccaggacaaattctttctagtaagctttgtcatcttctttttctcccatctgaatgaaagcgttgtcgcttttggggctttctgcatcatataatgttcacctgcaggtttgctgatctgtaggatttctcattttgtttgtgtctgcttgacaaatgacagccaaaatttattagtgattactccttttgcctcaaaagaaattagtgattgctcttttttttcctacaatgaagtacataatgtctaaaatttcagcatccatgttgtttttgataggtcagcattcatgtgttacctaacgtgaaaaggaaatcatggactgatagtccttgcatgaaagatggcagcattcgtctggaaaacatattcggttcagaaaattcatatgccatatgttagcttatgtccaattgtgaaattttatgcaatcattgggacaccattaaatttcattacgacaaaactttgaccaacaattattctattataacatattttttgtgaagcaaaattgatgtgattggattaattttcaaaagtacttttatatgattatacttttgtgtccataatatattagagaaatgtagggactaacatgggataaacaaaaatattcgaaggattttatacctctgaatgtatggacggagaaaaaaaaaactctgtttttagccccttctcgctgcttggagtctgtttttagccgccgtagtttctctatgcttaagtttttttttcttattttgctttttcttccttcccctagcataagccagtctggttgattgcgtggtgtaactaaaactctttttcttctaatatattaacgtgcaatttttttgcgcgttcgcgaaaaaaaaaccctactatctcagtagattcattactcgaaccagattgtaaactgtgaaattcggttcgatatgaatgaattctgcaaaattacatgaaaacccattcatctatgggccttctgttgctctcttcaacaactgtatgggcccaagcccaaaactgcccatgggctacaaacgaaggcccaatttggcctatacgatccacacctgaagcaacaagaaccagaggagacgacggtggcggcggctggggagagagaggagaggagaggagagagaggggaggagaggtagaggaggcgagagctcgatggcgtcgtcgctggggaggctcaaatcctccatctttgacaaggaggagaggaagatgtatttgcttttctgcccaatccccgtcccatctcattctgttcctgcaccaaagtttccccctttctttcggatttgtgtgtggcacgaatcgattagaaacctttgttttttctagcttcacatttcttgacgctgatgctgtcaaagtgtgattttgaaggggtatttctgtgctccgttatgtgttgggggtcagtgcgaataggggaagtgatgatgtcgatgaaccctaactttgttggttgcaatctttgcttcgagataggagttaagttaggctgatttgccactcaagggcaatggaatattagatagatgcactgctttttgttagttcgctcgctttatttttcatctgatggatatggattggttgtggatgcaggcaataccaatcgcacattcgggggcttaatgcgtatgatcgacacaagaagttcatgaaggattatggtatgattctttgctggcttcttttccacctcttaagcatttcttgattgttttaaaattttattgggagatctagggctactttcagttcagatttcattggaacaaaatataatgatagtggaatggtaatgtcatgataatatattacagttaatagcactgttttaggaaaatggcacattttaaagttttgcttctgcctttcttcacaatagtcagacaaatggtggttagcttgcactccgatattctggcacaactcccgttatcccagttcaatttgatttttgattcctgatgccaatgcatggaacggatggatcagaaagttgtcctttcacagtgtaaaggaaattgagacgctggcatataacgagttaattatttgctctgtctcagtttccaaaagcaactggatgacgaacagtcccctctactgtagaaagaattgggggctaccttcatccatacatgggctatgcttattgatatataacttcccacctagctttggatgaaacttattctgggtatgcatcttttccatatgggagttgatggtctgatatgccataccagtgacccaatctgttgaacaatgctgtcattgactagcagttcatcttccaactatactatgaatattatagatcagtttaaaatcattataaaagtcaagtgacttggattctattgcttgtgttagtaaagtacaaggaagcttttgttttagatatgtaagtggaaactactatgataaatgaagaaccagaatgtagcctcaccacagcatcctttatcgtggatgtataaataattgtggattggagatcatgttcatgtttacaaaattattgtttcattgattggctctggcattttattggtatctccctcttttcttgatattataagttcccactgaaaaaacaatgtgctgtgaacagttcagttttatggccatgacaagaatgtggataatcgtgcacccatcaagactgataaagatacactgcgagaaggatataggtaagaaacaagtccaataccctttgttatttatttatggtggaatgtgtgtccatgctttatgaaatactcctaaatccttttctttaattatttatccatataaaggttcatactttctgaggaagacgatgtggattctacttgggagaagaggctggtcaaacgttactatgacaagctttttaaagagtatcctttttggtggtgtgttccttacattcttttcattaagggtacagtgtatatttcttcagaaattttctgtaacatgttctgatttgtggagctgaggtgatttggcaagttcatcccattttattctgagcaatactgcaaatgtattgaagactgaagagcttgatataatagactaattgggtatgaactgtagatattatctcacaaactcattagcgtgtctgaaaagataagagttgcagtataaattgtaagatactatgagtgaaattttctcatcaaagaggtagacataacgcatatgtatatggttattctcataggcataactcgtatttactgttgtccgctgcatcagtatatgtctttgagagaatattgcaagttcgttccaaacaaatatagtgcttaacgggttatttcctaagagaaactatttacatgatatgcataaagtttcttgtatttatgccttaaatagttgggccaatattatctgtcagtcagtctcctatagaaacagcatgttttgaagttctgtagtacctattttagaagatgggaacatgaaggatgagagagaaccaggattgctatgtttgatttgaagcacttaagttctgctcctatctttataatctatctatattaaccaagagatgtagtccttgcaccttgaacttgttttgctggctgttttactgttcttgtaatgttcttgaaacttaaatttattgtgcctaggatccttaatttgatacagatactgcattgctgatatgtcccagtacaaaagaggcaaggtatggtgatacaattctatagcaataagccaatagttgttacagtatttatttgtgtcatttactggatacaatgatctcttgaatgatattcttgctgttttttctcctcattgctattaatgcaatagaaaagacgaaaaatgctcctagtatgatttatatctgtaacattgaggatttcaattaaaagaaagaaaagaataatacgaattgttgatttcgtatccgtaatattaagtttgcgtgagcagcatcgacaaagtgatcattcttgtttttggtcatggagttgcattatagtatcaattattgttgcacagagcagcaaaatcactagcacaaccatacttttatatatgttaatgtctgacaggcacacacttgatagtggggacgctaagaaatcctatttacttggttcgttactgaataatatctaagtatcctttagaatttagaacagcactaacaaggatatgctgctcatagatattagaggttttttttaattgataaaaccatcggttttattcttggaagttgagtgcacattctaaggatctcatttatttcagattggattgagatggagaactgaaaaggaggtgatatctggaaaaggtatttccctttataattccatgtgttttcaggtgcactaaactgtcgcaaaatgctaaatgtagtctatacattttttttttcaaatgtgtgctctgttttactaattttcttattggtagatgtgatattcattacatgttgtcttttgcagggcagtttctctgtggcaacaggatttgtgatgagaaaaatggacttggtagttatgaggtatgctcttggtcctttctatcttgtcactgatgctacaatgcatagatccttttgttcattaaagaactccttttctgctatagataactctcccccttgttttcaggtgaacttttcttatattgaagcaggggagcagaaacaagcactagtgaaactggtagcttgccagaggttagttaatccactacttcattttgggattatgtaacccagttgatccactatttcttttcttgtatttatcttgctgatcttggtattcatacattttgcatcccaactattttgctctggcccatcctctctctagtcttctcttgccatttttgttcaaccaaatattcaattgattattgattgttgtacattatgaaagatgtgcagaaaagcttgcttataagaggcaaaaggagaaggaaagagagaaggaaaaagagatttctcgtgaaaaggaaatggagttaaaagaaagggacaagaggaaaaggtacctcttttccccaatagttctttttcctaactttcttggacatttctgttcaaaccttttaccccaggatttttgttacctgactttcttttacatttctgttgaaactgtagagaacgtgagggaagtgaagaaactgaagatacatcggaggatgaatcaactgagaaatatagtagaagaaaaaaaggtaaaaatgattgcattattacctggaacagtggatcttttttcgtgtttatgaagtcaaacactaccagtatgtagtagtttactttattttcgtcggaatttaaactgtcaaaacttttgtatattattaacaagaaaaattattctatgcaaaatcctgcagatcgcaaacgatcatcaagaaaatcgagcaacaatgatgaaggcttcgaggagttccttgaaggcatgttcccttgatctggcctttatgtcaaaatcatcatcagaaggggaagcggcacctgtttaatcttccatgacatgttaatactgaacgtgattaattgtaactttgtatatgatggtgtattactgctagttgttccatttctagcctctaggtctcttgtgagttctgagatgtgagaactgccaggtgttgtctaactaatgaatttgtcaccacctgctcttaatctgtgatagcttgaagcaccttgaatgttatttatatgtggatattgtgtgttataaatatgcaaatatcagagtattaactagtttttttttcttatgcatggtaccgcccctttgtaagataatcctggcttaaccaaataatgtcagaggcattttgttacacaggtgaccaacctattgtgttcaggttaataatgttgctgatgcctcacaatatagctgggaatttcagaggagcaaattgatagtttctaaattgctacctaaatcattcttattctcatgcatttctgaagatacagtagcttgagaatttcacaagttacacttcacaagcattaaattcatgagttcccatttactattcctctcttctaaccacatccacaatgagaaatctagttcaattttaaaaataatctccagttgcagaaacagatcaacaggttgatcatgaaatctctgcttctgatcaccagttcaccactgtttttgtcttgaccaatgttttaagatcagcggtggaaaattggccttcccttaaatcgctgaactaatgtaaaactaatcttccatgacgactattcgtttgccctcgtgcagctgtttttcacacaataataagtcacaagtgttgaaagaaacaacttcatatcgtgccaattcaactcaagaggatatgtattaataactgaacatgagttcattcacttgaacatcaaaaagaaatagcaaggataactaattgtttatttaatctatcaaagctagttcaattgctttaagaatagctcaatgaaaatcagaaacatggctttccatgaacagagcactgatgacatacctgatggttctttaaaattggggcaatattcaacaataatgtcgctacatgttaggccttcaggaatggagtgcagaattggacagccagacaaacacattatctgtagaaaaggtaggttctccaaccattctggcaaaatctccaatttgttgcagttatcaattttcaagctggcgagagaggaaagatgctgcaaaccctgtgggaggcatgacaattcatgacaaccacatatctccaacttcttgaggcgatcaagagcctgtagaccctcacagcctgaagaagcatgcaactcttcacagaaagaaattgaaagattttcgaggctcttctctacacctctcagaccttccttcgagctgtacaacatcttattattcatccacaaaatcaatttttcaatcgatggaaactccatatgcagtgctctcaattttgggcactgaatgatgacaagttctgcaagacgaggaaacagattcatcctagatgactgttcccagacttcaaggctagtcatgaatgagagaatcagcttctccaatgaaggaaatgtaccgttctgaccatagaaattatcgtcaatacaactgatattctcaactcggcttatctccacttcctcgcaaaaaaaaaaaaactcggcttatctccacaatcttcagacatggcagtagcccaagtggaggtaaagcattttcacatgatctcagattaaccaaccttatctcaaccagagatgtgagatatggctcagtgcttgttatccaagatggaaatgcatgtccttcatacgcaacaatctccaaagttttcaggcactggttaggttggagggtttcaagtacttcatgatctattctactggcatttccagcatccatattccacctcaacatcaatgtctcgagcttttctttctcttgaagttttgccattcttgcatcttcagtgtctgaaaccttttcaaggttcactagtgataggctgtgtttagttcagcgcaaagtttgaaaaatgactaaaattagagatgatgtgactgaaaagttgtgtgtgtatgacacgttgatgtgatggaaaaggacggaagtttagatccaaactttggatctaaatacagccatagtctattgaggtctagcagtgattgaagctctgacattgcactactaccaatgttggggacaaagtaaccaagcaatgtgtgaagatgtgtaagttggcccatagcatgaggcattgctgtgagtgagtagcaattgagaacatttaggtactgaagctccttcattttactcttctttgtaggcaacgtgacaagatagtgacatccttcaaggtctagcttatgtaattgcacaagcttacatatgttctcatgcagtttccgtatcttttaacctaggtggggatttggcatttgttgttctaggtatatctaatcttgattaggttggtttttatgggacggtgggagtagaagatgaggcctggagtgtggtacttaatgtaagtggcggttgggaactcattgtctacgcacggaaaatagaacggtccattatcacgtgattaagtaagttttagctatttttttttcaaaaatggatcactatgatttttttaagaaactttcgtatagaaactttttacaaaaaatacactgtttagcagtttgaaaagcgtgcgcacggaaaacgagagaggagagttgtgaactccctcttacgaacagagccttaatgtagactagtagagatggaaaagacagtaagggtgtgtttagttcacgctaaaattgaaagtttgattgaaattggaacgatatgatggaaaagttggaagtttgtgtgtgtaggaaagttttgatgtgatggaaaagttagaagttcgaagaaaaagtttagaaccaaactcggcctaaggtgtcaaataaaaaagaacggagccttaatgtgaactagtagagatggaaaagatagtatggcgtcaaataacaaacagagagagcatttaatgtagactagtggtactcgtaccctagagatctaggttccattctttagagatctaggttccatttttttctaagggtgtgtttagttcacgtcaaaattgaaagttttgttgaaattagaacgatataacggaaaagttggaagtttgtgtgtgtaggaaagttttgatgtgatggaaaagttggaagtttgaagaaaaatttgtaactaaactcggcctaattaagatacaaaatttgcttcagttttcattagcacacatttcaaactgctaaatagttttttttttcaaaaactttctatgcaggagttgctttagaatattaaataaatccatcttttatgtttcaaataattaaaactgaattaactatgtgctattacctttcttgttttgtgtgtctgctcttaatcttaatcttgagtagactcaaacgctggtctcttatgagttctaagaagttgagaatcggcaatgctatttgcgttgcaccatggaatactccttccattctttaataaacaaatatataatggttttctagatttgttatactaatttaaataacatataatcctaaatttgtttttttaaacgcatagatcgtacgtttcacggatataattctaattttttttaaacgcatagatcgtacatttcacgggatgtcgctatagtatatctgcaggactgcgaggaccacgtcctattttaggagagaaacgcacaccaacccagatctacgacatactatagtcgtgcggccagccgcactactggagcccggcaatgagacaacgattagctggcaaagcaagttggccagtggcaatgagacaacgattagctggcaaagcaagttggccagtggtttctttttttaaaaaaaaaataattaaaggttagtcgacagaacttgctccgtcctaagataaataaacatacaccgtgtttagttcaaaagtttttccttcaaatttctaacttttccattacatcaaaactttcctacacatacaaactttcaacttttccatcacatcgttcaaatttcaactaaacttcaaattttggtgtgcactaaatacagccatagtactgaatttagcatattctatcattatgaatctagatggatttatttatttagagcaaatttaatagtagagctcactataagttataaatttattgtagagctaacatatatgatatgctacctataagattaactctattttttctctgctctctctttccctcactatgcattttcgtaaagaatgtgtacagctagttcctccatttcattgatcattatataaccaaaaattggatattctaaattgatcatcatatgaccatggtctactcatttgacgtgcaacattattgtatctatgcatgcaaatttagtatgcgcgcatgtatgcatatagacatttagaagtagttaaacccttgtttcttgtgcaaatggggagttaaaagtatgcatgtttcttaattcttccccaccacatactcatgtattaaataaaatacatggcagtttaagttttttttctgccttggtaagaaagcttactgtgtgtttggttcccggtcaaggttggatggaatatggcggtccatactttattggatatggcaatccggtttttttgtttggtggagtgaatatggcgatccaattggttgtaaggatgaatgtggatttggtgatccattttttttagttgggggagtaggatggatgagtggttgcaatcaccctttcattagtagtggtaagtatacccccttgaaattcaatgaacccaaaataataccaatctactaaaaaaatctaaatagaaactaaaaattagaatgaaataaaaggaggaaaggagaaaaacggaaaaaaaaataaaaaaaaatgtcctcttcgtcggccgcccctcgcctcctctctcaccgccgccgccctgcctcctctctcgccggctgctgtcctgtctcctctagatttggtcatcctcgtcgtcatcatcattgtctcctacccaaccggtcgtcggcacaccccatctcctccagatccagttgtcatcgtcctggtcatcgtcgtcatcggcagcggcaacgacgcaccctcttctagctgccgccgcctctggctctcgggctcgctgccgcctcttgcctttgggctcgccgcagcttccttctttccacgctgaccgccgagctcgcatggtgagaggggtgacacgacctacgatactcactcgccccgctcgcctgggtacttgggtggctgcatctgggcaaatcggccggatccctccatctggcatctgggaggaaaattcccctccgtgccgtcctatcccactcccgcccaccaactaaacaaccacaaaaaatgggccgccatgtcctatccacccaaatacctccatccgaacacacccttatatatgatgatcaatatggaacggaggtagtacatgagaaccaacacttctcaatttttgttatctcttttccatataaatatatatatattgtctgtaacttatactcctcctattccagtttgatcatcagctaagatttttgagatctttccaaaatgatcatcatttaacaaatatatctttatttatttatataaagagtaaattagcatcattgaatgcgctgcatacaactaaccaagattaattactattggtggtacaactacatgcaatattaaaaatttaatgcaatccatgggatacattactagtgtagtatcttaaccgatgtgaattaattacataatgatttagttgtttttgatctctgtgttttttcttagggcaggtacaatagcaggctataaaccagctgcaaacatattttaagaagataaatgaggagagagaagggtagcgggctacagatttgtagccagctgtagcacggactccaagacgcagtgtgtatgataggtgggactaggtattaatagtgtagtatataactattgtatgaatgaactattagattgggtatagatgaattggaggccggagtgggctacactattaa

SEQ ID NO: 73746 - DNA, 2575 bp, Oryza sativa
ttaaattaaaatttaaatgaagaaagtcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatctgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatggctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggattagagatggacgaagtcgggggtggatggacatctctaggacaaatgaaggctacacgggctgcggttcggtagtcgagatgtcatggcacagggcggtgtcctgctgctaggggctcagtcctgcctacctgtcccgggagtttcggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttagcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactgagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaatcggctcggtcttgattcaggagcttgaggggaaggaaagagttgtgttttatttgagccgtcggcttttggaggcagagacaaggtattctcctgtggaaaagttgtgtttgtgcttatatttctcttgcataaggttaaggcattatctattgtccaatgaatgcactgtaatatgcaaagccgatgtggtcaagtacatgttatcagctccgattctgaaaggaaggattggaaagtggatatttgctttgatggaatttgatcttcggtatgagtcaccgaaggcggttaaggcacaagctatagccgattttattgttgatcatcgtgatgactcaatcggctctgtcgaaattgtgccttggactttgttttttgatggatcagtgtgcactcattggtgtggtatcggcttggttataatttctcctcgggaggcaagttttgagtttgcctatactatcaagccctatgcaactaataatcaggctgagtatgaagcggttctcaagggcttgcaattgctcaaggaggttgaagccaatgctgctgaaattatgggtgattccttgctgttgaaattatgggtgattcaattagtagcagaatatgagtgcaaaaatgatatattaatggtttacagtgagaagtgtcgagagttgatggatggatttcggctggtaactttgaagcatgtatctcgagaacaaaatgtcgcagctaatgatttggctcaaggggcatcggaatataagccgatgatgaaggatgtcaaagtagaagttgccacaataatagccgatgattggagatatgatgtttttcgatatttgcagaat

SEQ ID NO: 73747 - DNA, 676 bp, Oryza sativa
ggccccactcccgtggacccggtccgcgcgccctctcccctcggctgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagctgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactctactcatggtaccactagtatgattttaggtagatgcttcgctgtttaattaggtaacattaggtgattttacaactctagactttgggatgttcatatcacctggacactatggaatggt

SEQ ID NO: 73748 - DNA, 2145 bp, Oryza sativa
accagatccgcataaatcggaataaataaataaagaaaatgaaaactaggatttatgatgcactggtaaataggtgatgaaatgcaatggtaaaaagggactgtccaggcatcactatggtgaattttttttttagttacactcaaatttcttgccgtacgatggagaaacgtgcacgatctccctatcccgaacgagaccctccccgatcgcctcctgcacagtgcgtgcggaactataagtttgtaacccatcattattgcgtgctcgttttgttttgagaaaaagccccgtagatttgcaggttcgatttactgagcccagattgcattggcccacattgcaggaacaaactggacctagatttgtagggaaataagttcacttggactcccatagctagtgaccgaatctgattcgtatctctgaaccacaataccggatatctcgatcactcaattatcaaaacaggtgcaatttgactccctcgacggttttggaacgcagtttcactgatgtgccatctacgtggcggtgttgacttggttttcatcatacgtggcgcttaggtggtattagaattaaaaaatatatgtggaacctatttttcattcaaaaaaagtattgtgggacccacatatcccatatgtcagcctcgctctttaaccccccctctctctctctctctcttccccttgagccgtggcgacaacagagtggtggcggcgggcactggagcggtggcggcggttggcgggcgagggaattgcagcagcgagcggtggcctgcttatcgtcgtgccattggactgaaagggggccgccaatgcccatcaaggtcctcgtgaccttgatgagaataagaagaagccccctcccggtgccgctgccgccgccggcagccccttcgctactccatcgaccatcggctgacccctttgcttacaaaactaacaaaactaggtataggtggtagctctgaagtaagcactgttagctaacaaaactaatctccatcgactgaaatctgctaggtactaacaaaactataaaaaagtaggaattttacaaacaaaactataaaaaactactaatctctattgactgaagttttgtaggcacaaacaaaactaaaaaaaggtaggaattttgcaaacaaaactaaaaaaatactaatctatattgactgaaatttgttaggtactaacagaacttaaaaaatgtagtacaaaactagtactatgtattcattggtgaggcccctcctccccttcctctctctcccgcgccgcttagccgccgcgccgtcgcctagccactcagccgccgctagcgccgcccgcgtcgccgccgatctccgccgccggtcggtcgccgccttgcgccgccgctgcgtcgagccgcgccgccgcgcaccatggccgccgggccggcttgagccaggcccgtgcgcgccgactgcgtgccgccccctccgccgtccgattcaccccgagtggatcggggctgcccgttccgccgccagcgtggtcacctgcgtggctgctgcgtcggtgccacatcggcgccacgtgtgtgccacgtggtgcacctcctttccccgggccgtggacccgatgcaccatgagctggcgcccaaagccactgccatgtggggcccgcatgtcggcaccacccgtctctccctccagggtttaataattgcacaataaatcaattaaggatttttctgtttatagtaaaaacacagtgaatcttctaaaattcatagaaaattcatccgagctccgtttaagcccattcaaggctcagtaaatcaagaaaaatacaaagaatccgttaaaaatggttttgttctctgtttcagtagccttatagcctgtctgcattgtttgccttgtatgtcgtgtagaatccggctctcccgacgctccggtgtacttcgaagttgtagccgaggtcccttcaacagcggagcaaggcaagtcatgcttgtcacttggacatgttgatcgtatattgcaaatgccctattgttttcctttaaatactgcattattttacaatgctaccatgagatgattacctactgtctcagccatactatttgttaccttgttcctttgttagcttggggatataaca

SEQ ID NO: 73749 - DNA, 5195 bp, Oryza sativa
aggcggaggcatggacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccactcggcggcgacggaggcaggtcggcggtgaagtcgtagacgcccaacagcagcggcataataggctagccgtgtaggcggaggcaccaatcggcggcgacgaaggcaggccggcggtgaagtcgtagacgcccaacagcggcggcataatatgccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaataaatacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaagggggtagcgcacgagatctaaaagtggatggatgcagagacaaaggatttagacaggttcaggccctctcaatgagaggtaataccctactcctgtttggggatttgaatccgccgggtgtagtatagatctgacgatcaggttgtctcatatgccccctagagggcctcctgcccaccttatataggatggggggcaggattacaagatagaaaccttaaccaatacggtatcggtttcctaaatctactttacaatattaccaaaccaggactttaggctgttccgtaatatataaggaaacgtaatacccgagccatgatctgttacatattccatagatataagttatcccctatgactagtcggataaccatgccgtatgggtatggggtacccataatatccacaccggtggagctggtttaagtattgttgctgccgatttcttcctcacagcagtcttctttttctgcaaaagtgagatttataagtgatcggctatgaatgaaataactgcaaaaggaaattagtatgagtggtttacccttgagaaatgagctagggtagcaggagttgggggagtttgcttgggtgaagccgatggtgttttttctgtatcacttactttggctgcagcttgatcgacatcttcttcgatctcttcttcatccagggcttgctcgatggatggatctaaagcaggcaagtcatcggctggcttaggtttgttcttcttggtcttcttcttgggagccagagctgattggtcaatagccaatgccttggcctttctcttcctgccaacatcggccggttctctcatctgtcgttgaagcagacttgaggtcttaggggcatggtagccgatgacaggaggagctaatccacctccgtttggtagaaggcatggagcatattctatgtccctgccgctattgctcttgcgaggaggagaagattctgttgtctgcaaggtaaagagagaagttagtcaagattcaagtcagctaataattattcaaacaaaattggcaaaataaagatgtacctgagggacaacatcaggaaataggtctgtcatgtacatagaagccgactgatggaatatatgttgcttccattcgccccaccatttgtcaaaattcctactcctgagtcttgccaactctatgttctcgatgctgcccagagggggtgatgtgcactagggttcccgatcttcctaaaggtcctgataaacaacggtttggacggagtcgcgacacagatcgacccggcttcttgaacgcgcacgctcttgagccccgcaatcgcagcaccacgtctcctctggttatcacccgtgtcgaaacgtggatgacctcgccgagaaggctaatccctgtttgccaatcgaagaacacaaacaagaacgggatagaaaaacaaccaaaattgcatatgaatgattaagctcacgagttggggtcttacaaaccgatctagcggcgaaactgttctcgacagattaatctaagcaaaacccaaaaacctaaagatgttggtgggtactgatatatagagtttaggtcgtgtaaacccctctcgacgcaaccctaatgggttccaacacgatacacgggccaaaggcccaaatacggtgacgcagcaccaggacagattctggacgtcaaattgttcggacaattcccgttgactcggaaagaatttggatgtggaaccaaaaccattggaaaggttttcttcttagctttccatccatataaagaacgccctaatccgagcacgtatgtgacctgggcgcccattttagtgtagactggtcctggactccgaattgcacccgacgtcgagttggtttgggcctccaccttgacttggacgtccccgatggtcctccatggctctaagtatttctccaagtgtctccttgtcccctccattgttcctaagcacaatataatcattaggtagcaagctattcttgaattcatacaaagaagaacataggaatgaactcacctctaaatttaattgtcgcgcacgagctcttgttatcgggccttgaatgaccattggaggattgttgtgtgtatctgaggtagtgatgtccgcatcagggggtcctgggatattgagtagccgatccatcatcagtgtggatgagatctcctcgcttcattggattttatcggcaaagaataagccgattggcgtctatcccattccaaactgtctagcatgggcaccaaacttgtatgtttcttccttgatggatgccgacaggaaggatgcatggactaatagcagccgagaagacttatctggacttgtcaaatttttcggaattgatatcctcaaatctgaagtctgctgggatacccaaatttacttaatcttcgtatgggaaccaaactcgagcatctctctggaagccttcataaaagctacagaaccaatccttgagcaattcagccgataactttgctccagcatcggctggtgtggatgcatattccccataggacatacacctgcggtgggtgcgctcttctccatcatcattggtaatcggctttaatcttggaaactcagcttctgtcatagctggccgattgacagctttcatggctaccaggtttagccaggtttgcagcaaccaccatggcccgcctacactaacagctgagcagacaacaattttagccgatgcattgttcagcatttgatacaagtagccgaggaggatcttgcctaaaggaaattgcctctttgattctaaggcttcagctaaaaactgccagttggttgtggggccgcaacttgatccacaaaaaaggaatttctcaagccacatcagcagaaaggccacttgttctcgggaggtggcagttcctttgcccatatatgctgctacataatcagaccagccacatatgctcttagttctgaagtcaaactggttcttggtgttcaagctcatgaggttagccgacgaggtcatatccaaaccgatgatcatggtgatgccaagcaaaatggggttcatcggcccttggttgaacaggaaagcattaatggtgttggaccaaaaataggtggcagcggccatcaggggttcatctttagctgaatttgctatggtaaggccaagtgcctggccgatgccgatttcgtcccaattgccctgcttgctacccgataccagtttatgccacacagaccaacttttctccgtagtggttttctcaagagaaggccaagacataaaggtgtttttccagtgacctagatttgggttggccaatctaaaagggatcctattggtttcagcgatgatgaactcggtgggatcaagattgccgatcggaccaaggaaataatggtgctcatgtgacagactcgggatcgtgtccagattggacaagtgctacagatgtaaacaagaatagagaagaagaaaataagatgaggcaaggaagaaccaatctattgcgaaagaagaggatctagccgatgggtacttaactctgcgtatttttccgatggcgcgacggatggactggcggaggacgacatctttgcgagcggatgcttggccggagaggaaatcatcttagggtcgtctggtgcacccaggggatcgccggagagagagaggacgaagttggcttaagcggtgaaaaaggagctaatggtgtgaaatttctcggggacgacggttagtatttaaagcagcgcgataacggtcggaaaaacggaagtgcgatattctctcggagatgagatatggcaaatccgaaacattaccaaatattccggacttggggtcatgtgttaacgaccaaatttggtaatccaagtatcagagatgaagataggatcgaagcggaattcaagatagaaattaatctagaaacagagtgaggatcggctaaagttcgaatcggctatgacaaggatcggcagaattcgagtcggactaggttggctgattcagccgataccgacaatgtgacgtggtacatgttgtcgggttgagttaatatgcttcatgaggattgccgtgcatggattgaatcctgagaaggcaattgtatctattaattaggatatttcatgtaatttccttagagatatgttcgggcaaaagtctgccgaaaaggattatggtatctttgtcgacgggtggcacccgtagaccggatatagacggtattggggtatgttggtac

SEQ ID NO: 73750 - DNA, 5489 bp, Oryza sativa
ccaatggtgggttgtgggtgcatggttttgctggttcgcgggacgccctggaagaacttatcgtacttaccacaagccaacgtgggcaacggctgggcttgtagtgtagctttcctctagccgacgctcccaggcaagggtgggcatgatggagcggggtgggccctgcgacggcttctgtcgcttccggattcacctaggcacgagaggggactgcccgttgcccgctggggacaagggtgaaacctgaggtgtggtgtgcttggctagagggggttatgcgaagggtcctgtcatggcctctttccggtatgtcgtggtggcatgtcggcgcacggaaacgtgtcatggggctgtgtcttgtgggtacagttgtacacctctgatcagattcacctctgtgtcttatgggcggtcaacctgattcaccgtgattagtctcagcctagcttagtctaatggaattgaatagttcaggtggttggttgggcctgttgcaacgtggtgtagtgttggacagtggatggttaatattgattaattactacaactgttttactattttcaactactgtttataaatgctagctttatgcaaatgatcccctttagccttcctttggttatatattgcatcatatcctccgttctggtatgacttgttgagtacagtggatagtactcagtcttgctctatctcccaaccctcaaagttcgtgtgtgcgtccgatggtggtttctctgaggagtgggcttcgtccgtgccatcgaggatgcctgtggggtggtgttccggcgacaatccaagtcaaggcttagctcctgttatctttaattttccgttgcattcatgtaagacttttataatgtttgtaagacgtggatctgtaagacagggattttaatgtacattctgcttagaattctattcgggaatttctgggcatgacaagggtcttgtatttatacccacagatgtccccttgtccaattagaaccaagtagacaaatatggatacgatccgagtagtccttgtagtttccaacttgaactttgctcctccctccttatccaaaacaccttccgtatatgaggcatgattccgtataagatttagtatattagaccgagcccaacccaagatcgtggggtatgccttatccataacactgacaagtatctttataagttgatgtgcatattgggatgctaccatgaacttggctaaggctgtccttccaagaaaagcgttgtatgtcgtgttgaaatcggccacatcgaaagtaatcttctcggtacggaagttactggcagagttatcttccctagcagttttgaagacgattcaggtgtgatcttgtggaagggttgttcagaaggctttagctcgcttctggggattcccattacgtcgagggcaccggtgaagagaaggttgattaagctgcccccgtcaattaagacacgtggaactttaatatttctaattgtgggctcaaccactataggatatcatacaggagtagtcttcatggtggggtgatcatcatctgaatttaatcttttgatctgaccaccgtagtttgacatttggcccctaggatatcaaacagacttcacgtttcacctttttgcattctcttttcgaagagtaaggagtgcaaccactgaagatatgagcaacgtggtgaaaggggtctagaaagttagcatcgtcctcggactatggatggctatcctccctctcaacaaacatactcgttggtctcgtgtgagcgccatctattttgccatcgccttctgaaaaacagagtagccagccaaagagtgagaacatgtcttgtttattgggcaccacttttttcctgaagcttcaccttgaatttcaaatcagcactgctgttgggggctcttggtcaatgacgagaacttcggcctcagccttgttctttttgttcctcttgaaggactgcttcgtcttcttgctagttccaggttcttccttctttgctggcaccttgtcatcggacactttctcattgccatcgtttcgtcggagagcttcgtcagcgtcagcacatctgtcaacgatctcgaatagattcataacagaatttattctctttgttgccagctctcttgtatgatataacgatctccgactctagatttgaatgccctgatgacagaagtgtctgtgatgtcagggatagtattacggtattcattgaatcaccgtataaaatccctgagaggttcacctttttttgtctcgtagcatgtagatcgtccttgacctcatgtcttttgtacataccttggaaatttatgacgaattgctttcagagatcgctccatgatccaatagacgacttgagaaggtgtataagccatgagcgggcataacctttcagcacagtcggcaagtaatttcccaacgtgctatcatctatgccagctccgtagaggacggttgaatagacatgaagtaactcctcaggatcggtgttaccgtcatacttctcaacgggtccggaagtttgtgggccatcggacttcccatagataaggcttgaaagctctgtagccacctccaggttagaaatctaatcgacgatcatcatctcgagaacatctccgtggatgtctacttgatgaacatgatgatgaagaagatggatcgctgggatcgggatcccggtgattattgccttcattacgtcgtgggggtgaccgggggtctcttcatccccggttctctcggcggttgcaatttttatggtaactggatgataccccgcgcgttgccgctggaattgaaggggaatcgaagtcaaatttctctaggttaatataaagatcagtatatttgtaaaacgtaacagtaaccaagagagaaagtactaagatatgaagagaatttggagctgtatttgcatggtgatacattagattaagtcatcaagttagttaaatggggaatatccatataacatttattcataaaatgtatatgtaatcgttgcattgtgctgtctggcaaaagtgaagtgatgcaatccaagtcagacatgcacgaagacctcttttatcttaattaatttgctcattatctttttgttgggcagtgtactgcacactgtagagcgtagacgctgagttcaggtatcaaattatcaatgcaagtttcttttaacttaattataagaaaaaaaatgactattgggactaatgaatctcagaacagcgtatgatcgagtagacaacaaagctcctctagcattcttatcatgcacaattagataggaaaaatattgactaatgattatgatcagaatcatatccaacaccaagtaacatttctaattcagaaaataggacagcaaaattttaatggcacgctgttagtagcaatacgtgaactaaaaacagccatagcttaggctgtatagaccctcacaaggtgtagaggccgggtttattataatccattatctaaaaaaacagccatagcccatagctaatgcagaataacggtcctagtaaagaatagatgcaaaattgaatttaccgagaaacgttaagtataaaattaatctagaaaaaaaaggcaaaatcaatcgaaagattaaatccatagcaaatgaagatgcgccaaaactttcagcatccacctaaggactcatttaaatctagcggacataacacacaacacacacatcacatgatagcgaaaatagtaagcgcacctgaggttctgcttgctagagagattagttgccatgcgtacgaatgacctcgctcactctgtggtatctagcgaagtgcaagactccagccgccgccggatgacggcagactcctctccttgcagtgaacctccgatcctacaaccgccggatgcatgtctgggatctggattttggaggcactgcggcacaggcatggcgattgcaggcacacatgcaatgaggatgaatccgactcgtagagatcgatggaatcatatagtaatcacgtagaagagtgcgaattaattaaggatattaattatccgacgctacatctacgtaactggtgaaagttgggaaaaagtgtattgctgttcggatgcatgagttacgcaggatgaagagatgaagcgacgcaacggcgaggcaccaccactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgaccttttttttttttttgcatggccctgttgctgcatggtttatatatatatatatatataaaccatgcatatatatgtttcaatacatatatatgcatacatatatatatgtatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagataaggaccggtgaattgtgtttccgtcgtagtagaattcacccttgggatcaaggatttcttcgttgatgaatcccatgagttgttcttgaaccgctgcgataaatttcttgtgtgtgatcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatactatacagttgtatgtattaatttgaatcggagaaatataaatgtagagcatgtgtactcacaggaaatttgaacttccgcctaagtctttctctccatttgccgcggaccaaatgacggaaccgataccaagcccaacatggagtttaaagctatgattcgtagtagcaattaacataacaagattttcttaattaacagaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttaggaagttcgtacgggaatgaaatttggtatgtaggaagacagtaaaat

SEQ ID NO: 73751 - DNA, 683 bp, Oryza sativa
aagccttacccactagacatgtggaagtacggtagtgctttgcaacaggggcccgaagaccggtccttatgtggccgaggtgctactaacaaaaccatgcaccccgagcccagcctaaaaccattttgagggttttgaatagagggggaggtgtgcatccaattccacaataatccaaccattccatagtgtccaagtgatatgaatattcccaaagtctagagttataaaaccacctaatgttgcctagttaatcagcgaagcatctacctaaattcatactagtggaaccatgaatagagtacccactagttggggttttatttattctagggtgaacaaggtaataataacaatagcaataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgagaaccttccggaacgacagaagctacgcgaagcacacaagcaaagctaaaccctataaagaagcaattacaatacataaaaagaaagcacacggttctttagggtataacaaacatta

SEQ ID NO: 73752 - DNA, 743 bp, Oryza sativa
tccttatatgcgaatacgggacagtgccacataggcacaacccccgcatcgcaagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactaggtaggtccgtcgatttggcacgcaaaccgaggccaagcaagttaagtgtgtgattataataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataactgcaactatacgcaaacaatcgaaaacctaaacaaaagacaaaaagaaagatcctatttagactaattagtagtgccattaaatagatctcaatttacggaattattggaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaa

SEQ ID NO: 73753 - DNA, 2363 bp, Oryza sativa
tagtacaaaatccaaatatgacataacacaatacattataattattctataatcaactcttagtttcaggttaaacagagctaagtgttggaaaaaattcaacccgcggtgtttaattcttctctcacggcatcacacctttaattttctttacatgttattaataaaattaatcaactccatatatgacttgatatgtggcaaagtggtagcgtagcggcggtcgtaatcaccttagatgccttagacacgacgctttgtcacgcgtgcaaaaggcaaaaagtgcagacgtgcattgtgtagcgggccaaaaaagagaacttcgaacgctttatttataagaaaacaatagatccgatgatttaaataatgggtccactggttctagtgtaagtgtaaattagttaatatagattttaaatttttaatttaatgggtatataatataatagtgtagactttattttgaaactatgcattattggagaataatagtccaatgtaataaaaaataaatccagtgatttaaataatgagtccatcagcttaaatgcacgtataaattagttaatatagatcttaaattgtttatttgataggtacacaatataattgtgtaaactttatttttaaatagtgcattattggaaaataatagcacaaagtaatgagtacaccggtttaaatcaaaattatcttacattattattaatttaatgggtaacatataatggtctaaattttattttcaaaaattgtagagctaatttagttacatgcaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggggtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttataacctgctggtatacatgctctaagagaaactatagattatccccgatgatggacagaatcacaggaggttcactagcagcttagcttgggagattgaagcccacaaggtggatagaggatttttttggaggcggagatgaacctgaggcggctatgggaggtgtggggggagtgggagatccgcgtgctcgtcctgtccagcctgtccctggaggtcttactcctcttaaccggcggcctgcgcaagcgcaaagccgcttggtggctgcgcatgccgctctggctcacctacctcctcgccgactacatcgccatctacgcgctgggcaacctttccaagaagcagaagctctgcgacggctcattcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaagtcgcgttagccgggtacgtctactggaagtcgcggcccaacatgcggctcatgtccccggcgataatcatgttcgtcgccggcgtcaccaagtacggcgagcggacgctggcgctcaggcggcgagcatggactgccttcgcagctccatggtcacgcagccggatccgggcccgaactacgccaaattcgtggaggagtgccagtcgaggacggagtccggactggtcgccaagatcgtcatcgtgcaggagcggcctccagatgacgaggaccatgtcgaagtcaagcgagaggagtacggcgacctggtgtacagtgcgcacaggttctttcacaccttccgccgcctcttcgtcgacctcatcctcagcttccaggaccgcatcgacagcctcgccttcttccggaggttggagatggagcaggcgtacaaggtggtggagatcga

SEQ ID NO: 73754 - DNA, 17300 bp, Oryza sativa
atatatattcttttttaacttcacagggttcatataagcataattgggccctgggttgcaaacgtgagtagcgtgtagagctaacacgagaacaaactcaatcctgaagaaaccacccaggaatagccagtaacatgcatcgcaaactgcaagcaaacattaacatccacaagaagaccacatgttacctggatccagcggccaaaacttaatccaaccaaaagcattatcgtgatataacaggtatacatagaccacggtttacttatggtcaggttaaagaatccagaagaaaaaaaaaagagtaattatgcaagataccggtacagtttcctgtctgtcttgtccctctccaagaactcgcgctcaatcagagactcgactctcttcttgatcaccacagggttcggcatgaaacgaggctgcagctgcttcgtcacctctgtcactatgctgttgtgatccagcactctcctcgacttcatgatcctcacgatggccgcctcgatctgaggcttcctgtcctcctcgactctctgccgggtctccatcttctctggctcagactccttctgtgtcgccaccgtgccgatcttcaccttgaacagcttgctggtgaacttatcgttgacgtagaagttgtcatcgtcggagatgtccctgctcataggttccttgcgcagaacgttcttgcccttcacaagcgcgagagactgaaggcagcgcttcaggtccgcggatggtatcgctgtagtctgctcgatatcacggtaagacaaacagtccgccgagttgaacaacatgagaacacacatctggtaggtcgacacgtttagctcgtgcttgctgccatttccaaacactgctttgatgtctgcagtacccatgtttgtttgccatgtcagtctcctgccattgtgggtaccaaggtagaaaccccgaaacatctcggacacgccaagaatctcaagaggaaggttgcaggtgttacatggttgtgtgggccaagacccagtggtgagtatctggacagatatagtaggggcatcccccaaatcaggagtaccagcgtaaaatcgctgggtggtatcatgagaggtcttcaaatcattgaacatgccctccaattttgaagtgaactgatatccacattctgtcttgagcttcacaagcatacttctctcagaatcatcagaagcagccttcccagaaagaaggcgcttcgccaagtgttgcttgtagtatttctcaaacaaatctttttcttgcaagtacctaaacagcatcatcactttgtccaggacagtctcaacatcctcctcattggcctctttcattcctttacgcagtttgtcgtcaacatacagcgagatgaactcagggcatctattgtttaagttaatgaagtgctcaaaggaggaattcagagcattttggaaactcttgtcattgctaaaggaagtggtaacaatactgtcatacttatccttctcatttagaagcctctggacaaaatcaacagggtccttcagcctctcaggatccattaccatatccttcccggtttctttaacatgtgaattcatcacagatttaattgtcgagtgaccatcgggaacacgttgaaacaagctgtacatcatggtcaggtcttcatacttgtcctccacaagcatattaacaagacctgagttctccataagaatcaacctctgcatgtgattcgcaagcatttccttcaccacaacagcagttattttctcgtctgttttggcatccatgtactgtgaaacacgttccgcttcttcatcaagccgctgctgagccttcttaagatattcaccacaggaacaacactctatgaatttttgtgactcaccactataaaaactagcagacacctcaaggaatggcctttcaaaatcatcctgataaacagaagaacctagatccatcaacattttagttgtactcctcatcaaggatctgtttatcacctcacctgttctctctctatgtatgagatcaagaagagtgtcaagcaaccttccatggatcttgggtgaccgaacaatagtatctctccaaagatccaatccaagatcaaatacaggtgtctttttattggtgggaataaaaaccctgtccatgtacatcaggatatctctgatcatttgcaaagccttgttatggtcatcccatttcctctgtagttctaccaagaacaaaccaccttgagcagcctcaatcgatacgcgcatttcttgcaggtgatcttccatgttttctgtcagtttgtcatagagctttggcccatgtttgtgaagtaccagattataagcagtcctgccagaatataaggacaatattatgttctggtacgtaagaaggcttattggttccaaacaaataataatagtatactgtgccatgaaaggctggtagctcagacatgataccatgaaaagccaataataatatcgaaggtatttccagaaccaaaaagaaaaagaaaaatcagatatcacaataacacatcgcttaagggcaagcaaacagggcagttggcctttgtttctctcttaaaattctatttattgcacttttttaagagtatacaatgatgcaagggacataacaacaactacaaagttccattgaacaagttatgggtactgcagtaatccagtttcagtatgatagaagcactacctacagactacatgaatagtaaaagaccatgctttgtgattgtagaaatagagttcttatgtaaggaaaataacaattttccactgaaaaaacaatgatgtaaagaagaaagactttcataagtattttgagacactgttcagctaatcttgtttcaaggggataagagtttttttttatgcgcaaacaaatgcatagcatagagcacgcaaactctcaagtgatgagaattgatctgagatgaatttccctagaggtaataggcacgcaaactctcaagtgatgaatttcttcacaaattaaattttgtagaatcaatggtattttccttctaataaaacggagtattttccactttctcaaacacctcttacatgtggtttgcaacatccaaattgcttgatagcatggccaccaaaaaaggagccagaaaatgcaacagcactacaacatgacttaagaatccattgcacttaaatttatggagcaaaagcataacgaaccaagagacccatcaatgaaccgacatacgcaatctcccaaacttctaaaccaagttaaaagtatttaatgctctacaaattaagcagttaactgcatacgatttccatctggctgacaaagctccctaccaatcataatggggcgttacgtctacagcgataaccgacaagcgagcatcaattattatagtgaggttcaaatcccacataacagatcatgaatctaggagctgtcctaaactccatctgcaatatacaaccctaacaaacaaaatttctaattccttttttaatgaactatgtccaaatactcgcatcacatatcgccatctccgcattgttgtaaccgcaaaactaaatcaaatcaaatcaaatcaggcctcttatctttctttctgcccctgtacagcactgacagggagaagcgcgatgggatgggggatggggggatgggaaacctgtagagctcctcgaaggagaggccgctggcgttgtggttgtagatctcgcggatggcgtcgtcgagcttcctccacgccttctcgaagaacctcgggtccgtctccaccttgtgcctgaacggctcgatcctcgacggcttcttcctggaactcatctcccgccgccgcccgccgcccgccgcccggcggtgatccggcgaggccccccgcctgctgctgcggattcaggccgcgagcgctagggtttcgtatctcgcgggagatgtggggggaggaggaagagagagagaagggggaggaggagatgtttctcgaggatttttgtgaaattcgttttgtttgtgtttttaagcgaagatgagaagatgagggagagcttgaggtggattccagcttgggcagttggggatggagatggagtccggtttggtttgggggaacatctgattattttgaggattccggttcgaatttgttttttttaataaccacggtttgcgagcattactgatccagtaattttttgaaattgataaagacaccacggacgactcgttatcgacggttatatcgtctaccaccgaaaaaataaatagttatcaatgcgatcatccgtatcaaataatttgaaccggggtgagctggttccaccacaagaaacctaatcagttgagctatgcttatatttcgtaggttgaaattctaattgagttccatcactaattggaatttgcatccagtacatatttacgattgcgtttacgtcgacacatatctacgtattaaaatatgtatattaatccgaaatacctattaaaaaattgtgtaatgtttacattgatagaggtctattatttgaatttaaatattgttaaaattatgtttatattatttctttgtatttgaagggagagcatgtatcaatctgaactacctatctctcgtgcaattaactataacaaaaatcaagagattggtagaaaaaggcgtagtaccaccagatctacaagtatgcttgaggttttataaactcgaaatgaactcatattatttttatatgttgtttatatattaaagtattgtagtctgaatataagaaattagaacgatgatatatttcgacgcactagctaaaatggttggatatgtgtgtgcatattttaagtacgacggcttaaatttgaacatgttcataggataaattggtgagtttggtgccaagtcaaagaagtcgtcatacatgatttcttttatatatcgtattccgacagagctcgtggctcctcaccgggagaccgcgcaggcccccctttgccagttcggccgggggcttagggtgagatctcaagctctctctgtatgtagaaagatcgcgtgccaggaagaaacgcgagacacggacgatctatacaggttcgggccgctgggaagcgtaataccctactcctgtgtttttggtggatttgtgtaagagcaagttacaaaatatcaaccagccctctcctctcccgggaaaatccaaaatcccatccccctctccttgtgggcatggtcctccttttatatcttaaggggataccacatgcactcttcccttttcaaactggacttttcttctttacataaatggacggagatctgcacggttgccctccgaacgtccttctgatgggacggcacatacctacctccacttccgccgggggcaggcgcgtcgtgggaacgtggctgtgcgctgacgacatgagcagtgtcagaccggtcacaaatcggtcatccttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgtggcgtgcgtcagaccgccagtcgccacctaaccgttgatctgaccggtctgtgactggtcacagaccggataaaagagcgcgctgcattgcgctgcatgcagcgtgacacgcttgaccaaaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgtgatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagccatgggcggtctcttcaagactgccacatcacttgagcagcgctcgaatctggacgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaagacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgctaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccagtgttgaaccgctacatcccctgcgccctccgcaagaagtgggacgattggaagagcgactggttctacaccccccttgccaacgaagcgcgcctccgactcccaagccagcccccggtgccggtctccagctggcgggcgccagtagatctgggggatgactatgacgccgtcctcgaccgcctggcgggcctgcgatctcaggggctcacaggggccatggtgtacggcgactacctccgacgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccatggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgagggggcggggcggtgcgtgccagcagcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgagctcgccaagccgaagaagctgctcgggaggaggccgcccgagctcgtcaggctgaagaagccactcgggaggaaaccgcccgggctcgccaggctgaggcgatggcgtcttccgaggcggttcacgacaagaccgccagcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttcccctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcatcccgacggcgcgaagaggccctcgaagcccgtgccatggcgctggaagatcatgccggcgccgtggagatcagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggaatccgaggccgcgacacaacggctggcggacagcctgtccctccgcaaggcagcgcaggaggagcaggcgcgccgcaatctggaatgcatccgcgccgagagagccgcgctggagcagcgggctgctaacctcgaggcgcgaggaaaggagctggacgcgagggagcgcagcggcggggcggctacgggcgaaagcgacttagtcgcccgcctcgcagctgccgaacacaccgtcgcggatatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaattccgcgttctaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgagggcgatgcgcgcgcgcggatccgggatgccgccaaccatatcgtccaaagcttcgaggggtcggcccctcggctcgcgttcgcccccagccccgacgaggagggcgacgccagcggtgaggacgacggtggcgacgaggccggcgacccgggcgcattggaatgagcccccaggcccccgccaatctccaactttttctttcttctttttgtatagatcaacttaatctgcaatcaaaaatgatgaaaaatttctatgttaactttattttgctatgcatatgagttgaggatgatttgtgccgtggtccttttgcatcttagcttgatttaagggctcgtgctcaagtcccgatcctcaaatggctcgggtcggggctagtgcctggggagatccacatgtcgagactggccaggccggaaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgatcccccccgtcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttctaagtagtcgaggtcatctctacgaagctgatcttgatcagcctcgcagtacatggtggcccggggagacctcagggtgagctcggatgggagaaccgcttctgcgccgtagacgaggaaaaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgattgcaacatacagatactcaaacccgcccggggcccgtttgaacggtcccaggatatcaagcccccagacagcaaatggccatgacagtggtatgatttgcagggcctgggccggctgatggatttgcttggcgtggaactgacacgctctgcatcgccggaccagatcgactgcatcattgagggctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaaagtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggtctggctcttgatagcgtggcgtggttcaaagtgcagatcgaactcagaaagctcgattgcccattttaccacccgtcctgtaccctctcgattatgcaagatttgaccgaggggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctttgctaggggccgtatccccggggcgttcttcattcaagtggcctttcggggcgcacttgtcttctgtgccgatgacctcggggtcggaggatgaaaggggcggccttccctcagtggcctcggggccgtcctgggggtcggaggcccctggcgtcgtcagacaagcgggcaaagggcctactccggtcgtcaggggcctcaggcctccgttcggctcaggggcctcttctccctgctttctcccgggtcgagtcagcacagggttagcctcggggccaaagggcgttaagtgcggccttcccgcagtggccttggggccctcctgagggtcgggggcacttagcaccgtctgacaagcgggcagagggccgactccggtcgtctggggccgtaggccaccgtccgactcgggggcctctgctccccgctcgctcccgggccaagttagcacagaatgggggtgcacgaaatgaggattgtcttcatcgcgctccacaaccaacgctgcactaactacttggggggtcgccgctaagtaaagtagcaagggctcatttggctccggggcgactagaaccgggggagagctgagatatgcctttaactgagtaagggcatgttcagcttcctccgtccaagtaaacggccccgagcgcttgaggagcttaaacaagggtagcgccttctctcctagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgttttcacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgtactttctgccggaccggccttgcgcccggccgcacggcgagacggtgctcaatcacctccctggggaccccgggcatgtccgctggtctccatgcgaagacgtcagcgtttgcccgcaggaaggagacgagcgcgccttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcaggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgttacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgtgtcgcctcatgagtaggggccgcggcgagaagctctcgcctcatggccttgaaactccggcgagaaacgtgagcacacgctcccccgtcaacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccatttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacgccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacaaatcctcccaggagtggaccgacgcgggtggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgtggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtgccgtcatgaccaagttggccacgtcgtccagccatcgctgggctggagattccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgggctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtagaaagatcgcgtgccaggaagaaacgcgagacacggacgatctatacaggttcgggccgctgggaagcgtaataccctactcctgtgtttttggtggatttgtgtaagagcaagttacaaaatatcaaccagccctctcctctcccgggaaaatccaaaatcccatccccctctccttgtgggcatggtcctccttttatatcttaaggggataccacatgcactcttcccttttcaaactggacttttcttctttacataaatggacggagattgcacggttgccctccgaacgtccttctgatgggacggcacatacctacctccacttccgccgggggcaggcgcgtcgtgggaacgtggctgtgcgctgacgacatgagcagtgtcagaccggtcacaaatcggtcatccttgtcca

SEQ ID NO: 73755 - DNA, 896 bp, Oryza sativa
  unsure (1)..(896): unsure at all n locations
aaccgctgcttcttgccctatggtnggtanttcaaagaaaaatctctgggggtccaactctcgaaatccagtctctcttgggtgaggcccgtgattctgaagccgtcaaaaaaaacctagctcgattccatgaccggaaggcaaagttatcaaggttttaatttgcacagaattctccatctgcattccacagtgtcgcacccgccagcctaacttaacggcgcggttagtcgacgtgcttgacaccgacatcgtctaagctatcgaccctaacgtcctatgtgccatctctatactaaccaccgcgttgaaaaccagttgtggagcctcagatattcgacgtttcgccgaataaacagctgcttcctggcctatggtaagtaatttctagaaaaatctctgggggtccaactctcaaaatctagtctctcttgggtgaggcccgtgattctgcggccatcaaaaaaaacctagctcgattcaatgaccggaaggcaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatctctatactaaccacctcgttgaaaacccgttgtggaccctcagatattcgacatttcgccaaataaaccgctgcttcctcgcctatggtaagtaatttctagaaaaatcaatgggggtccaactctcaaaatctagtctctctagggtgaggcccgtgaatctgcagccgtcaaaaaaaacctagctcgattacatgaccggaaggcaaagttatcaaggtttaatttgcacagaattctccatctggattca

SEQ ID NO: 73756 - DNA, 1621 bp, Oryza sativa
ctgaaaccagatgaagattctgggcaaattaaaacattaatactttgcctcccgttcatgaaacaagctaggttttttttacggcttcaaaatcacagccctcccgaaagagagaatgaatttgaagagttgaacccccagagattttcttagaaattacttaccataggccacgaagcagcggttgtttcggcgaaacgtcgaatatctgagggtccacaactggttttcaacgaggtggttagtatagtgatggcacataggacgttagggtggatagctaagacgatgtcggtgtcaagcgcgtcgactaaccgcgccgttaagttaggctggcgggcgcgacactgtggaatgcagatggagaattctgtgcaaattaaaacattgataactttgcctttcggtcatggaatcgagctaggttttttttgatggctgcagaatcacaggcctcaccgaagagagaatggatttggagagttggacccccagagatttttctagaaattacttaccataggccatgaagcagcggttgtttcggtgaaacgtcaaaaatctgagggtccacaactggttttcaacgaggtggttagtatagggatggcacataggacgttagggtggatagcttagacgatgtcggtgtcaagcgcgtcgactaaccgcgccgttaagttaggctggcgggcgcgacacggtggaatgcatatggagaattctgtgcaaattaaaaccttgataactttgccttccggtcatggaatcgagctaggttttttttgacggcttcagaatcacgggcctcaccaaagagagacaggatttggagagttggacccccagagatttctctagaaattacttaccataggccacgaagcagcggttgtttcgaggaaacgtcgaatatctgagggtccacaactggttttcaacgaggtggttagtatagggatggcacataggacgttagggtggatagcttagacgatgtgggtgtcaaccgcgtcgactaaccgtgccgttaagttaggctggcgggcgcgacagtgtggaatgcagatggagaattctgtgcaaattaaaaccttgataattttgccttctggtcatggaatcgagctaggttttttttgacggcttcagaatcacgggcctcaccgtagagagactggatttggagagttggacccccagatatttttctagaaattacttaccataggccaggaagcagccgtttattcggcaaaacgtcgattatctgagggtccacaacgggttttcaacgaggtggttagtatagggatggcacataggacgttaaggtggatagcttagacgatgtcggtgtcaagcgcgtcgactaaccgcgccgttaaggtaggctggcgggcgcgacactgtggaatgcagatggagaattctgtgcaaattaaaaccttgataactttgccttccggtcatggaatcgagctaggtttttttttatggctgcagaatcacaggcctcaccctagagagactggatttgggagagttggaccccagagatttttctagaaatgacttacccattgccacgaaacagcggttgtttccgcgaaacgtctaa

SEQ ID NO: 73757 - DNA, 723 bp, Oryza sativa
tttcggcgaaacgtcgaatatctgagggtccacaactggatttcaacgaggtggttagtatagtgatggcacataggacgttagggtggatagcttagacgatgtcggtgtcaagcgcatcgactaaccgcgccgttaagttaggctggcgggcgcgacactgtggaatgcagatggagaattctgtgcaaattaaaacattgataactttgccttccggtcatggaatcgagctaggttttttttgatggctgcagacccacaggcctcaccatagagagaatggatttggagagttggacccccagagatttttctagaaattacttaccataggccacgaagcagcggttgtttcggcgaaacgtcgaatatctgagggtccacaactggttttcaacgaggtgtttagtattgggatggcacataggacgttagggtgtatagcttagacgatgtcggtgtcaagcgcgtcgactaaccgcgccgttaagttaggctggcgggcgcgacactgtggaatgcagatggagaattctgtgcaaattaaaaccttgataactttgccttccggtcatggaatcgagctaggtttttttttacggctgcagaatcacaggcctcaccctagagagactggatttggagagttggaccccagagatttttctagaaatgacttaccattggccacgaagcagcggttgtttcggcgaaacgtcg

SEQ ID NO: 73758 - DNA, 15792 bp, Oryza sativa
  unsure (1)..(15792): unsure at all n locations
cggaatgcataacagacggtacagtagttcatcacctcattatggaaaatcaagacaactttcttaatgttgtatcttgatgtgcattcttttgaatctaggcttatttttatgcagttaaatttatgatttatactcctccaagttccatcagcccgctttgtataatattatgctttagatgggattagaggcctttcaaaggcagaaagagaaattatgctcctccagttggcctaggcttcaactctgggtttttatttctattgctggtcattcatacacaagatttcatgagcccacagttcaccttttggtcctacctcatttatcagcataggcgatagtagttgatgattatataccatttcccagactattccgaaagagcctaatgttggggatatttcaaggatgctaattgttgtaatgggtgcaagccatgttattaatgggtcatgaggaattagtctctgaccaaagtatctaaaaaatgctaagaaagaccaatttgtggtgctacttgatcccaagaaacaaggtgtacaggaagggaatgtgaaatcggtttctcactttttatggtagtcagtatctaaatcttacagtagaaaccaccttgaccgtgctgaaatggcatgagttattgaggctgctggtagaacacttgaaactttgcctcatttttgctgcttgatcttcatttcagccaattgcttgttagctatttagcttcatgttgcgattcatgttttgagcagcatttgtaaaatcatttatttaagaaagtggccatggacaagctcttttagatattgctaccttactatctttgggagagaaaaatgttgaatgaacattactagccatgatttggcaagaggccttcagattacgtgactattttgtattgatttgtacttgtgctattttgcttttcaagccaattacttctagaaatggatcactgagcctgtacacatgacacaataagagctaagcttttagcattctctgaaccctgactgcgacatagggtggctaatgaaatatgatcattagtaaatatgctgagtgcaataaactcttttccatgtaggcaaaaattttcttgtttgtaaaaattgtcatgtgcctagagctgagctctcttccgtggccaagatgtttctatagtttagtaagtggtatttcttggtagacgtttggctaatggaactcatgttctcagatattccaagatcttcagaagggaatagatcttggtgtagtctctccttagatgctacagatgttttttttaccttgagaaatgccctgttagggcatgtttaatggtagagacgagtatggtctcttaagcaatacaagattatttagagaccgtatctttacaatagtagagacgacaaagtctctaatcattaactcaaaaaatattccttttgttaatattctttccatttttttaccctcatgcaaccatatttccattttatattgattaagagtcgttgttaagctgttgttatgcatgacaacgatattttgtctctcctctttctctttcttccatgtcaacaagtattccaaattaacatcactaagagaccactattgacaaccattgtacatgcccttagtgcttcacagtttccaggtaagaaaatattcttttttttcccttcttagtgcttatcaattcttagtcttatgaataattctgttttaaacatagttatcctataattttgaggcagaatatacatacacttcatttcaataaaccaaatttcttagcggttgtgcaaaagattgctgggcagaccccaaattctcttctttttattatatatggctctcttgttcttctacattgataaacacacttttcagacaagttcttttgctcatggttttgcatactgcagatatccatagaagcaattgaagatttacaagtaaaacatgctttccataataacgcaaaatgttcctattattctggtgtgggtgtctgatgaaaggctttccttggaagtgcaactgtaggtacctatttctctcctttttttgtgagattacaaagtgccagacagacgcatatttctgcacatagttgtgtattcttgaacataggtctaggcttggtcagtattggatataattacatggtctgttttgtcacttccatggtataattgttttcttcaacttcctttttttttccaagcttagcaaaccttgtgacacaaggccacactaaactgcattagtgacatattatattaataaagacaaatatgtatatacacatgccactttgcgtttaggatgacagttttgtcaggtgttttgttacatagcaaagatttaattttttttattttatatttggctagccgtttgcgctttttcttacataaagtgttagtaggattaactaattaaattcataaaacactgtttgccacaatcatatatggtggcactctctattttccaatttagttagcataatgaaatgctcataattaatcctgtgctgaactaaattactatttgttagattactagccgttatttatgtatgcctgtttggttgttttattcacaaatctgtctcaattctctctttatttaatggaactgttctgacagtgcatgcatttcttattattcaggatggtgttcttcttgggatgaaatatcaaaacatatttttgatttgctttagctatgatacttcagcaagactcctggctgccttatctttttatataattgtcttgagcagttgtccctcaggtttttgcatagcttgtaggaacaagagtagagccatggaggcataatagcttgaagtaattatggttaatgtgcttacttaaaaaaggtgtttaatgttaacattgaattctgaaaacttgaagcagatttttctaagtgtacctggatgtttcttaagacatcggtttcttttgctatggtgctcctcgggagtatatacagccacaaaatcaaatgaactatatgcaggcggcgcgtcggggcttccctgacttccagcactcctttctaactagatgcgtacaggcggcacgctccaacctttagtcggttatattaaaacctactgggaattggcgagctgagagcgattcggagcggcgtgttcgcacacggaggcattcacgtcgcccgcgagcgctgggaggcgggcggaattcgcgccccctcgtgcgtccgcgccgtgcagctcccagccgtccgattcgtcgcagcgacggctgagatcgatcatcgtcgcgagtgcggtggtaatttttcaaaaaacccctccgttgcattgataatgtgttttagatcccaagtcatacggtgcgacgttgtggtcttttacgtataagacctccataaccaagaaaatcttacataaagaagagagaaatctaaaaataggaccgcactctgaaaaacgagcatcaaagggcttttctgaaaaccaatatatacctataccccttcccctgaaaccctagaatcattgctttccttcccctctccgccccatcgacgccctgcgccgccgctccattctccggcgccaatcctcgccctgacaccgccgcaccccgctgcccgtcctccattacctctctctcctcttgccgctggttcctctgagctcaagctcgatggtgagaggccgactccgtccgtcggcgacgagtcagtcgatccggctttcaatcgggttagatctccgtcctctgcatcacctcgtcgtcgatttacctgtctccacaatccaagcccattctgccttcagatctggtgactctgccttgcaattggctgaaatgaagatcaagcagcaaaaatgaggcaaagtttcaagtgttctaccagcagcctcaataactcatgccatttcagcacggtcaaggtggtttctactgtaagatttagatactgactaccataaaaagtgagaaaccgatttcacattcccttcctgtacaccttgtttcttgggatcaagtagcaccacaaattggtctttcttagcattttttagatactttggtcagagactaattcctcatgacccattaataacatggcttgcacccattacaacaattagcatccttgaaatatccccaacattaggctctttcggaatagtctgggaaatggtatataatcatcaactactatcgcctatgctgataaatgaggtaggaccaaaaggtgaactgtgggctcatgaaatcttgtgtatgaatgaccagcaatagaaataaaaacccagagttgaagcctaggccaactggaggagcataatttctctttctgcctttgaaaggcctctaatcccatctaaagcataatattatacaaagcgggctgatggaacttggaggagtataaatcataaatttaactgcataaaaataagcctagattcaaaagaatgcacatcaagatacaacattaagaaagttgtcttgattttccataatgaggttattcccctagttcgtggtaagctgtatgggtaattaatcgtggcaagtaaattatatgcagcaagctgcaaagaggttaactcatgtggtgcggcaaaaaaattgagatgtaaaccatggaatctagtttcaatatccaagacacatgtattgaacaccttgcatgactgctagagagcattgtttcgtacaatataaccaatcacacgtcaacgaattcatgatttgactaaagattattttatgtacattttgagaaatatcagaaactttttaatgcaaattgctagaggaatatcagaaaaagaatgaaataataaatagtgtcgagcactcaagccttggataacatttatcaccagcaactcaattgtgattcaaatagcagaaaaattcaatcttcaaattatgtcctaaataactgtccctatttaggacaaaaaccagcagcgatgtgtagtgcaaagtttatgaatcctagctaaaatagtcctacaacacatttacctgtccaaccaaaatagtgcattcaaaagccatggtttgcagagcaatagagcatcaaaatgcacaaaatatactaaacatttgaagattagcacaacaacaactaatcacaataaatctgagttagcacatggaatttaaaacaacataaaaggaaatattttttctatggaaaggaaggtcaaaatcaactgcctcacaaactaagtgtgcacaaaggaaaagaaaaaacaataccatatgcaacaaggagttctggatcaccatatatatcaacaaggacctacatggttttgtccatgagtcacaaaggattacactaaacatctcaatcctcttgtagaacaggcaaaatatataagaaaccttgggctctacttcttgcgtgttaagagtatggaaacctagtgaatgtggaaacctacaacagtaaatgctgaggaaggaagtagaacaggtcatggacgactatcacataacatgatctaccaaaaaaatacttttttttcctatatcaagaacagatgctagaggagatgattggactgaattgattcgtacctagatggcagcgacattggtggggaagccatagatgcagatcaccatcctggggttgaccccatgcacagaagagaccaaacctgcatcagtaagaaatttccattcctaattaaacccacaaggcaggagctgtagcacgcctcgaaacacaactgaattaaagataactgaatggagagggcaatgcaagataaacctataatatgaagtaattggttctatccacttcaagaaagaaatagaagaaaattaaaggatggtggaagaaaaataacatctctgaaccaatcttatctgctctgcctgctagacatcacttaggccaaggcctgttgcatgccacatgaaccacatccaacattttcttacattgccaaccacatgccaggcaggcatacatgatgagaattgaaagagaaaaaagttgggcttaaatcaggtcacaaacctcaaattgaatgagaaaattcaaattagatcgcctcactaaaaaaagtagaaggatacctataacttctcatcaagtaccagaatgctaaatgataatctctgaataaatgagcatcaatcatagcaggcagcctgttgcattcatattctgctttctacagtggattaagctcacccactataaattaacctgcttctctgcatttttagatggtgtgccaaagtgagtagaggtagcagctatagtggatggtttttcaacgacaataatctaatccttaagaagactcctgaaatatataaataagtaaggcacatatatgaaagtaaaactctcaaacatttagtaatatcattatatataaaaatatgctactcgttaaccactgaatgtgttggcttgcaaagccagtttttttggatgggaccaagggctaaaacaattagtcaatttaataacaacccaacagcatcatcacattttttattctgtgcaaacaaaatagtgttcatttgtcaaaactattgggtacttggttttaagtttctgaaatagatcatgagtgtgcaaattgtgaatatttaaataaccgcaacattcagttcacatatatacctctttgcatggaacaccaaaagatagcattttcatagaacatgaatacatatagagaaatattctagaagcattaaatctaaaacacataacaaaatactgctaaccaaaaatttaatactttaataaaaaaacaaggttaatacggatggaagcctttggaaatgaaaaaaaaaaacagttgcctgtgtatatataagtttcaagcggcaaaaataaattaagtttatgcactacatttagcgaaaactttgctgcaaacagctacaattaaaatgactggtactcaggtttcagcatcaagtagcaccgtttgcacctctttgcaatgttgctatttccttcagcagattattaaacagcggcataaccactgcacccctactttctttgaatattttttagagtatagctaccacacagtgaatatatatgctgataactaaatggcttgtattaagacttgtaccaagatttttctggtctgaaatgtgtagaattcacccagacaaaaagtgagatttctgcatcagaagagatctagctaaggtttgcacttcagtgactggaaactaatcccacatatcatttgaatgtgcaggcaacattcacaacaaactatcgagaaacagtaatggataaagaatttaatagagtcaaaaggaccaaaagttgaaaataataccagcaattatattgttttgtttatgtagcaacatcatccatggtagatgcagattcctactgctcgagcacctcacgtatgcagtgactttaagccctgagagagtgcaaataaccattagatgttattatgatacaataaatcatctattccattgaaaaagatacagtaaatcatctcccaattagtgaacaaggtaacctttggaagattatttgggtgacatattgcattaagatcaaatttgctgtcactaagtagctgtgccaaaatttcagtgagttagcatttatgatgatagatcaggatgtcccccattgtgccaaagacataaataaagatcggcaatcgaactttcttagttgaaattatcatattcatcggctactgatctaatacaggaaagtggcaagtctgctcgcacttgaagctcaacgtctagtggagatggatgaggccttaccgatcatgcaccttgacaaatatcctaagctggagaaacctatcgatggagatcctgtgcttggtggcgtactcatcaagcacacactccttcatggccgcagcggccaccggcggcggcgtagacacacacaactccagtgtgtacttcgcgagcggcctacagaacaagtgaaacactgatgacagcaacacaaaaatgaatcacatagctaaggtcggcggattagggacctgactgcaggcacaatcatcgcaacgcgcgtgctgttgcggatcccggaagttggttgtgttcccctttaatctctctttacatttttgtgaacattgcagctagatttctgctctaaaaaccaaaaactactcatttttgtaaataaaacagagaggatacaatataaatttctaaactactctaaaatttagatgcaaagaaactcaattttcagatgccacattagttgcaaaaaaaacgttgagatgtaaacctgagtgaatgatgtgcatatcgggagcaggcacagcggtcacggtactacgaactgtgcagcaaaccgacgttgctccggctggatacatgagcagattacagcacccagagcagacgagctggctttgggcccctgaaattgcacaatcatggctcttcagagttcagagactgactgaatgtcacatttcagcagctagcattttcattttcagaggacaaaagcattctccatgcattattttcatttcagacaacagaacacagtagtaaaaaaaacttccattttctcaacagggagttctctctaaactttcaggatttctatgagcacaataaactgcaacctctgaaccaggaagagtaacatcttattcaagaaaaaccaccctaacttaacacagaattccacagtgtcgcgcccgccagcctaacttaacagcgcggttagtcgacgcgcttgacaccgacatcgtctaagctatccaccctaacgtcctatgtgccattcctatactaaccacctcgttgaaaaccagttgtggaccctcagatattcgacgtttcgccgaaacaaccgctgcttcgtggcctacggtaagtaatttctagaaaaatctctgggggtccaactctccaaatccagtctctcttctgtgaggcccgtggttctgaagccgtcaaaaaaaacctagctcgattccatgaccggaaggcaaaattatcaaggttttaatttgcacagaattctccatctgcattccacactgtcgcgcccgccagcctaccttaacggcgcggttagtcgacgcgcttgacaccgacatcgtctatgctatccaccctaacgtcctatgtgccatctatatactaaccacctcgttgaatacccgttgtggaccctcagatattcgacgtttcgccgaataaaccgctgcttcgtggcctatggtaagtaatttctagaaaaatctttgggggcccaactctccaaatccagtctctcttcggtgaggcctgtgattctgaagccgtcaaaaaaaacctagctcgattccatgaccgaaaggcaaagttatcaaggttttaatttgcacagaattctccatctgcattccaaagtgtcgcgcccgccagcctaacttaacggcgcggttagtcgacgcgcttgacaccgacatcgtctaagctatccaccctaacgtcctatgtgccatcccaatactaaccacctcgttgaaaaccagttgcggaccctcagatattcgacgtttcgccgaaacaaccgcggcttcgtggcctatggtaagtaatttctagaaaaatctctgggggtccaactctccaaatccagtctctcttcggtgaggcccgtgattctgcagccatcaaaaaaaacctagctcgatttcatgaccggaaggcaaagttatcaaggttttaatttgcacagaattctccatctgtattccagtgtcgtgcccgccagccttccttaacggcgcggttagtcgacgcgcttgataccgacatcgtctaagctatccaccctaacgtcctatgtgccatcactatactaaccacctcgttgaaaaccagttgtggaccctcagatatttgacgttttgccgaaacaaccgctgcttcgtggcctatggtaagtaatttctagaataatctctaggggtccaactctgcaaatccagtctctcttcggtgaggcccgtgattctaaagccgtcaaaaaaaaccttgctcgattccatgaccggaaggcaaagttatcaaggttttaatttgcacagaattctccatctgcattccgcagtgtcgcgcccgccagcctaacataacggcgcggttactcgacgcgctggacacgacatcgtctaagctatccaccctattgtcctatgtgccatccctatactaaccacctcgttaaaaaaccagttgtggaccctcagatattcgacgtttcgccgaaacaaccgctgcatggtggcctatggtaagtaatttctagaataatatctggggggggtccaactctccaaatctagtctctctagggtgaggcctgtggttctgaaaccgtaaaaaaaacctagctcgattccatgaccggaaggcaaagttatcaaggttttaatttgcacagaattctccatctgcattccacagtgtcgcgcccgccagcctacctcaacggctgtcccaccgtagcgcacctgcctcgctcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttagttttatttctcctttcgcaaatcatgtcatcaatatcgtggcaatgtggtgctcatgtctctacatgccgcatctcaattaccttcccaaaggtaattgcccaagcatatagtatttgataaatatgagtatgcatgattctagaatagcatttctaagcatttgtcatagttgactagggactcatacgtaaacatggttacgaaggaataaggggtaaacaataatcaaggcatggcataatcgcaagtaggatgttcaccattgcatgcaattttatttgtaaacaaacaatttcgcaattgggatcaacatgttcaaggaatagtgatgacttgcctgctcagaatagtccttattcttgatacaatcttgatcaaccttcacctcctgtaagctgcatacgttgcctcacgactaaccgatatacaaattctataatatgcgagaaaaaccaatattcaaacaacaatcaaatatgtacaaacaaaatatagttgttggggttgctcatactactcgtgtttgctaatggattctaatcaaactaagaactaaggtttcttaatctttatgttgtcatggtggtctatataggagctaaccaatgtagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaactccactccagactcaacttctggagttatatttaggagttggagctgtgccaaacaggcccgtagtatgaatgagatacgtatctggctactatgtggtttagtctagcaaatggctattcatgcgtctatctaaatagaatggttatacactagaggttctgttgccggatggatttggattggttaaataattactgtgaatcatttgtattattattttattgatggaggctttattttaattatgtacatattttacttgtaaaaataaattataaaggttaacaattacccatgctttgtatgttagaattgtttaggttaatcttattatggttacggactatcccatcacataattttacaatgaataatcctaatttacaattatattaggtcaagatttataattagtattttatccactatagatgtttgtcatagactcattagtttactatacacaaaagggtaggtttttgatataccgtacatctaaattgggatgtacaatgtatgtgtgtgcaacaatatttaatcattggatcatttactgaatagttgctatttactagaagctatacgatatatgtgattaagatagctctgttttgttaactaatggatgtcaatcgaactatatatattccacttcacatgacattataccaactaacttttaagtggtccaattacaactagctcagttattattcttcttagacaagttgaaggttcatctaagtgtgtttatattttagttacaaagtatgaggctaaacttatgtaaataatttataagtcataggtttagttatatttggacatagactaataaatggcactaatatttcctatgctttaattaatttgaaacaatgctcctagttagtttacataggttttatagtgagaaagcatgttaaagacaattatttgacatctactttatagtacaatatcaattttattattagcacatttttaagttaactattatgcatcatcttgatattaattattaataattataaatatattttattaaatagtgaattatataccattggaaagcttgtgaatttaggttcaagtttcactcaaatcggagctaaaatgaataagttatgctagtgtaaagattcaaatttgaattaattctaataattgcgaaatggtactgttcctaattcatttatttttaatacaaccttatccacaggctatagtgactgacaggtggggtcttcctattttcttttcttttattttatttttctttctaaaggaatcatatgggcaaatgacaggtgggcccgactcctttgactagggtcaaaccggccattaaacccggtagggcccgcatgtcatagactcgggattataaaacctcaataattagatttttaaccacccggacccacatgtaatagactcaactaataaagattaagatggggattactattcactaaacacgtggggcccactctaatctttcctctcctttctcttttctctctctctgctatctctttgcttcctcccacggctcggctggaattggcgggcggcgcggcgcggcgtcaagcggtgggggaggggaaggctcaccggaccgatggcggggtcgacggagatgcggcggcggggtcgacgtcggagcacggcgcggcgacgaggcacagcgcagcggcggggcgcgtcggctcagcggcggcggtggcttccgaagaggcggcgacgccggggacgggaaagagaggggaaagggaggggaggtggtcagggtggtgtgggaagtaatgggcggcaagggggaggggtttatataggtggaaggggcgggcagtgcttaatgacgacggcgacgcggcacggcggcgtggggcgcgacggcgacgggacggcgataggtgacatcgtgcagcggcgcggggctcggggcacggcagcggcacatggcgacggacgagcggcgcgcaacagagagaggcgacggcgacgggcgacagtgacgcgcacggcgcggtaggggcgcggagcacgaggcgggggcgacggcggcagcgcgcgcggaggggaggggctcgagacaacgcaacagacgacggggatgcgatggagtgcggcgcggcgacaggacggcgcgcggcagtggagtcaacgggacggcgatggcgcgcggcggggtggagactcggcgcggcatcggcggcacggggctcgaagcggcgaggggacgggcgcgcgacgacgggatgggcaatgcgacggcgagacggggctcgaggcgatggcggcacgcgcggcgcggcagcgggatggcgacggcgacggcgcggcagcggcggcgcgcagctcggagcggcgacgcgacgggcgggcggcgcggcgcggggctcggcgcggcttggcggggctcggcgcgacttggcggggctcggcgcgacggcgacaggcgacgcgacagcgacgcggcgcgggcgcgaggtggcgatgggacggcgcagtgtggcagaggagggggaagggctaggggaccacatcaagcagatggcgtgcaatgaatagtgacggcagtgaataaaaaaaagaatttaggtttttggttggttttaaaaattgagaataatagctatttgaatttatattttcaccaacgcatttgagtgacattattaagtgttcaaatgtgaattttatttaaagttaatgttgtccaatacttaatactcgtatttattatagtctttgtaatttcctaatgagacaattacagagaggcagtgatattatacactctatttatttatgtgagtgaattttatgcgaagatggttgcgttaaatattgatttaaatattccagcaaaacactcttttatagatgggatcctggtaacgatgtgatcattatttcgtgtgaacaaattattctatctaattgcaatgtatgagctaaccttgttcttttaaaattggttttacctctatatggatccttataatttaatattcgtggttcaatacaaattatgtaacatctaattaattattcccagtaaaactattctatagatagagttccatttatttgaacgattatcatttcctaagtgtctatatttcatggcacgcatcacaaggttcaattatttaatgtttgatccataaattaaattagtaattaacattccctttgtctggctttgtttcctggtgctctaattattcgtagggttaacaattaaatattctcgtaaatttatctattacttaaattttagatccttactttactttccttgtgatcatttacggtttggcaagcaataatattcataacaaccatcatgatgcaaatgttttaaaaagttctaaattttagtgatttttattgtcttgaattttcaggatgttacatgacgctcgtgattctgcagccgtcaaaaaaaacctagttcgattccatgaccggaaggcaaagttatcaaggttttaatttgcacacaattctccatctgcattccacagtgtcatgcccgccagcctaccaaacggcgcggttagtcgacgcgcatgacaccgacatcgtctaagctatccaccctaacatcctatgtgccatccctatactaaccaccacgttgaaaaccagttgtggaccctcaaatattcgacgtttcgtcgaaacaaccgctgcttcatggcctatggtaagtaatatctagaaaaatctctgggggtccaactctccaaatccagtctctcttgggtgaggcccgtgattctgaagccgtcaataaaaacctagctcgattccatgaccggaaggcaaagttatcaaggttttaatttgcacagaattctccatctacattccacagtgtcgcgcccgccagcctaacttaacggcgcggttagtcgacgtgcttgacaccaacatcgtctaagctatcgaccctaacgtcctatgtgccatctctatactaaccacctcgctgaaaccagttgtgaaccctcagatattcgacgtttcgccgaataaaccgctgcttcttggcctatggtaattaatttctagaaaaatctctgggggtccaactctcaaaatctagtctctctagggtgaggcccgtgattctggggccatcaaaaaaaacctagctcgatccatgaacggaggcgaaatatcaacgttttagtttgacagaatcatcatctacatccacagngggcggcccgcaactaacctaa

SEQ ID NO: 73759 - DNA, 8949 bp, Oryza sativa
aaccaaccgggactaaagatcccgggggggcctgacatgacctgacagcattcgaaccgggactaaagatgatctttagtcccggttggtaacacaaaccgggattaaagatcaaatatgcccgttacccttttgaaccgggactaaagatcatctttagccccggtttttattgcatccgggactattgtggaaatcggccgaccgacgaaagatggtttctccaccagtgcacaaacgaatagacggacgatgacgctcttggcctcttgggctctcggcttctcgggtcgccacgcgttagggttgggcgacgtcagaaggaataagttcacttcgtgaccctcaaaagtgatcgaaatctaatccgtgaccctaaaccacaaaatcggatatctcgacccccaactcttaaaaccgatacaatttgactccctcggtggtttcggagggcgatttcgctgacgtggcacctacgtggcagtattgactcggtcttttgtccacgtggcgtttgcgtggcacttaggtggtattagaaataaaaaatatgtgggacccatttatcattcaccaaaagtatgggtgggtcccactgacacgtggggctcatataaatcatatcctcccctctctttctctccgcgagtgtgggacgggggccaatggcgacggagacccaggagcggcactggagcggtgacggaggcgtgcgggtgagggccggagcggcggcggcggcggcggagatcgagaccgccgtggaaggttggccgtcggaaggaagaaaacgagccacgagaacggccgtgtcctcgccatcctcggccccgccaccgcactatccatcgctgcgctccacgccctctctgccggccacgacgcaccggcctccgccgttctcccgccgcgcccacgaacgcgtaagggtcgcctgcgtctcgccaccgcgactcgcgtcggcatcccctcgaagatggcggcatccggcggtggcttcttatgcacctgcgtcggcaaccactactacaaaaatcgtttttctgtacgagtgggtcggtagcttctatgcgggccgcttttggcggcgcctgcataaaccgccccccgggggtcggttgattagccgcatgcgaaaataggcccattatcgcatgcggctgatcttcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattaggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactaatttttgcaaaatctagcttcaaaatatatgttttgatgggcaaattttgcatgtaatcaattgtacatactagttacatgtattgttgtatttttttttggagacaaatgcatttaaacttttgtatgaaatacctgcggtctatttttttatttgtaacttttttgcctttatataattagatggatcagtcgtcatggatgtatgagatgtggagaacgcagccgatatttattaaggaagcatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttgaacctatcacagggaattcgccaatccgaaagatgacgatgaagagttatgtttcgagatgaatgaggcagagaattttataatcgaagacatgtcgcgtgaaagaatggttgtcgatgtttccaccgatagtgatgatttcgatggtagttttgatttagaggatatgctacgccatgttaaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctaagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaatggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccagaaaatagatggtatgattcgacatcccgccgacgctcgccagtggaagacatttgatgcaaaacacccagaatttgctaaggatcctaggaatgtaaggtttgcattgagcactgatggaatgaacccgtttggtgacataagcagctcgcacagcacatggccagtccttctcacaatgtataatcttccaacatgaatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacagatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaatgttgtatatggaaagggaaagaagaagacagtaaagaggaagaaagctgatggtgacaacggtactgcgtcgcctttcaagaagcactcaattttcttcaaatatttagattacaggaaggacctagagattcgacatgcaattgatgttatgcacctcgagaagaacgtgtttgatagcaccgttggcacattgctggacatcccgagtaaaacgaaggatggattgaagtcacgtaacaaccttgtatatttgtccatacggcatgaccttcacccagtagtgctgccaaatgggaagaccgagattcctcctgcttgttactcgttgacacttgaagagaaaaaagccttcagtaaatgtttacaaggggttagagtgcctactggtttcacatcgaacatcaggaagctagtatcaatgaaggatttgaccatttcgggatacaatgcgcatgactgtcataggttgctaacggtgttcctaccaattgctataagggcagtcaaaccagtccacacaaaggtggttataacaaagttgtgctactttttcaatcgaatttcgcagaaggtatttgatcctttggaattaggtccgcttcagacatttgccatcgagactgtatgacagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcatccggaaggatcattgatagaggaatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctccgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcactgcacaaaacagtaggatccgtgtcgaagcgattgacacgagtggagaaaagaggtcgtattatgggaccattcaagaaataagggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtgttccaaatgtacgtgcatgaatttaggtcccccttatgttgtaatcattagcatgtaacatttgattacgagttttgagcaattttcatgagttttcttagtgccaaaaacatttggaatggataattgtggcgaaatattgggaaaaaaatatatatggacagtttacttagagaaaaaaaatatgagtttttttggtaaaaagatctttccatgcggacgacttaagccagccggatggaaatatctttttcccatgcggccggctttatggcccgcacggaaatatctttttcgcatgcggctggcttaacagcccgcatggaaagatctttttcgcatgcggccggcttatgtcgaccgcatggaaagatattttttccatgcggtcccttaagccgcctgcatgcgatgatctgcgcctatatatagggagcgcggggagccaaaattttctaagtcccggctccagcgaaaccctagccgccaggctgccaaaatttcccaagtcgccgttgccgtcgtccccgccaccgccggctcctccccaaagtcgccccgccccacgccgtcgccgccgccgccgccaggacctctcccccctcgccgtcgccgtcgccgccgccaggtcgccgtcgccgccgcacggacctctcccccctcgccgttgttgccgtcgccgcagcacggacctctcccccctcgccgtcgccgtcaccaccgcacggacctctcccccctcgccgttgccgtcgccgccgccaggacctctcccccctcgccgtcgccgtcgccgccgcacggacctctcccccctcgccgttgccgtcgccgccgccaggtcgtccccgccgccaagtcgtccccgctaccgccggctcctccccgaagtcgccccgcccctcaccgtcgccgacgccgctgccaggacttctaccccctcgccgttgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgttaaattgggatttatgtataattgggacttttgttaaattggcacctatgttaaattgggacttatgtttaaattgaaacttatgttaaattgagatttatgtatatttgggacttttgttaaattggcacctatgttaaattgtgacttatgtttaaattgagacttatgttatattgggatttatgtataattgggacttttgttaaattggcacctatgtcaaatggagatttctgtttaattgtgactgatgctaaattgggacctatgttaaattgtgacttatgtttaaattgggacttatgttaaattgagaattatgttaaattgggacttatgtgaaattaagttattgggacttatgtgaaaataagttaaattgtgacctatgttaaattgagatttatgtataattaggacttatgtttaattgagatttatgtataattgggacttatgttaaattgggacttatgtcaaattgagacttatgtgaaattgcgttaaattggtacttacgtaaaattgggacttatgtcaaattcttttacgtcaagttggaacatgtcgaacgaaaaggttccatcgaatgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgttgaaaatcgttagccatgtattattccctaactatgatgtgacatgaacctaatggtgtatagagttacctattctttgcagatggtagtccgacgccgctcgaaacgtaaagccgagaggaacaggacagagcaagaagttgagatggacaccgctacgtctgcacctgaacgtacggagacatctacaagtgcaggcgggagtgggaaaaaaagatgtggtgagagaagcaagaataaattacccaaggaaacttacaacgtgattgctctcgatcaggatgggaagcccgtcgagccaccgatagtgcggtccaagttcagcaacgcatgtggcactctagtcaggacacgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtcatacgctggtcacgtcgatcaatggcgggagatcgagcaaagatttgccgcggccggtaagcccctgctggtagaccccatggttgaacgtagcaagaactgggtttgggcgcgtagcacaggtcaagtctcggatgagggagacatactattcgagactccagacatagaagaagtgactactaatttgcagcagatagtcgagaaagaaagatcaggacagttcgtcccacggagggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccaacaacccacacaatccgcacagcaaacaactaatgtacccagcagtgtaggctcagtgcagacaactaccttccctgtggatagtataactggaccacctccgtgcagtctcatcgtaccaatcggtcgcgctggaaagactaaggaggttgcaatgggttttgcaatacccggacgtcaattccacaacacggcaatccctgaggattacgcaaggatacaggtcgccaaggtccatagcaaccacgtttccttggaactagacatacctacacttgaggggattgaacttctcggtgatgcagtgaatcagtttatcttgtggcaccgcagagacataatcctgagcgcggcctttcctgcagcaggatcttcaaccccatcctcatcacaggcaatgactgctgccgctcctgcaccaccgtcgccttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccaccgtattcaacaagacacacccacaagtacagaataaatgcaagggagtacaaaggagttatactataaagggttagggttgcagtaaacagcatttaaagatatttagttgctcaaaactatttagtaaacacgattctagaactatacaatattat

SEQ ID NO: 73760 - DNA, 8695 bp, Oryza sativa
aagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgcgatgcatccaaacttgggttaggttgtgttttgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagctttagaagcgaagcccactctaattgatcaagttagagaagcccaaaataatgatcctgatattcaagagatcaagaagaatatgagaagaggaaaagctattggtttcttggaggatgagcacggaacggtatggttgggtgagagaatctgtgtccccgacaacaaagatttaaaggatgcaattctgaaagaagctcacgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaactttaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtttacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgtttttgcaaagtcccgtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctaattttaattaataaattccaatataaaattgggccagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatcccttctctctcctcagcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggttaaatcgctttggaaagcgtcggagacgagttcgtttcggatcggttttccctctctccaagccgaaggtttccttcgccgttgccgtcgccgtgggccttcgccgccgcctccgagcccctttaaaaggacccccggtgtctcctctacccgtcgcagccctcgccttcgcctctcgtcgccggaagagctgtagcgccgtgtgccctagctttgccgtcgccgccgccgctccagccgtgcgccgccgtcgtttcagccgtcgccgtcgctcgggaagaccgccgtcgtgcttgccaagtcgccgccgtcctcgtccgccccttcgctgccgtcggagaccgccggagcatcgtcgccgtcgtcaacccgaaggtagccgccgcttccttctcgtcgccgtcgtcgtccgttccttttccgccgccgttttggtcaccggtgtgttcgccgcgttgtcctctacgtgctggtgccctccgttggtgccgtggtgccgccgttcgccggcgagtgtccgccgcccgagccgttttcttcgccgagccgccgccgtcgtcggtgatgtcatcgttgacgtcatcgggatcctctcccgtgagccggtcatggaccgatcgatcttggccgtccgatttggatcggatcaatctcggccgtccgttcgcgtgaaccgccgcccatgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaattctctaattttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgttgagtatgtcatatactcaccttgcaatcattcatcagaagaagagttctacaatgaggctgatggtgtggaggattaggtgtagccttggtcaagctgcctgtggagtggagccgtctgcgccgtttatttaatttccgctgcttagaactttattgattgagaagaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaagttggtatcagagcccctttgaccctaggttataccaaatggttacccaaagaagccctctgaaaaatattggaaaagtagaactgttctcctccctttctcttttaattaaccaaactaatggcacatgcacttcataatttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatacccagattcctcatgatcgtcatgaagagaagtgccgagtcaaagtcaccttgaacagcaatagtgaagatattccctcagtgatgttcgaagctggaggaagaaactacatccatgcatgtcaggaggtggcaaggatcgccataggagagctccgtgatcgctacagtgatcaattggccgacactgagtatcgttaccatcctcgccaaccccagggaagtgaccgtggcagttatcttgagactgaaggaattgagaattatgttaccacaagacatttggttgagatgttgtgggctatggatgaaagtcgtgcggagactgtgttagcagctcaagatcgtgaagaccggaatcatggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcttaagtagtgatgaagaagaagaatctaagcgcaacaattccaagattgagtgggtagcaacccaagatgatgaagacgagccttcaatcgacctccgatgcttggaagaactagagtgacttgttaagtcgttgtcatagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttttccccgttttctcttcttgtgccctgtccatgccagatggtgaacactcgtagcaatgggaatggtcccaacaaccccaataacaacaatggagagaatcccactcttgctcaagttcttgctcaacaaacacagcttatgaacatgatgatgcagcaatttcagaatcagcaaaaccaagggaataatcatgcacctccccagaacaagttagcagaatttcttcgtgtgaggccgcctgttttctctagtaccactaatcctgttgaagctagtgattggctgcatgccatagagaagaagttggatttacttcagtgcactgatcaggagaaggtatcttttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtataatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaataaagctccacgtcctgttgcagctccagtacagcaacaacctgccaagagggagcaaggcagcaagcccgtggtgtgtttcaactgtggagacccaggacattatgctgacaagtgtccgaagccccgtcgcgtgaaggttgtccctgcccagagtaactctgctgtaccagtatccaaggctcgtgtaaatcatgtcgctgctgcagaagctcaagatgctccagatgtaattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtattctgatgtgttcccagatgatttacctggtatgccgcctaaaagggatatagagttcagaatagatttggtacctggaacaactccgatccataagagaccttatcgaatggcagctaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttagaatcaaagaggaagatatacctaagacagcttttaccactaggtatgggttgttcgaatgtactgttatgtcttttggactta

SEQ ID NO: 73761 - DNA, 4627 bp, Oryza sativa
ccttgagcatattgaatcccagtttataaaattattttgatttaaattaatgcattatcgctttatttaaattcccgcgttatcactgttttatttagccatgcctatttacctttgttatgaccttattattattgctattgttattataaccttgttcaccctagaataaacaaaaccccaactagtgggtactctattcatggttccactagtatgaatttaggtagatgcttcgctgattagttaggcaacattaggtggttttataactctcgactttgggaatactcatatcacttggacattatggaatggttggattattgtagaaatggacgcacacctccccctctattcaaaaccctcaaaatggttttaggctgggctcagggtgcatggttttgatagtagcaccttggccacataaggaccggtcttcgggcctctgttgcaaagcactaccgtacttccacatgtctagtgggtaaggcttagtttgtggctcagtctggttataaacaaaggtacatggatggagatggacgaagtcgagggtcgatggacatctctaggacaaatgaaggctacacgagctgcggcccggtagtcgaaatgtcatgtcacaaggctggtgtcttgctgctaggggctcagtcctgcctacctgtcctggaggttccggccgtaggtggggttgggtcggtacccttgtctatggctaggatgggttggaaactatgtgtcacatcctgatttttgtttcaggatttataaattatttaataaattattattagaatttatattaaatgttcattaatttacaagtgaagttaaatgtgggaaataaaattttctaaatataaagcatggatggatttaattttttttttaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccggctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttaggtgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccattaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgattcattatagtgcgccagactgtgaagcggcgagaagtccatgggggttgctggggagtccatgccttgtttataagggggtgattatgatccaggaaaggtgcgctgtaatggcttatgttgtgcaaggggtattgtcacaactcctttccgaggtaccgtggtggtattgaggcacatggtgacatgatgtggggttgtgtcttgtgggtacagtggtacacgtctggccagagtaaaactattcgaatagccgtgcccgcggttatgggcgggttgagcaatgtttttcttgattagtctcacacctctcacaataattatggatgttaatacttggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctctggtatccttgtgcacttgcatatttgctgtgtggcttgttgagtatgtcatatgctcattcttgcaataatcatcaaacctcagttgaagataaaggatccagaaggagaagacatttggcttataccccagttgagctgcctgtgggagtggagctgaagccatcgctagaccgttaattccgctgctgttttcttttctttttaagtatgtaacgttattattaagatggatttgtatattaaaattgtcagtttgtgtacctcggctgattcctggacgaggattttatgcacaaataagttcggaaattactagtgaatttccgggcgtgacactatgtcatgtcttacgtccgtatgccgtggtggtatgttgggacgtggttacacgtgaggaagacgtgtcttgtgggtaaagatgtacacctctgatcagagtataatctattcgaatagccacgccctcggttatgggcaagcctagcaatgtacccaagttagtgttttaattcttaaaattttcttaacaactaaaatgtggaatggttggccttgctgggggtgtcttcttctgtttgttcatcaagatagtctttgatatcgaaagagaacagatcggctaaggcctgcaagaagaaatttgaagacagttgattatcaaaatgagttattcagccgattcaagattttcatagacaagacttactgggatggcaggagcggctggttgttcttcttcctcaacatggtgacttcctatagccaatggagttcaatcacttgatgtttgttgtacaggaggtgaagatgggggaggaggctgtaaaaagacaaatgttaagtaaatatcagctatgattggattaatgaaaataattatacacaatagtctttctggtggagctggtttaagtgttgttgctgccaatttcttacagcagttttctttttctacaaagatgagatttataagtgatcggctgtgaatgaaatagttttaaaaggaaatcagagagagatgtttacccttgagaaatgagctggggcagaaggagttggaggagtttgtttggatgaagccgatggagttttttctgtgtcacttacttcggctgcggcttgatcaacatcttcttcaatctcttcttcacgcaaagcttgctcaatggatggtgtcgacgggggatacccgtagaccggatatagagagtattggggtacgccggtataaggatctacgtagtacgacatcgagcaatcaaaagacaagaattatactggttcaggccccttgacaggtaatagccctaatccagttg

SEQ ID NO: 73762 - DNA, 9964 bp, Oryza sativa
  unsure (1)..(9964): unsure at all n locations
cggaccggagctcggcgggcgacggcggagagagagagcgacggcgcgagctcgattccggcggggagagagagcgacgagtggcggaaacggcggagggaggcacggggagcgtttatatagggttgggagtgagagagggcggtcggatgagggggaaacggccgcggaagatccggccgccattgatgcgccggcgaggtttaggggaaaagatcccgaacgaatccgatggagagagagagggaaaagtggggggaaagagggagggaatcacggggaatatttcccccctcttgattgcacgtggggcggacgggagcggcgggatttgcggcggcggcggcgctagggcacgggcgaggcggcgggagcggcgggaggtaggggatgacgggtgggccccacccgtcagcgagggtggcgggcgggcccgcccgtcagcggcacgcgcgcggggaggaggccggatgggccgcgggggagaggagagagagggagggaggtgggccgagccggcccaagagggggggaaaagactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagggtcgttttgggacgcgacaaacctaccccccttaaacggaatctcgaccccgagattcggaagaactggcgaagagatcgggatgggctgccttcagctcgtcttcacgctcccaagtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggactcgaagacatttcttgagttgtgacacatggaacacatcgtgcccgttgcccaaggaggcgggcagctccaactggtaagcgacttcttcgcgccgagcaatgatacggaaaggacccacgaaccgaggtgcgagcttcccttttgtctgaaacctgtgcacactcgcaatggcgtgacccgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaatagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatctggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcatgagcttcctgaagtatcagctgtttatgttctctgacatccggaacgcatacccgatttccgttccatagggttccatgttcatcctctgtgaaacccgcagctttaccctgtttcatatttttgaggagtccacgcatgtccgggtcgttcttctgagcctcgcggatttgatcgagcaaggtgggcttggcttccaacgcagccaagaatccacgactcactacgctcagattcagggcttccatctgttggttaagttcgggtggaaagccacggacgttaagagtgttgcaatggctctttcgacttagagcgtcagcgaccacgttggccttaccaggatgatagtgaattcccacatcgtaatccttgatgagttctaaccatctcctttgccgaagattcaggtccgactgagtgaagatgtatttcaaactcttatgatcagtatatatttcacagcgattcccaatgagataatgccgccagatttttagagcatgaaccaccgcggctaactccaaatcatgggtagggtagttgccttcatgaggccgtagctggcgggaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgactgtcttgggttgcttccaatcagtgacggcggtcactgttttggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaatgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgttttttatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcagccagttcatttgctgccatacggtagggtcgcttgtatagaggagtggttcctggagcaagatctatccggaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttctggccctgggtacagagtgacagtgcgtctcgcgcaatccactactccttggaattgagccaaccaattcatcccaaggatcacatccaagctcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggctgtcacgtggttcacacgaccccgaatgacatccttaccaccgttgttggagcggggaggcgcttggccttgctgacgcctcagctttgggcatttatccgcaaagtgccccggctcgaagcagttgaagcacagacgctgcggaccttgagcgtccctgcggctttgaccaggctgcacagttggcataggaggacggggcgcacgagtcccttgttgactctgctgctgctgcggctgtgggacgcgcaccacgaattgaggtcgaggcgcggagcgtggttgctgctgctgttgttcctgctgcgaggaggatccccctggatagggattggtgtagcggaccctttggttagcaccctgttggttgcggaaattcgccaagcggcgcttgtgtgactccagttccttgtgcttgtcttccaagcggatgctcttgtccaccagacgttggaaatccggatagtccccggagactagacggacggacagctcaggatccattcccgccaagaacttctcctgcttttcctcatcttcccgtacatcctccggggcgtaccgggccaggttgttgaactcatgcaaatactccatcacagagcggttgccttgcttcaactctcggaattcccttttcttaagggccacggactccgggcgggncacatgggttctccggaaagcagcggtgaagcgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgttggcctgctgggcgaggatttgagtgagaatggcgttggtgtctggtggtggtggtggaggcggaggaggaggtggaggtgggctgccctggtggttgtggttgctgccttcagattggttgccctcaccggtggcagcacttctcctggtcgtcaccatctgaaaaccccacccaaaaccagcaaacagagagagctgacaattaaagctaaccatccacgactaccataattcttgaatttattactgctattaaattggttcattaaagttcaagttgcttaagcaaataaaataaagacaggctccgacacagttacaccacacaccggcataaccatgccccacacaactccaacaagaagacaaacgagaaagaacacacgcgcaagcctactaactgctcgtctaccgctgcgacgggccaggacggaaggtgagcaacagcgcatcctccatgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcgacacttggggcgacagacctctccctgggtgatcttgagctgatgcagctgcgcctccactgcgtctaggtccttcttcagctgcagattctcctgacgcagctccaggatcttcatgttgttctcgaccatcccacgacgcaccatctgatggaagtcgatacgagccgcatcgtacgcctccaccatgcgcgccaggtgcatgatggtagcgtcatcctccgagctagcatcccggaaggtggcgaagtcgcgggctcctccgcgacgagggtggtagcggtagggcgagtgctgcaactcgtccgggtagccctggtgaagagtgccgatggcgaggagagcggcgctctggcaagcggcggggaaagaatctccacccgcggtgactgccaacgaagtccgctcgggagagccagtgaggatcactgcagtaacctcccaagcagcatggggctctgcatcgtcaccctcctgctccgggagcggcctgccctggtagtccactccatgcggataccccaggacaacgcacatgccccgcagctccaagacgaaaccagtcatgtccagaccacgacggctgacgctgccggccatctacaaacaaaaacaaaaagaaaagcaacattttaaaggtcatattttggcgataaatgaagcagcaggacagagagagactagaggattttcacaaataagaagggatttttattttgaaaatattgctaaggcttgggatctaaggctcgtcctagggtcaagggggctctgataccaacttgtcacgaccggaaataacccaacgggtgttccttacgtgcgtgcattaatccttgtcccaggaggcaaggtacaccaaaagttgatacaattcagagtttaacaagcggaagcgtaaatagttaatttattacatgggcagcaaaggcccagcacacacaaagacaaacgagaaacagcggaagactagggcgatgaccacaggcgcttgacggcaggcacgagctagacaccaaagccttcatcttccaggggctcctcttctgggtttgggaaaaattgagcaagactaagtacaaccaccgtactcaacaagatacacccacaagtgcagaataaatgcaagggagtacaaaggagttatactataaagggttagggttgcagtaaatagcatttaaagatatttagttgctcaaaactatttagtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccacagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctaaggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgcttttccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggagagggcgcgcggaccgggtccacgggagtggggccacggtggaccgggcgcacccggctcacaccggccggcgccgtgggtcccatgcgtcagccacacccgagggcgcgggcggctgacggccgggccccacatggcagccgcgggacgcgcccgaaggcggcgcacccgcgccccgatggtcgccgccggcgaccaccggcgcggcggagcggcgcccgagagaggggagggaagggggaagcgaatcggcggtccacggctcaccccgggtcgacggcgacgacgggaacggcgaccggagcggaggaaggcggcggcgcggcacgggtcgacggggacggcggcgttccggcggtcggcgaccgaaacggagaggtggacgaggtcggcgaggttgcggcgaacccgaagaaggcgacgccgaaacgggagaaggtccggggcgacgacggcggcggaccggagctcggcggcgacggcggagagagagagcgacggcgcgagctcgattccggcggggagagagagcgacgagtggcggaaacggcggagggaggcacggggagcgtttatatagggttgggagtgagagagggcggtcggatgagggggaaacggccgctcatttcttctttattcattgtacagtatgcaattccacgaagctgatagaactggagcaaaggttggatacgtcgatccaacaagaatatgcaaaacacaacacaccgtagagctgagagaagactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatggaaggtacaaaacaaccagtaaccgagcaggtcatcgaactcttctctacaaagaaacccatctcgcacacacttctcactgagtaccattttattttcctttctgtgtgcagatccccgaaatccca

SEQ ID NO: 73763 - DNA, 728 bp, Oryza sativa
  unsure (1)..(728): unsure at all n locations
gatgtgacctccgactcagtaagagcgaatcaaagctggcgaccgggggatgctttagagtctgcctgcaggcgtgcatgctagctaaacttttcttcatcacagcggattgtgctgagagagcaccttatgctgtgtgcaactacccaccaattcgcacaggcaaaatacttcatctctctctatctgacatagacgatggtcaaatgatgataaggaccatcatcaccatccttttcgctattaccaccactggaaaaccggggatgtgatgcatggtgattaagtctggtcacgccatactttatgaaatcacgaggtagctaacgcactcctcggaaggtatttcttcctctctgacgcttgggtatccttgctgcgtcttcaggagtaaattctgaaccggtgatgatcatggtcctgccattatccatcttccatatcactgtcctgttcgctccagagttgggctgcaaagtaccatccttcttgtcggtagactgacttggagcttggttactccctgggcactacttctcgtctttttcaggtgacctggcgaacaccttccatggacagttccttacataatgaccttgctcaccacagtcataacaggtagcacttactggncttttgtctgacgttgacttggctgtcgttatcttccgggatctggactgcattttgacaggggtctttcgtgctgatattgggaactcctgact

SEQ ID NO: 73764 - DNA, 745 bp, Oryza sativa
  unsure (1)..(745): unsure at all n locations
gttatccaccctacggtctattgtgccatctctatactaaccacctcgttaaaaccccgttgtggaccctcatatattcgacgtttcgccgaataaaccgctgcttcctggcctatggtaagtaatttctagaaaaatctctaggggtccaactctcaaaatctagtctctctagggtgaggcccgtgaatctgcagccgtaaaaaaaaacctagctcgattacatgaccggaaggatagtccgattacatcggatagtctgatttgacttagagaaaaaaatcactcaagaggaataaaaagcaattcaacacagagagtgaagttctgagaaatttcagatagtccgatgtatcagacaatctgaccttatatcggatagtccaatatttttgagccaacacccagaccaaagacagagagcaaagttttgagaaatttcggatagtctgagcatcggatagtctgatcaggatcggatagtccgacaggagaagaacaagaacacttcaaaaacaggatttcgagcactagtgttctaccaattataagcatgtggtatccctcttaatagtatgacatcctaatactaaagaacacaagatatacatggattagaagacaattaccacaaaagatgccacaatacttttaaactcaagttccactcctttttatccttgcatccatctcaacaaatgatgaactacttgcagtaanagggaattcatnngnaatcacatcg

SEQ ID NO: 73765 - DNA, 1241 bp, Oryza sativa
tatgggttataatttgattagcatgaaccttatatattggtttggttcagctaaatgctatatgtatgtttgcttagccatgcttagaaacattagctaattaaaggggattaaatataaattatattatattattcttattaattatggttatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttttgagggggagattatgatccaggaacggtgcactgttttgagttgtgttgtgcaaagagtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacactactcatccatgttaataatgtgataattaatttgactcctggtttggaatgaataattcatggtttggaggtttgatctgtacgaccggggttggttgttcaggtttggttgggcctaagcagcatgggtgtgctgtttagtgttgattaaaattgatgattaactactctactgttttacttatcttaaatctttgctaaatgctgcttttgcaaatgagactatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccattgctagaccgttaattccgctgctgttttcttttctttttaagtatgtaacgttattattaagatggatttgtatattaaaattgtcagtttgtgtacctcggctgattcctggacgaggattttatgcacaaataagttcggaaattactagtgaatttccgggcgtgacactatgtcatgtcttacgtc

SEQ ID NO: 73766 - DNA, 3710 bp, Oryza sativa
atattattttagctattcggaaattgaatttcgcatgcggtctacttaagacgcccgcatgcgaaaatagatcttcgcatgcgatcttcttaggtcaaccgcatgggaaaatatatcttcgcatacggctgcgacatgcgggccggccaaccgcatgtgaagatcgattccgcccgtatgcaaaaacgctttctgtagtagtgaacgttgaaggcgggaggagcggcgcgggcgggggaggcggcagcccccccgatggacgcggtgggcgtgccgagccggccgacaacgacgtgaccacacgggagttgggaggcatctgcgtcaagcattctcctgctggttgccgaggcaatcggcaagagacgacagatgaggactgactggactgcgactagcaagcggtagcaacaggcagtgcatgtgtgtactaacatcaagcggcaagccaacaagcaaagggctgactgacagagcaatgctgcagataggcacgcatcgtctcctcgccggacggtggggcggccgcggatggtccaggtacgacgaccctccccacccattcgcacggacggagcgcggccgcggaggagggggacgcgaggggcgggagcctcgctggccctcgagcgccccccgccgccggcgctccagctcccgtccctgcagacatgcgaaggggagagaagagatgtcggatataatcttgacttaattagttgctgcacattatgtgtatgtgcagatgtacgtggtcactgagtcagtcacgtagttagccattacttgatgattgcacgcagatgagctagtgattagttactgcatgtgcgtgtattagtgggagttagttgggttgttagtcgtgtgagctgcttacatatccatgcagtgcatgctgaagttagtgcctagagaataggtcgtgcatgagtggagttggtagctcttttgtgtacataagtactagataaatgaatgaaaatatgtggcatggttgccgagaaagcaagatgtagtttatgtgtccacctctgttcttcctccctacttgtaatattcttgtgtgcgtgtgtctaccaaagagaatttacgtgtttgtgattaacacctagagagtgagaggagatattcctaacaagagagaggagggagagagagagggaggaggatgaagaggagagaggataatatgtgggccccacatgtcagtgggttcacaaatttgctttgaatgataaataggtcccacacatattttttaattctaatgatacctaagcgccacatcaacgccacgtggacagaagatcgagtcaatactgccacataggtgccacgttagtaaaaccgccctccaaaaccgccgagggagtcaaattgcaccggttttaagagttgggggtcgagatatccggttttgtggtttagggtcacagattagatttcgatcacttttgagagtcacgaagtgaacttattccacatcggaatcagttgggcctaccagacaaaaatgggcctccatatcacacctaaagagaggggttgctcaatatataatccaacgcttggtattagctggtctgagctgatccaacgacgccaattaactgatgacgtggatgaataagagggcagcaaattagtattaactgcagtaagtgtggattaatcgtatagatatataggatttttgctatgctgactgcagttctcacgacgaccacggttgttgtcatcattgtgaggatgaggccacgattgttacgatgatgtcagcaaccgttgtcctcattactcctttggttctcgcgcttttccctccatccattgaggtgttgacataagtctatcagcttcatcgtttggcctaaacagtcaaagaataaaccaaaatttaaatttttaaacttaattttgaaattgattttgaaatgcttttaacgtaatttttgttaatgttggcttttaagtcgctacgaataaatctacagaagttttacttataaattaattttaattttctaataagccattttggataaaatgggcaattgatgggagcctacatcattattggggggaggagaattgcgtgttctccatcatcgaggcatagattgatcttgattgtggttctgacttcattattttggccttctgcaccgtcttggttccttgcgggagattggtgatttgctgaatgtcatccctctctttgttgattgttcacagttttaaatgtagtatcgaggttggctgtcatagacttcatatgttccaaccaagctgttgcatctggattggtcgttgcattgttggggatttggtccagcaatccatgtacataggtcaaatgctcggccggtgttagagcagggtttgttggaggagtatgttgtgagaagctaacgtattcaccttcctcatgggatgctcttgctccagcactggttgccgcttccccttgattaggatcattaaccttgtgttccgagttggccccctcatcttttcgcttatgcttatacttatcagccaaaatttaaattttcaaccttaaatttggagttgattttaggattttattcattgtagtttagttttcagcatttgagcctttgcttttatatcgtcaagaacacgtatataaaagttttatgcacaaatatttttcatttgtaattatgttgttttgctttttcctccaatatgcctaatgatggggttgtaaaatagccccatattgcatattcaggcatataaactatcacaaatgaaaattttatcaattagaaagttgtttatctcattgagctatataactttgatatacgtcatgtctctatctgagatcatttaaaaaattcaaaaaaaaattccaaaatagatctcatcatttgtaacgcttatttgaacatgtaaacaatctcaaataaaaatattgaggtctacaactttgatatagggcctatctccattcaagtctgtctgaaaaatttaaaatttatttttcaaaatagatcccatcacttagtgcatattcagacatctaaacgatctcaaataaaaatattatcaattataaaattaactctacaacttttacataaagtctgtctattcgactacatacacatttttttaatacacatttttttatcaaattttataaaaaaaggttgtgatttaaatatattccctcatgtgtgagggttcgtaactgccactcatcatagatcatagatatgtgtgatgtgtcgtagttacgagctattacgatgacgggtcataaatatctttgatgggtcataagcagggcttcccttactgccgtaaccactcttaccgtgggggtacggtaatggttaccggcggtagggtttgatgaattttaaccaaattcaaaatttccaaaacaaatcgaaaaaaacatggatgtagttcttgatttgtagtggcggatggtaaagaaatttgatgaaaaagagtaatataaaataacatttgatggtaaaaccgagagtacattagaaaatggtaaaaaaataatgcaatggacctttaagttgcactgtttatccagcaaattaaggcccaatagtggagaaaatatatatagggtggctgggtgctacatatggacatcattatgatttgaaatgtgaggttgttgaattgacgttgttgacttattatgctatgaa

SEQ ID NO: 73767 - DNA, 1144 bp, Oryza sativa
  unsure (1)..(1144): unsure at all n locations
attatcctcaatttttacacatatttatgtttttttccattttttttagcattggtctgttcagctacacaactcacggttaccgtgtcaaaccgtgcggtaaccacgatcaaaccgtgaaaccgctattttttgaattcaaatgtttgctgacgaaattcccatggtttaggcggntaccacntggctatcgtggtaaccgccttaccgtggggatgtaataacccccctccaaacggtaagagaaaccatcacagatagaagtggaaacgagccaagccgagcctggcttggctcgtgaaagcttggtacaagggaagcttggcttggcttggctcgctacaagcaacgagctaaaactgcagcttggcttggcttgataatgggctcgaaccagctcgagctggctcgcgagcctggcatcaagtaaatctccagcacgtctaagagaaatcgagcaacataataccatatagaatgcgtaataaagttatatttttctttaatatatcatcacaacacgataaatagataatatgacaatcaaagttatcattttcaaccaataaatagttcaaaaatgtgcaatttttttgtatatgacctattctattgagtcaaaagagctcacgagcggctcgtgagccagctcgggcttggcttgtttcggaaacgagctaggaagcagtcttgggcttggcttgtttggctttcgagccgagccgacctatgcgagcctgaaccaagcttgagccgagctcacaaggccaaactttttgtccacccctaattacagatggcctgtcaaggatgaccgaatttgtagcagtgatggtgcacaccatctatatttatatttatggggtagtctgcgttgcagagattgggacatcaatcttttgcatataattacagctttaaaaccatctataacctattggaacttatatattcaaattcaatagctattcgaccaataacaacttctctcttcgtcccaaaatataacacttttacgatttagaatttgtcacaaaatataattacgtatccaccaatattttcttcttgatcaatcacaaccctccaccatttaattttcccatttaccttcacttctcatccaatcacaacattcccctat

SEQ ID NO: 73768 - DNA, 1194 bp, Oryza sativa
acgccggtataaggatctacgtagtacgacatcgagcaatcaaaagacaagaattatactgggtcaggccccttgacaggtaatagccctaatccagttgatatgggattatatggtggaaaacacagattacaaaggaaaagacttaactcgggagattcgacgagatcgtagtcgagatgatccgactagctctcgtcgacttggctctttgtaggctctgacttcgtaggctgtgttggttgtctaggctttgagattcgatgagctatggctccgcggggggtcccttttataccgtaggttgggcgatatctgagtaggactcggatgtaccaaacctggtacgatacgtaggtaacccaattcttgttcgagaaggtttctccttgtttgttgtctttacgaagaatttccttaagtgctagaggatttatccatatacacgtggatataccttgtcgatacgtgacgtatatcgtagggtgaagggtatgcctaacccgtaaccctgacagtagcccccgacttctgctcaaaaatgaactcgtgagaccgtttgcgactccaggtgtcgagaacgttgccattccaggtgcgagaaccaaggagatgacgtgtaatcgagcgcaccgtttgaagtccaacggtcacgaatgaattttgaactgaagtccaaaaaccaccatgcacaacggacatagaaatctccggcggggatttctcctatttccttggaattcgcaccgtcgggagtgcgtctatttaaaggtatttagggcgtgagctttgaggtccgcctacttcattaagtatacactgctcctttgcattcctcgccttcctcgccgccgcaaaaagccctagcctcaccgattcatcgtccgtttccggcgatcttccggcgatctcccgacggccatggatcttgggaagtcgacctccaccgccgcgaccctgaagaaacttcaggaggagggtggcctccctggccacgacaaggcagagagggaagcaggaggtactactccccagcccgtcctaggtcgcatggttgcgattgaggattacattgtctgcgggtttcttcctcccccctctgaattccttttgctggtcttaaacttctatgggctttcacttttgcacttgaatcccaactccatcgcatttctcagcattttcgtgcatctt

SEQ ID NO: 73769 - DNA, 49761 bp, Oryza sativa
  unsure (1)..(49761): unsure at all n locations
cacctaacccctatgagagaaaaatatttgtcaacaaaaagaaaaagtacgtacatacatacgagagattattattggctagaaaaaaaaacatacttgcgtataatcggaaatgtcacgtggaaccacattatatcccttataattatgtgattctcatctaaatagtgttaacaattagcaccccacaaataaaacaagtggcacaaataattttgacaatatagattattccatcgtatatatattacccacgaagttagatgtataataaaagaaaaaaacctatattaattaactcatacgtttgagaaacatggtgacaggcgagattatatataactggaacaaaatgatttttgtttgaacatgactgttattatcattattatgtcaaaatctttgatctactccacggtataaatatttctcttttacaattataagctagcgtgttgttaagatatgacttatttcagtattctttttataaacaataaataaattggccgcgcatctgcgcgggctttctttctagttatcactataatagctggaactagaaattttgccaatagatattactctcttttgaaaaagagtaaattgctagcggtccttaaacttgtaagtaggtttcatctagatccacgaacttgcaaagtgtgtatcgaggtccctaaacttggtttattgtatcatcccggtccaaagtctcatttgaccgtggtcttacctacgtggcatgacatgtagacgatgacatggcacaatattattattatttctttttttttctcacttcttcctctctcatttccctcttctttggcctcttcaacgtgggggagctcgaggtggctctagtggaggaataagataaaagaataggaggaaaaaagaaaagggggaaggaaaaaaacgccatgtcatcgtccacgtggcgtgtcacgtagacaagaccacggtcaaacgacgctttggactgagataatacaataaaccaagtttagagacttcgatgtgtgctttgcaagttcgtagatcttagtgaaacctcatgacaagtttaagaaccgctagtgcattttactctttgaaaaatgtactgaagtgttaagatacctgatgattgttctgtcaaattggggcagtcattcatatgtatttcgatactgttgccacgtagcaagccttcggaaatagaatgtagcgcaggacagcccgacaaacgtataacttggagagaaggttggtgctctaaccattctggtaaagtctccagtttgttgcaattgtcaattgccaagcttctaatagaagaaatatgttgcagaccttgcgggaggcatgtcagctcatgacacccgcatatgtttaacttcttgagcctggcgagatcttgcaaaccctcaaagttagaagaagattccagctcttccccaaaacagattgatatttgttccagatttcttgccacacttctaaggcctccttttgaaccatataacatcttgttgttcatccacaaggtcaacttttcaacagatggaagctccatatgcaaagcactcaatttggggcagtgaataatttccacttctgcaagacaaggaaacgcacccgtcctgtctgcctgttcccagagttcaaggttatgcatataagagaaagttaacttctccagagaggggaatgtgccattgtgaccatagaaattgttgtcaatgcaggtgatactttcagctccacttatctcggctatcctcatacgtggtagtatccccagaggaggtaaggatttacattctgtgagattaatcagtcttatctcaaccagagatttaagatatggttcggtgtgtgtcatccaagatggaagcttatcaccttcatacgcaacaagctccagctctttcagctgttgtggcggtcgaagaatctcaattagttcataggctgctgtattggcatgttcagtatccatgttccacctcagtgccaatgattcgagttctagcttatcttgcagcatggcatctcttgcatctttcagatccaaaacattttcaagtctttctaagcttagcctgtgcaggtttgccaaaggttgcagctctgacagcataactacattgctgtttgaaacaacataccctagcaatgtctgaaggtttttaagatttccgaatctgtgaggcattcgagtaagtgatgcacatccaagaacactaagatactcaaggctattaattttactgatgttctgaggtaattcagaaagatagcggcatccttcaaggtctaacttgtgtagccgagaaagcctgcatatatttcgatgcagtttttggagctttccacagtaggataatttcagagtatgcagaagttgtagtttggatattgagctggggatgactctgatatctgtccctgataggttgagaaatgtcaagtggaagagtaggtcgaatttattagggagcttcctgatcttagtggcttctaaactgaggacttcaagatgtcgaagtgtttgacacaattcttggggaatctgtttgatctcacactgccgatcagatgagcacgttttcccttcctgtagcaaaataaatgtctttaacatcttcaattgggacatgcaaattggcagcgattccgtggaaggatgaacgagcagtgatgcactccgagtagacaagataatgtcttgaacagcattgaactgaccaactctgatgattgagctggaaactctgtctgcatattgcacgaagatgtgcaatatcttgtgcatcctgtacatatgcctacctccatgatcatattcttccaccggataaaagcactcatcaagaaactgttggaggaatcgtattcgttgggcttcaggcacggtcgacggtataaagcctttggcagcaaaaagatcagccagttcttcagcagtgaagttgaagtccaatgggaacagcgagcaaaaaagaaaacaattccgcaattcggacgagagatgctggtaactggcataagctctctgaaagacatcagtcagttcttcctcttgttgaatcctccaagaaccttccagaactcttttccaccggatcagagttagctggtccctttgaagtataagaaatgatgtgtactctaacagcagaggcacaccggcacatttttcgaccaacttgataccgtactcgtgataagggggaaggtacatgtccatgacgtgtttggaggattcctggtccagtggttgcaagaagtaagcctcagtggttcgcatgacgacggccgtccgtggtatgatagagggagttcgtgtggtgagaaggatcctgccatttggggggaatgccagcataaggttgtcccattcaggccagtcgtgctggccaacattccacacgttatccaggacgaccaagtatttcgctcctcctcttagaacactggaaattacttgttgcagataggatggcccatccttcctatcgaccaaccagctgcttgtaatcgtactgacaccctcagatagatcaaaatgtggtgagagatgcacccaatgccgcacctggaacgcctgcttgaccctatcgtcgttgaataggaaccgggctagatatgtctttcccatcccaggccctcccactatcggtaaaaccagcggcccgtcgccctcctcctcctcgccgtcggcgagcaacatcctccccagcatcttctccgccagctctgatctccccaccattggacttttgacatagtcgtcgggacccacatcgttcgtcgaggttcctactggatacaagtcttcgtccatactctctccagactctggcacggaggcaagtgattcctctagccccgcaagcttcttcaacaaactcctaagctcacggacggtggcacggcgaaagaagaggttgctaatgtggagagcggttacctgataccaagaatctggttccacctgcctgctcaggattgcctcaagctcgccgcgaaggtgggcgaacaatcttctcgcttcctcgagacggcgatcataatctccacatgttgccaacacaaggcatttatctcgcctgtcgatgatattgttgatgatgttggggaagcgcgcgatggagtcacgcactgcgccgagcagggcgtccaattccagcagccggctctggctctccatgcgcgccgagctcagaatgtcgatcaccctctgcagatctgctgcgacatccatggctccctgatactcttaacgctctaacacctctctcccagtctgcttctcggctgatctcctcgctcccgtagtcccgtcgcatatagactacagagttggctcctctgcattcatcctgtacttctttgactagatccatttctttaaaattcgatgggtagtacagatcacacaccaaacctaaatttaaaccagaacgcatatgcacgggcatctaatttaatgttgcttgaaatattactctacacatgtggatataatatttgtatatacgtgatgattctattctcaacctgttttttttaaactagctgggtggcccgcgcaattgcgcggctagcacccaaacaaaatcatatatttttttagtatgattttacttaaaatttattaaatagctatctcattatcttataatactttaaaagaccaaaccttatcatcctcgtgtttttaattatatagtttttaaaagtcacaccagttgctaccccttatatcatctccttctttatttgcttgctcgatctaccactatttctattcattcttcttagaacctttaaaaattggatttcatagtttttagagtttattgtcacgttgggttttgtttttataatttctagatgtcccgtcaaacgttaccattatactcatctatggcccgtctactgtttcttctctttattgtcattgaaattttaaaaatcgaacataattatcgtttgggttcatttttactttctagaattcccgccaaaccatcagcggctttgccattgtactcctctatagctcgcccgctacctcccttctttattgttattgagattttaaaatcgaacatgattatcattgggtttttttttactttttggaagttccgaacctttaaaaattggacttgtagttttattttttataatttttagaagtcccatcaaacgatgccactatgcccctctacagcccgtccgtcgcctactatttatttttaattcatttttaattttttagaagtctagtcaaccgtcggcagctctgcaactatactcttatacaccctgcccgctgcttctcctttttattgtcattaagattttaaaaatcaaatatgattatcaatgttttttttttactttctagaagtcccagcaactgccttacttgtttgcttcatggcctaactgatgtccctccttttaatcgtcattacgattctatttggtgttttattaacaatttttatatgtcgtatcaaccgccaccactctactcctttgtaggcatgttacttaatttatctcgtcatgtgttttagatggtcttttcttttaatagtctttatttttatcacaaattttagttatttataaattgtattcctaattgaaaacttatttttctttttctaatttcagaatttaatttttaaaaaaattagttaatatcatattatgttcttttaatgtttttattttttattttcaatttcagttgtttcaaaattgtatttctacttgaactctcctttccttttctaatttcgtattttattttatttttattttgaattttgattaatcttgtattgggttcttatatggaaacttctttcaatattgcttatttttaattccgaatttcagctatttttagattatactcctacttggactgtcctttccttttctaattttggattttattttatttttattttgaattttgattaatctcgtattgggtttttatatggaaacttctttcaatatcgcttatttttaattcctaatttcagctatttttagattatattcctacttgggctctcctttcctttctaattttggattttatttttttatttcgaattttgattaatctcgtattgggttcttatatggaaacttctttcaatattgcttatttttagttccgaatttcagcaatttttagattgtattcctacttggactctcctttcctttttctaattttggattttattttatttttatttcgaattttgattaatcttgtattgggttcttatatggaaacttcttttaatattgcttattttttattccgaatttcagctatttttagattgtattcctacttggactctccttttctttttttttctttttctccgattaatgtgggaatttctagcctccacagcgaacgtggtgccttcttttcgagctgtcttaataatataatagatattttgtttgtgactattttgaatgctaattatccttgcaacacataaattctaaataaaaattacttacaaccatgaaatcttgaattctaggaaagtattatgtcgcaacaatagagttggttcctatgaactgtcatctaaactatatgttctttttaatacatatcaaatattcgcgttggagtgataaactttaagaaagttattttcttaagaatagttattgaacttcaagcaaataaaagttccaatgatttttgcagtttgttttgggctttggattcaacaaaatttgtttaaatttagcccaaattttgtttgaattccatatgtcctttctacttcttttggagtattagaggtctatgttctatcactcgttcttgaaatgcttttgatctctttaaattgggacataaacataactgtgttgagtgtacaactcgatatgggataaatgcgtcctttctaaaatcctgcctctaaaattgagccaaaaaattataacagtagacatagtatgttttacttcctctgagatcaatatctgtgttgagtgtacaactcggtatgagataaatccgccctttctaaaaccctgcctccaaaattgagccaaaaaaaattataatagtacacatggtgtgttttacttcatccgagatcattatgtatgtgagacatcaatgtgaatatgcattaagggacacgcaaaaattctattttagctatcgcagaaaaaaaaagggcaaagaaggcgcatatgtacgtacttgttgtagccgtggagaatattttagaattttatttgttagatctaactgtctagaccaatcaatttattagaaattttttcaccataaaagagcataatatcttttaactaccgattctaaccaaaaaaaaaaagggggaaaaggggcatgataaggaaacggctatggtggttgggaaagttatagcagcaaaagccatcaaatgagcaattgtcccaaaataactgaagggagtagaagagaaaattgtggttgggaaggttatagtagcaaaagccattgaaactaatattttatatacaggaataattcgttttgttattaatgggaaaaagtgtggctaaaagaagagaaatcattagaaataaatgctccctccatctggtttttaccctttttaccaccccaccctcacctttcctccatccatttttttcactttttaccccccccccccctccgtgtttctttttctcctttccatctcatccgtgccccattgaagcgcccgataaattattaaccatctagatttttttttagttttctcgttccttcttttcagatcttttttctcatttaattaaaatatttaccatctagtttttctttctgacttttatgtttttatagtgtttcccatgtttcaatagtaacaaatttactctttagagttttccatttgctcccatcctcccacttctgtatcttcaaaaataataaatttactcgcatgaatgcccccttcacaagtaacaaatttacttgcaagaatgcccccacatcgttcggcaccattcctagatggccttaaaaaaatactaccaacttacaacgctagcaattcttttaccagtgttacaaatattgtttagacttcgtagtctgcaagtaaaacaattatcacctttctctcaatgtagtccatgttcaatgtagtccatgttctcgtagtcaccacatagtaatatatttactcatgtgtttaatacataatacatgagtaaaaactgatactaattatttttcacagagtattgttaatttgaatcacaaaatgattgtccgaatgaaaaattcataggctcaatcacacaggtgaatcaaactagaaaagaaaaaatggttcagctaaaaatccatcttgaagttgggatcctagtggctttgctggatcttgcgacaaggatcgagaggctggtctatatcttgtgactggtggtggagaaggcaaccgggtggcaagtgacggtgggctatggaatcacggaaggatgtagtggcgcggtatagagatgagctcggcaatacccataaggccatccatcgtctagcaaccagaaaaaaatgcaaaaaaaaacattcttgttcatgtcacagagacgacgagcaaaaaaaaaagcaaacaacctttgtcaccggctgactccaccatatactctgcagccagccacatggagaacgatgtgcacatgtagaacctatgcagcacatcaattcagataaggtaattgtgcagattgcacgctaatttgatttttaaaaaagaaattggtgttacatgcgtgaatgtgaagtataatatccatatccaaatggaattgccattaccttattaactcctccagtcaatgtcgtcgccgtggtaaatgatgtggagtacccgctggttgtttctcttggcctgggtgaacatctcccccttgctggcgaaggcactgcccggcgtccggcggcgaggcccggagcttcatcgtggcctttatgctccacgcctcacctcaccggttcaggcagcagcactgcagtgcagtccatccaagaaacgtacagcgacaaaccgacggtgaatgcactaaattgccagaaaggaatcaatcgcttgatgggctcacctgtggtggcgatggaaggagaagcgaactccgctggctagagaccatcccctcttgcatccgtcgattgagcatgtctctactcactatccagagaccacggcttgccgctgccaccaggagagggaaagggaggcgcgtacgcacatgagggggctgatgaagacgatggcgatggctggttctcccgtcttcgctgcgtgcgagatgggggagcacacggacgaggttgagggtgggaagcccccccataaaaaaaggtcggccaccaccatgaaccgtcatggtgtcatcatcctcctccctggtgcgcatcgctcgccgaccaccgctgtcaaccgtcggggtgcatcgtcctcctgcatggtgcgttaccgatttatgggttgggacggtggatcgattcagatcccaaaaaaataaaaaaatgaagtgtggtggagaaagaggttggtcgggtacaggaaaaatagaatatataccggaagtagaaaatttgctttatcgaagtaaattgtttactctaataatggtgagcctggctgatgcatgcttggagtagtacttagcgcgcgctgcgcttgtactagttactctattaatatgatttttttaaaaaacaacttttccatataatttttttacaataaatacgttgtttagcagttaggaaaacgtgctcgtgaagaacgagagaaatcttctctcaatcaccaactaccgaacgcagcctagctaactctcgtaatatctagtctgagaaaagaaagttagattttacttataagtaattttgtaataatatattttttagatattatcgttgtattttaatagaaattttgtgatcaaagttctacaccaaacatcaaataaactcagtggtagtagtacacccttttctccctaagttatgttatggggatggaaatgagctcgctcattttctccgatccataaatgtactaccacgtctccatttagttgtggtactgttgactattatattacggactattgacgttaatttattggtttacggaatctcgctaagaaacctaattgactttatttttttaccgtgctgaatttctaaacaacttgcaacagattgtccttctttttttctttactattttatggaattgctaaaaaaaaacttgcaatagatttttttaatttggggacgtcctggaggaatggaacatgctgttatgaaattattgtgttatctcatcatccatatattggatgggattggcaactgaagattaggcatggcttagtgaacaattagcacatgttaattctgtttggttatgaagtcctcatgatcatgaggggacgtccacactatgttcaactacaagatactcctctctcgctctcgctttgaatctcaacacgttatcagaaatgcccgtgaaggagaagatgaagagaaggaaatcaattgcgaagatacgatgcctaactttggtgtgatcttggatgttgttctcggcctctctcattggcaccgcactcaccgtctccaccaccttcttcgccaatcgatgaggttgcgctggggctacagcgccagagcgaggattcggatcggtggttggcgccaccaaccccggcgttgtgtggtcgccgatgtcggactggttgtcgctccgccggccccacactcccacttactcactctattaatttgcaaaactccttaaattttctattttaataatttgcaaaactctttaaattttctattttaacttagcaaatcctattaattatgtataaaatgattaatgaaggatttaatgcatgttagactacatattttgacttacaattaaaacatatagagatgtagccctatactttacctacaatagtcataatctaggctaattactaagaggtctacatcttatgatattacgtacatgtgttatttcgagaatatgtttgaaatatgagattattttaaatttggatatgtacaaggtagtagaatcctaaacatcggttgtggtatattcattagaatatatttgcttagagatcatgtttttagacagtgagtttatcttgcccactattaagagatctactccacagtttaattacttggagattatccatattgtgctgtctaattttaaattctaactcaacttgtaaggtctatattctacattttctaaacatgacaaaatatgatgccttatatttttgcattgagattactgttggtatttcttacgatcacaaataaattcgtaagcgcacggataccgctgtagcatttcaccaatgagtattccaagggtattgtatttatatttccacaaggaaggtgacggtatgaagatatgtttatatctctttaatcaacctatagttaattcaccatagtctaaaaaggggttaggataataaatgataaggtagtggacacacatgagattcacctctataagaatatcgagtatggaaatagctttaggaaactacgatttgtatgtacttctatactaatcatgtctagtatacacttaacatatatagatgcttacaacatatgacttagttctaggcacccaggtactatcgagagaccactcccttctagtctgccagcgtgattatagcatttatgcactcttacgtcagagccagacgtgaaggaatacaaaggacagacaacgctatcaccacctgccgcctgcctcactttccgtggggcacacccacatccaatggcatttatctagcctaagcacatgcttatgccggtaaataatatcactaactcccccgagactctcaccctatggatgaacaagttgaaacaagagcaatctataaaggttattggactgttatcatagcatggatcgactagtcaaagatgaagtatatatacaaagtatatactactcatatgacatatactcaataaagaaatatataaaccataagcataaataaacaaagtataattctattaattcaactgtattcttacacaaagagggaaatattagagacataccaagaactccaacaagactataggaccgaagctcctaagctttattccatttagaaactatagagaatacaaagtggaagagggaattgctccttgaggtgtgttgtgggatcctctatttgtagcctcctaataacggtagttaagtcggttgtaggtcgaaaaacgggtataacagtcatcaaaagtgaaggaatcgccacgtggaagctcagtggcgcgggcgccaagattggttcggccaccgcctttggtgagggaaattttattctttttgaaaaaacaaatgctctagaattccagtatcactcagagaaagatcataacaactctatttcaccaattcatatccaacaacaatctagatttagatcatgctttatgcaacccacaagtttcatgttgaaggcaaagatttttttaccaacaaactcaaaaactatagtgaagactaagctgtaaactattccctccgtcctaaattataaggcctatattttttacacgatcttcagtaacatattatgaacattaatttattccatgttatattcccaacaaatataaattagcatcacaaaaaagtactttaaaacaagaatctagtgatataacgtgcataatacttagcatatatatggttagtatgattattagttaaaagttaccgagtttgattttccttaaaaaaagagggtgccctataaattggaacgaagggaataaatactagatagaaataataacagagcaaatcatttcaagtgggaaatcttaaaacattcttatcgcgtatatgatagcttttttggtaatttttatgctttgcaaccttttgtcgtttttctttttctgattcaataaaaaatgaaagataaaagttaccttagtggaggagagagcccccaagctagcttcttgctagggtgcatgatggggatcgaatccatgcgatctgaagtagaccgtcatgtcagcctgactgctgaatggcggcgttgatgtccgtcatctggtcacagcctcactggtatgctgctgccatgagtgggtttcctggacatgctggtttagcatgttgtgcatctcatttgtccggagatccagatctcccagctgccgagtaacatccgcaaatcctcgtccaaagtcacgaaaacttcgataggagaatgagtagtgtgcactggactgcagggtgttaacaacaaaaattggtaagatatacggagattgcaatagattcgatgcggatttggatgagataattcggtttctaaaattagagttgcgcatcggttgaaaacaatatcggccaattttatataggagtcgaggagaagatctgaagatattgccaaacaaaatgaagctcgaagggggtaattttatatattaattaggacaagagtcacttttcctcaatgtctttgggaaatctttgttagaatccgggatcgatggactgacctgatgtgtttattttataatcagctcgagtgctttggtaaattgtgaagatcaaactttaaccacccgccattatgtggtgtaattaatgcagggtattttactaatcgcctataatagcctggctccatagaacgaaacgcccggccagcttgttcccacgaggcacagctagctggctctccagcgacgtgcgctgctggttctccagcgaacgtcctcaagaaaaaaaaacaaatgttaaggtgacttttatttgtttaggtttaatggccgagctaacggctaagagtaagtttaataatatagctaaatgttagcttcaaaacatatatagctaatctagttaaaccattgatataatagtcattacctatgaaaatatactacaccattaatacccggtcacatatttcatagacacacaacctcttgagtccagattgcagctggctataaatttatagtctgttttcttctctctcttcccttttattcctgatatgttattatagctggcttatagcctgctattatacttgctctaagtataaactcaaattctagaactaatatgctgatccatgtagaactaattaataaataatatcctagctaatttttacataaaactaacacagtacacttcacattttctttttctccatgtgtatttatagctaagcagtgttaaggtggtgtttgaatctcatgaagatgaagattaagttagcgcacgtaaaaaaacctattagcatatgattaattaagttttaattattttaaacttgacaaattgatatatttgatattttaaaacaactatatagaaagctttcacacagaacgtaccgtatagtaatttgaaaagcgtgctaacgaaaaccgaggtaaaatctatatcttcatgagaaaagaacaaggactctcatgttaaaactaattatacattactccaaaatatatacattaaatatataagtttcagaaaaaattgaagactatctcatagtcaatctattatacatctttaatatgtttgaattgttgtgttcccccgcaattaaattaacagttcatcacccatattgaccatattttaactttgtctcatcacatttgttatgtcatccaaatgaaaatttataaaaaggagctgatacagatcatattatcatagattacttcacatgcacgcatagttaaattatatataaagaatattccaaatcgttgtattagattttataaaagcaggtccacgtggtgcaactactgggtgcaagccacctattccacagtcccatcacggcgcgtcacgcatgcacgtttccttgtgggtcctgaccttctggcctctcctccgcttcacacattctccttttctcccccattattctctttcagtagttgagttagaatatatttgtaacaataaatttttgaacagtcgtaacttttaaattatatatttaattttttatctcttagcaccatcgtattatttatgattaaaattacaacttaagcctcatgttaaccatttttttttgaaacgaaccatataaaatagtgtgagattttatattaatattgtagagtgtgaggtttcatattgatataacataaagaaatagttacaagaccatagccctaagatgctataatgagaaaaaaataacaagtcacaccacgcgtttgcaaccaaaagaacacgatatggaagaaaccagagtgcaacgtcctggttgcactcaactccatccacgtctttggattggagaagcaaagggcgagagaaaagatagatccattatcccatgcacacaacccccgctaacatgctcatcttatgacggacggaagcgccaccacaacaggacagatggaatggaaatggacgttcaaagtgatgcatgatcgagtatgctctatttcctaacaaaggttcctatctgttgacgcaaaaaatgttgcagacatcaaggcctgagatatttggtttctctagtgcaggtactatcaaattgggttcagagcgtgtcagttagtttgatcctacaactaccaaggttataaaggaaatattagtccttgggccaattggctttgaagccgatacgaaatcgtatactgagagaatgccgatagtgattgctggtctatcggcaacaaccaatggaaataaatagcatcggccgtaatatggatgatgatgatgatgatgatgatgatgatgatgatgatgatgatgatgatgagatacatacatacatacatatagatatatatgcacgctaaacctaaatcttgttataatcaatctttgtagagcagacccaactgagacaatatgagattcaacaacaataaaacctagatttaacaagtatatatgatttccagatgtaggctaatgtatttagatattaattagaacttatcattgttcattattagtgaataaactaaaatcaattctagtaaaccagaatataatcggtaataatttgtagctattacccacaatcttgatagattgggcctaaccgagacagtgtaacattgaagataataaaaacagcaactagccgattatactaaattttgtaaaccaatcaataaaatatttcatattatgataagtagataccattacctcatggactgaaactctgatgaaactatgataataacttattggcttgaataaatctaattaacacacgataacctacaagatcggacctaaccgagacaattcaaggttaataatatgtctaatagatttaaactagccgatagatactattcagagtgattgatatagaaaccctatctagaaagcaaaagcaatcgaagcaagagccgatatatctgataagcaacacaagcagaagaagctctatggtgtcaaaagctttctcaaaatcaagcttaagaagaattatctctctcttggactgctcgcactgatgaatgtattcaaaagaccaagctaaacaatcttgaattgtcctgcctttaataaacccatattggtttgtatgaacaagcttgaggatcactccttgcatcgtatctgccatcagctttgttaagattttcaaacttataatcatcaaagatatgggccctataatcatttactttttgaggagaaagctttttaggaacaatagtaatgtaggatgtgttgatgcattgcagatcagtgcattctgcatgaaagtgggcagcaagcctttaaaagtcatgtgtaattataggccaacatttcttaacaaataggccattaaaaccatctgatctaggagctttatcaattgggagcatagagatgagattatcaatttactgagtgaagaatggatcaatcaaactctccaaatttttaggggtaaatagagacttagatttagggtctctttggcagagctttagtttcaacttcatttctcctagagctaattaagtctagctaaacaaatttagtttcacctaaattgaaaatgaagggggaattggatttagcctgtcccagaacagacccttgtgtaggggattaacgtaggggatccggatcgcaaagaggctagtcagtcattcagtcccgatcacggcgccatgtctgtcgctcagtccaaggagcgtggtaaccccgcggcccgcggcgtcgaggaggacatcctcgtcccactcctcgcccgactagcaaccatcaggaccgtcctcgacaacgcgccggctccaagtcgccgtcgtctaccagtgcatgtgcgcgacgccgaagaggatgctagggtcgaggcccgcgcgctgctggagaaggtccaaggagagatgtcctacctccagcgcgtcttccgccgcattgacgaagccgaaaatagcatcctctacggcttcgaccctgtcgaggagcagatcgacgacgcgctccagcaagcgcaggttgggcttgacgtggagcaggtacacgaggctctcctcgccgtggacgccgacatcgaggtcatcaaggccagcatccgcgaggtctacaggttcccctgcgacggcgacgaacgccgtggtcccccaccgccgtcgaccgcgccggccacgggcgtggtgatgacgaggaggatgggggagatccgtcgcggcccgcagatgcggcacctcggcctcgccatcggcggcttcgaggcgcggctccgcggctgcgtgctcaccctcgccgcgttcccggagtgcgccgtgatcaagaagcgcctcctcatccactggtggctcggcgagggcttcgtccgctccgccgccgaggggaagagccgcttcgacgagctcatcgccaagggcctcatcgtcccgatcccgggccatctctgcgccaccgtccaccgctgcacggtgcggccatggatgcgcgacctcctcaccggcgtggccaaacgcaccgccttcctcgacctcgactccggcaacgacttcaccctcgcgcgccgcgcgtgcctgaacgccggcaggatgtcctcggggttcagcgccgaggcgagagccatctacaacatcgaccagaaatacctcgagctcgacgacgcctggttcgccgggaagaaggagctgcgcgcgctgcagctcggccagtggcgagagttcggccccctcgagcagattgccaaccccatggacagccacatcgagctcagcggcgtcgaacacctcgcggacatggagagctgcaagaatctcaggtacatcagcttcaggggaatctcaagaatcgagtccctgcccgattcgatcggcaggctgcgtgagctcaccgtgctggatctccgggcatgccataatctggaggaattggggcaagggatcacaaggctggatcgattggggtatctcgacttgtctgagtgccacctgctcgtcggaatgcctaaagggattggccggctcacacggctcgaggtcctcaagggatttgtggttgcaaatccaagcagaagagagccctgccatctcaatgagctcaccaagctgaacaagctcaggaagcttggcattgtgattggcacaatggctgttccgacagatgatgagttcatgaaattgggcgagttcagggcgctcgaatcgctcaagatcagatggggtgtgctggcttctgatagcaaagggaaaattgaagcatcgtcgcatcaaaaaccgatcgacaaaatgaagtttgcgcttcctccaaatctgaagaagctagatctccgatgcttcccgctgacggatttcgctcagtgggttacaccgaagggtgttaagaagctgtacattaggggaggaaaactgatgacacttggagatgaacagggctgggaggcagaggtgcttcggctgagatttctgaatgatctcgagtatgatcacgatcggcttaaacgatcattcaggaagctcaaacctgaaaatacagagatccatgcatgtccaaagttcatccgtggacaatgatccagatatccagtgtactggtcgcctcagcttgcaacaacctgtactggttgctttttctgaaggatatatgggctggttttactgctttctattgagtctttgaaaaagaaaagaaagagttaccattctattctccttcacaagcaacttagctggttcttgccattgtactgccttcctgaaagatgttgtgattggttgtttccagataagaacaatatcggtcatatactttcttatagccctgctacattttcaggctataatgttcaggaaccctttttacccttttttctccatgtctgaagaaattcgctgaatcctatggtctggcctgttgtagaagggctgagacaagagtcaagacaagacaaaaatgtggtaccaaaatacaagttgctgctcccgtttgtggagtccgtcaggtacatccttttgcattttacataagtgaacaacctttttgtgttcagcttaacaatgctgctgattcctcatgatattacaatgctgtgataaatcgggtgagtaattcaatatagaagaaattctcattttacaatacagagaacatgacagattaggatcgaactagaactcgattacaatatagaacataacagctaacatataacaggtacaagggaccctaaaattacactgaaattattcacaaaggaaacatgctcactacaattcttcgtgcacgaagagttacatttcctcaagatgttagggcctgtttgtttgagttgtaaaattgattgggtcgaagaaaatagatgaatattaatgcatgtttatagcccatagtaccacaccaactgagccaaatagcaatcgggctctacttgcattatataagaaagatttatcctatccttgccggaattgtagttagtgtacgaagaattcagctaattaccatctgatgaatctatgtgaattagcaaatcatgttagactatatggataagatcgtattgtatccggtttgttatggtaggataggattagtttccatctgtatctgtttggtagaactcagtagataagtcagccacatatttgaattcaaaaaatggagtacgtggagtatcacaactctaccaatctactatacttgaagcctagtaggactcgggttggagaaacggatctttgcattgcaggctaggagcaggaggcatcggaggtgactatcatggcgagctcgccggacaaagggaaagagacagcagccgcagccgtggacgcgccgtcatcgtcctcgggatcctcgccggagaagaagaagaagaacagcagcaacaacaacaacaggggagaagcgacggcggcggcggtggccggagacgaggggaggaagaagatggtgaggatgtcgccgccgcagatcaacctgctcatgtcgttcgacccgccgccgctggagcacgtgaggggcctcaccaaggaggaggaggggatcgacgcgctggcggcggagtgggagagggggatccgcgcggtgacggaggctgtgaggacgcagtacgagcagggagggtacgtcgagtacgaggccggcgccgacctgcttgcgtgtcctggccgcagtaagaagaagccacagggaggaggagaaggagcaaattcaacagagctcagtgtattttactttgggtcatattttattaccaatgtataattttagattagatcatccttcatccaatgttttcacgttggatcggtatttttatctttgttgctcgcgtgtcctggccacagcaagaagaagccacagggaggagaaggagcaaattataattgtttttttaaagtacatttcgctttgagtcatattttattaccaatgttttattttagattagatcatcctttatccaatgttttcattttgcattgatatttttacctttgtgtcacttcgggaatcctccctcggtcgctcgggggagagagcaaaatcggaatataatgttgcagtgagttgaaacattcttttgcaataaatcacctacatattttggaaaactctctactaagaaaatccgtttcattttttttcataaaaaatgtttcactatgtatggatcaaatgttgcagtgaactgaaacattctttcgctatttgccgaaacattatttttatataagttgaaacaacaccaatttaaacgattggaacattttctatctactcagtgaaacaattccgatatacttggtggaacatcgtgcaacatttaaaaaaaaattaataataagctaaaattttttcgttggattatatccatgtgtggtcttgttttaaagatttaattgcaacgaatttaatggtgcaatcggatcatgatttagataaattacttaagaaaataaatagtttaaagtggttttttatgcatgtgtcatgctgacgtcagcgcccgattttcccccctccccatcgggcgcccgattctgagttgcgtccatatcactttggatcaccattaactttttttatccatctacctctaacttgtcatataccaaagaaatgatattgcatatgaccgtgagagtttattgataggtgggaactgacatactctagatcgttcatacgcttgataagagagtcgagatggtccaaagtgaaacaaagctaagattactcggtccaaactgaaaatattgattaataaatagtgatctgaagtgaaacatgggtaataaaacatagtccaaagtgaaatttactcttatttttttatcggtagttggttattgtacatacttgttgatttctttatgttatgttaggacgagaggatctgtggggaaatacttgtatttactcaaacacctaaatagttatgaaattgtttacaacatttcgacgacatacatgtattactccgcaatatcttaagcctaaattcaactcatacatcaagaaagagacaaatttaaagtatgaatatatatattcatacccaaatttatttccctagattatgtttgaagtaggtatcattctactctgtattatcaattttttctactaaattttcacaactattcttatgaattaacaactattctaatgaattcgaatgaaaaaggtaaaaggagacatccctttcttcgatcccacaactattcttatgaattcgattgaaaaaggtaaaaggggacatccctttcttcgatcccagttttgtcatcgtgttggttattgcagttcaagcaaaaggtcagcaaaataaattcgactttgggaggctttcataggtgagataataccccaaagagaaaaaaaatgtgggggcattttacaaagccaaccaaatatatatgggacaaatgagcaaagttaacaatgagaaatttcccctcatattgcatgaagaaataatgaataatgctggttcgctatgctgtagtacaaatatacaatgaaacttaaacattattaataattaataatttccactctaaagcattaaacatttattcgagcgcctaccactatgaaacttagggcctgtttgggggagcttaatattctgagaagcagctgttgagaaactagctagtgaaaatctggtgggaatctagagaagctgggaaacccagcttttggcttctagttcattttctagattctacaactacagattctcagaatctaggtaaaaagctagacagtttgaggaagcttctggcaactagagattctatgaaagctgtagctgctaaaagcttccccaaataggctcttagtagaaccaactaagctggttcatggaatcagttccagtcttacagaacttaagtacacagaaagatatataactatgacagctaactatttttttaaaaaaaaaagataaacaattgggctgctgcaatctctgcatcagcaaagtgctaagcacatcgcttcttggctaattcagcttgttaacttttcctgccttgatggaaacgccgggccgaaaccttctccgaccaggattaggagctcgagcttgttcatcgcctgctgtatcggttaacgcttcttcctcctctccttgtgaattatctgcaggagacgatgtttcgggaaagtcttttctgcatcagcacctaggctgaacaccacacgatgtgctttaagattcgcacgtacgcagtacccagctgcagtattccatctgctatccactttacctccatttacggcaggtgccatcgaaatacacaaggtgggtcccaccgtataagtctccctctctctctcacatgctccaactgcttgctttcgtattagcacactgcccgatcacacatcatctccactcctttatactgcacagctgcccctcttccagtcttccatttgtgttgggtagtactactattaaggtgatgtttggatccagtaatttaactttagtctatgtatttagacactaatttagagtattaaatatatactacttacaaaactaattatataaatgaaagctaattcgcgagacaaattttttaaacctaattaatccataattagagaatgtttactgtaacattacataggttaatcatggattaattaagcttaatagattcgtctcgcgaattagtccaagattatagataggttttattaatagtttacgtttaatatttataattattgttcaaacatccgatgtgaaagggatttaaaagttttagtccgatctaaatagagtctaagaaactttcttgttcaatcatcttttaatcacatcttttattcatccaaagaaatttcgttggtgtgcggcaaccggatgatcttcgccaggatcactggtgggtgtagttagtggtcaaatatttggatgcttggtttcaggggttcacattctctaccgttctctctctctgccctcttccagaatgttgcatattgcctcttccaaatcttcttcagagtttttagttttgttttagaagatttgtttgaacttcttcttattcttccaattttaaccaaaatttgttcatgaagacttatatgttgttgacttgttgttcaactgttgtgttcccttcctctatttctctcccttacccctctctctcttaatgttcttgttaaaagaatagatttctagttggcttgttcgtttctttttctcttgaaacaagatcagtgcactttttcgagagagaaaaaacctctatttctctcccttaccctctctctcttaatgtttttgttaaatgaaagagattcccagttggcttgttcatttctttttctattgaatcttgaaacaagatcagtgcacttttttgagatgaaaaaaaagaagaaacaagatcagtgcaatcttctccgcgagtaggatggacaaatattccaaatctaatttctctagaaaatgcatcttcttacccaaatgtcatcttgtgttccccgatctgttctccatctgtatctagaccctcctacttctctcacctcttgcatgcatctacttcactcatctctctttcacggaagcaggctgagggcttgaatttgtaatgtagattgagggacgaggaagaaatatcttaattgtcttcagtccataatctccctactcttttctctttccccccaaatttacctaaatttgataccccacaatggttcaatgatccaagcagtctggtaaatccctcatggttcttttttttcgacgtgaatccatggttccttttccatcttgcaattgaatttgtccccctttttgataaataaaaaaaatcatttgctgcaatgaaaattcacctcttttattgccaatagcaactttatgcagttgtaatggaaatatactctcatcattcatacttggttgaagtctctctctatctctctctcaaattcattttcgtctctcctcctgaggtgttgtagacggagatggatgtcaagttttctttttttttttccttagtcaatgtgagtcctctaaatttcgtttgtccaagaagtttgggagatagagacggtacgaattcatggaaaaaaatgctgagatgacgagcatgattttatatttgtttttgatctttgagctctggtaatgtgatttgttcattccttgttccaccacacttcggtgctttgttcatatggattcattgataccattcgaatctaggctgtatttagttcacgccgaagttaaagtttggttaaaaattgaaacgatgtgattgaaagtttgtgtgtataacaggttgatgtgatggaaaaagttggaagtttggaaaaaaactttggaactaaacacacccctaatcaattttggtgaactttttttctcataccatcagatattctgcacttcggatgcacatgtactctccccgtccaaaaagaaaggcaaaccctcggtttccgtgtctaactttgacagttcatcttatatgaaatttttttataatttgtattttcattgttgttagatgataaaacatgattaatattttatgcgtgacttgtctttttaatttttttcataatttttttaaataagacggacggtgaatcgttgggcacggaaaccagggtttgtcttttttttgggacggagggagtatgttttaaagtactaactaaaatagctgtgaggttgaattatcacccaaattttatgtaaaactcctataagtttgtttgccacaattcagtgggtcatcaattgtctttttttgtcttattggttttctcttctactacaagagcagagcagaggagtagtatgtactcctacaagagcagagcagaagtgttctggtttttctttggctcgaattaaacgacaggagagaggacgtgctgtcgcctcgctgtgtactccgtatgagtgtgtgtgtgagagagagagagagggagagagggagaggtgttctttttagctgaaaaattggagtcatcctgactgcaaaaagtccatctctgaaataattagtaagatttaagaactgcagacctcacggaattaatcattatgggtgtgtttagttgctgaaaaaaagtttaaagtttaaagaaagttgggagtttgaaaaaaaagttataaacttatatgggtaagaaagtttttgatgtgatatgatgtgatggaaagttggaaattagagggaaactaaacacggcctatattagcctttcgccccatgaaagcaaacctgcatgaatccatcttgccaatcttgggtgggtttagtttacgtcaaaattgaaagtttgattgaaattgaaatgatgtgacggaaaagttgaaagtttgtgtttgtaaaaaaattttaatgtgatgaaaaagttaaaaatttgaagaaagagctgggaaccaaaccagacccttccatcaatcctgtactcctgtcttttatcagcgctactaccattttggtgatattttacctgcatggaaccatggacttctacaaattaaaggatacaaataaataatcatccttaaactattcaaataacctcttcaatagccttgtactacctccatcacaaaagatatctatgacgggatttaacctatctaagataataaattttaggatgaatcaaatctcacgaggaaacaacaaagcctgtgtttagtttcacgtcaaaattgaaagtttgaagaaattgaaacaatgtgacagaaaagttggaaatttacgtgtagaaaagttcgatgtaacgaaaaaattaaaaattaaaaaaaatagggcctagtactagtaaaaagtctcgtagaaagtctttctgctctccctctctccactggtctggtgtagcagatgtcagtgcagtgggctccattgctacagcaatacagcatgcaaagcaatgcattgcctgaccagcagatgtggtgggcccggcacctagctgtgtacatgtacattgcaggttagatactacgagctgtacaaaagggtacgcgtattgcgtggaaagtcaggaaatacagcacgaatcactgcacagatcgacgtctcttagcttaggtgctgctgcacctaggtgcagaaaaaccgcgtccacgatgtttcttcttttttttcttcttcttgctcatcatcatcgtcatcggtggcctttcgcatcgcgtaacctttgcggtagtactgattcaggatcccgtctctatgcttcatgaactgatcgtcaatctggtttatctccctaaaaatcttggcgacgtaatcgtcgatctggtccatgggtacagggaggtcgcctttgtgatcagacaagtccgtgcatgctaacctctccttgcttactattgggaatatttcatctggcatcctgattgtctgataattgatgtagctgtcgatctcctcctgtgtcatcctcaccttcctccctgcagtcgtcttcttcttcttcttgcctccagccattgccggcgacggcggtttctccttctcttggttgggttggtccggtgagcttgccatgatcaaactgtcgcagaatatgcaagtcgatctctccgggatcaggatgtcacgatggcaccctgcaatattaattaattgttgtgggatcgattggatttgtgagaaacctagatatattcatgctgcttttatttgtagctccagcgcgctagctaggttggaattggagtcaagcctgccgacttgatccgattcctagctggagttcagtgtactcaattcttggatagaaatctgtaatttaatcgagttcacccccaatctattttatctacgcatcaacgaagaataacctgcacgaaagggctgatcagcgatcagccgcgcgcgccctcccccgcgcgactggacacgcgtcgtgtgcggagaggggggcgcgggcagcacgcggtttctccttttttttttttgattttttagtgttttcttcttttctgtttttttttcttttcgtatctctttagtccggttttcttttctttttttcgcatgttttttctgtttttttcctttctgtatctttttcagttttttcggttttttaatatgcacgtatacaaattttatatgcatatatataaactttacatacgcgtatacaaagtttatatatgtgtacgtacgggatgcaaagtttgtatacgcgtatataaaatttgtatttgtacgtacgtataaaaacctaaaaaaaaacacgtatatgaactttatatatgtgtatataaactttgtatacgtgtatataaaattggtatacatacgtataaaaacccaaaaatacacatatacaaactttatatatgtgtatacaaactttatatatgtgtatacaaactttgtatacatgtatacaaaattggtatacgtacatataaaaacctaaaaatacacgtatataaagtttgtatttgtacgtatataaagtttgtatacatatgtattaaaaacagaaaaagatacgaaaagaaaaaaacaaaacgaaaggtacggtagaaaaacagaaaaaacaaaaaaaaaaaggaaaaagcggggcgctcacaggaaagaaaagagaaaccgaaaaaaaagggaaaacgcgagagcgatgcgccgtccgccgccctatatacatgcagtagttagagaggagagactagaaggggttagaattgatcgcgcaccggtaaagagacacgatatattgatcgtccattagggctcccctaacctgcaaggcccagccgttcgtgcacaaacctatatgtatcgtaaacagcagtagctatagcaagttcggttctaccctttcctaacttctattcatttttcgtgtgtatggtttccaaactgctaaacgatattttttttcttaaaaaaaataatagaaaattttgtttaaaaattatatttttaattttttaagctaatacttaattgattatacaattaattatgagttaatgagtagctctgtttcgcatactcggaggaagagtttctaaccattacctatgtaccttcgaacacacctgacggagctcgtggctcctcaccgggagaccgcgcaggcccccctttgccagttcggccgggggcttagggtgaaatctcaagctctcactctctctgtatgtggaaatatcgtatgccagccagaaaacacgagacaccgacgatctatacaggttcgggccgctgagaagcgtaataccctactcctgtgttttggtggatctgcgtatgaatgagctacaagtgtgagctgacttcacccccgttctaagctcataatctgggaaagaatcaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtaagtgtcagaccggtcacaaatcggtcattcttgtccaccgcgtgtaatcttggcaacgtgcatgtttgcccttcttcacacaacatcttgcctgtaatggttaagatgaagcctggcatatatcgaccgggtctaacgtgtcatctctaagagataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgccgcactgcatgcagcgtgacacgcttgaccagactgcaataaatgctgttaggtgagcacagctgtgctcacttatcccatatacgtggcgcagacttcctaaagggggtcggggtgccccngccctcnnngccncngcaagcgcaacccgacccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagtgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccacgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgtgattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagccgcccggggaaaaaatctgccccaggagggggtcgtgcttctgggccccgcgtcgggggctcggggagcagccgccctgccgacgccccggggaagaggaagctgggaggaatacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttactcattttgttcgtcttttggttttttcttctgcttcagcgatgtcccgtcgcattcctcccgccgccccaagtccggccagtccgaggtcgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaagcggcagctgctgctggcgcgtcactcgggcccactccctcgggcggccctcaggcgacatcctccgaggcggctcgcgacgaggccgcgggcgcgtcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcgagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggtgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggcccttgaggcccgtgccatggcgctggaagaacatgccggcgccgtggagaggggcttgatggaccgcgaggccaccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagagccgcgctggagcagcgggctgctaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccaccggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgcaccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggcttgcgttcgcccccagctccgacgaggaaggcgacaccagcagcgaggacggcggtggcgacgaggccggcgacccgggcgcatatgaatgagcccccaggcccccgccactcttatcttttttcttgttctttcttctaaggccttcatgcctcttttttgtacaattttaacttaatctgcaatgagaaatgatgaaaaatttttgtgttagttttattttgctatatatatgagttgaggatgatctgtgccatggtccttttgcgacttagcttggaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgaggggggggtgcggggttagcccgagccaaaacctgacacccgaccccccccttcaggggtagaagcgacgaaggtgttcgatgttccatgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggctcggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcagaatgggctccgcactcgccctcatggatgtcagcaagaagctcaacgccttgttcctgaggaatgcacttcaggaggattccattagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctaaggggtcgggtcgcgccgacggctgggtaagcctttcttcaaaggcgcctggtggggtctgggctcgcgaggacgcgagccttgagagttcatcggcaatcatattatcccgtctgggcacatgccgaagctctatcccgtcaaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgcactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcccgggttgagtcagcacagggttagcctcggggccaaagggctttaagtgcagccttccctcagtggcctcggggccttcctgagggtcgggggcacccagcaccgtttgacaagcgggtggagggccgactccggtcgtcgggggccttaggccaccgttcgactcgggggcctctcctccctgcctgctctcgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctaagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaagatctcttggttgcgcgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccggggcccgacatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcttttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacctcgccgtttgccggatggaaccaccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgccgggagttccggcctctttctttttgtcgctcgcaggcctcccctttcgggtggcccgcggagcgccctcgacggcgaggacatgaccctcgtcgccggaacggttcgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacgttccgaagactcgccacaaaggctctacagccaacaccaccggccgggggcacggagggctgatcttcacgtccatgtcggggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggagggggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcactctctctgtatgtggaaatatcgtatgccagccagaaaacacgagacaccgacgatctatacaggttcgggccgctgagaagcgtaataccctactcctgtgttttggtggatctgcgtatgaatgagctacaagtgtgagctgacttcacccccgttctaagctcataatctgggaaagaatcaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgcgacggatagggtaagtgtcaggaccgggtccacaaatcgggtcccattctgtgtcccccggcggtggtaatctgtggcaagcggtggcatggtttggcccttcttccacacaacatcttgcctgtaatggttaagatgaagcctggcatatatcgaccgggtctaacctggcattttttaaaaaaaacccccctaaaccccggttggaaacaagggactagaggctttcgtcttgacgggatggggcatggcgtgcgtcagaccgccagtcgccacctaacccgtgatctgaccggtctgtgactggtcacagaccggataaagggacgcgccgtgccgcactgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaacacccttagaacaaatacaataaaaatgtttaagctaacgataaaactatccagctcagcattatctcatgtggaggatagagaggagatgtgagagagaggagcaggtagttatgcaagagactgtattggcacaaactcctactccctccataaaaaaagccaacctagaacttgaatgggacataatctagtacaacgaatctgaacagacctcttttatcctccagtcccacagtcgattttcttaacatttctatttctattttaaaaataaactgttctaaaatttatttttatatctaagtcttttggtcacaccagtacaccaattggactagcatgacaaaacaatgcttctaccttgtccaacataaaattgtcacgtctctttatttttgtcatgccctctatgatatggtgcggtcgaaaagttaatatgttttggagggcttattttacaaataaaatattagaaacgttgaaacaatataataaaagttccgcacaatcccacatatccgatgatgcaggcagcaatagtgtgggtcagggtttaccaaacagattagggtgagggtgaggttatcgctacctcgcggtttggtggttaccacggtaaccatacggttatcacgagatataccgtggtttcaaaactgaaaaagttaccacacgtaataaccgtgcaataaccatacagtctggtaaaccctagtgtgggcgcgattgaccggtcgagcagagctgtaaacagacgtcatctacttctaatagcctgtttgcttgcttgttgtttaccgttgcgttatgatgttgttggttgcagctgtggcagcttatctgcattgatatgtgggttttgatgtatgactatcactaactttatcatcacacagaagtgcccttttgatacacgttgggggacaatgtttagtggatttaaaggagtaatttaaaatagaaattgaggtaacttcgttctttcttatgctattatagaagtaacttatagttaacaagttttcaataactttttcttcatatgaaagtagtaacatttaattcaactgatttggaactaaggcctggtttagttcctaattttttttccaaaaacaatagacatatgtatggagcattaaatatagattacaaacgctaattgcagagttagggaggaaatcgtgagacgaatctttggaatctaattagtccatgattagtcataagtggtatagtaatccacatgtgctaatgacagattaattaggctcaaaagatttatctcgcgatttccaggcgagttatgaaattagtttttttattcatgttcaaaaaccccttccggcatctgatcaaacatccgatgtgacaccctaaaaaaaattttcgtgaactaaactgggcctaactagacacaaacttgacgaatcgcaatttctgcagcttcacaatttcccaatgttcagggctataaatgcaagtttcagttcatgggagtaaattttagaaataagacaaacttcacaagttgaaattcctgcacaaactatttgatgtgccccagcccccgtcacatgatgatgagcacatcccttgctacaattgacgtaaacaagggtgatggtttacgtcatacatcacatgaagaaaatgaagatgacgtaaaccaacttgatggattacgtctcagtaagaacgatcaagcatctcatggtccaattatgcgcagccgtgctaggaagatacaataagaggtgaactcgctctttgcttaacttaacctaaattttagtgagaattttatactacataaatgctctacatttgtattgctaaggtttacgcccgaggacatcatcactacgcaaagaaggatgtgttacgttgaagactacaagggttacgtcgagcaggaatcagcccatgcccaaccagtagctgtctacgccagcaagaagattgtttacgctgcaaaaggctcaacttccaaggcttgtgcgacccaaccaatcatatttctccatgcttaatatatatggttggaaagataatcaagtctagtttcaccttcaacaaatggcttatcatttcgacttcctaataaggagttatggacaaatcattgagtactgctcagaagccaaacagacgcataagtcttctcgggaattcatttattgtgaccttcgagctagcctatatactgtaaactcccaagacctttcattctcatctagaagggttgttcctagtataaatatctcctatgttttatcatttgaaagacttttgacaatgaaaatatgaaccccttttgtttagttgtgtgctaataaattcaaagagagatctatacccctttgctcttgtgatttccttgtgagattacagaagcggcattcaacgcctcccaattgatgctcctggtcccttcgaggtttttccttggttgattgcaggttgtgttggttggtaacttaaagtgtggttaggcgaaccctcgattcaggttgccgtaatagagatggtggttggcttcgagtacgatcgccagctgacactattatcttggctgcttgcagctagttatcttggtctctttgaggctagttatcggttcttgatcctacgccgtgaagatcgtgacatcacccctaccaggatcgtatcactattttttcagactgaccgtagacagaccgaagtacaaaacttcaaaacatgaacgcagttagactgaagtaaaaataaaaaacaaaaacaattctttcagtagatttaatgtaaacatgaatgtagtcctgaagtaccaaaaagaatcaaaataaaattttaaacattgaaataaatctttgctgctcaaaacatgaactcagtcggagtgactgaatgaaaaaaaattaaaaaaatagtagatttaatgaaaacttgtgaagtaaaaaaataaaaaaaaatattcaaaagtttgactgaatgaaaaaaaattaaaaaaaagtagatttattgtaaacatgaatatagtcctgaagtaccaaaaagaatcaaaataaaattttaaacattgaaataaatctttgctgctcaaaacatgaactcagtcggagtgactgaatgaaaaaaaaaatagtagatttaatgaaaacttgtgaagtaaaaaaataaaaaaaatattcaaaagtttgactgaatgaaaaaaaataaaaaatagtagatttaatgaaaactcgtgaagtaaaaaatattaaaaaatattcaaaagtaaaaaaaaaataaaaacatttttttttgctggctgtggggttcgaacccacgcgcactcatgtgcagaagatcttaagtcttcccccttaaccactcgggcaaaccagctgaatgcttattaatttcggttgttgagtataatcctatataaaaatccaagccacagtcgacacatcactagtttacatttcagccatatgctgtattccactttcttcgatcggtaccttatcatatcgtattgcaaagaagaaactgttgttcctcaagaaaagaataattatatcacatgatatttttttatctggaaggaagaaagatcattttcattgcaaaaatgattcggccttttctgatatcacataataataataattgtacacctcagtttaataatcctaaagaattttgaaccctataatatttacgaaccagaacacccccaggccccaccccaaaaaaaggtttcataattatttgttttaaaactgaacaatatacaagattgaaatgataaaaaagccctcctataaaaatacatgtggcgtggctaacccttctaagctaactcattcttttggctattgttcttgatactcacttatttttaagattaatttgatctataccattataaatatgtcataatagaaaaataccattacaattcgcgatatcaactgttgtgtgccattgaaattttctataattggaaccatgccactcccgatactctttgtcatcctctctctcgtcgccattcttaccgttgcctcccaacaccgaagtcgaagctctcgtccccaccatcggagtcgaagctctcgtcgctggaaccctataccgccatcgtcgctagagctctcattgtcgatgcctccgtcagcggggaaggaggaggatgcagttgcagctccatcggcaaggagtggggtggtgctagtgcatgaagttgaggggagaccaacctgaggtcgccgtcggaggtgaagcagcttcgaggctcggttgtcgtgttctccaccctcctctccatgcgtcgtaagccgcctaacttgaggtcgtcgcgcggaggtaaagatctgggacggccaagctccaactcctccctctgcttcgatggccggccgtcatctccttcgttctcctttctgtgcgtcggaagccgtctcctctaaagtggatccggtaagccaggggatgatggtgacacacggcaaccagatcctcccgccttgaccctgagggcagtggatctagccacccccgtccatgacgctagctacctccttgtctccctctccgccccaagtgccaaccatcgactttgtcccccgacaccgccttcacccatgagcactcgccggtgctgtctccgtcctcgacgatgaggatggcgatgagtaggagcaggagtaggaggcacacagccgtacggagcctaacctcgtggtgctcacctttgcattcgaccccgctcgccccatcctccgctccaccctgcaacagctcaatatagaagaaaaagaaaagaaggaagaagaggcaggatgacagggagaacaaatgggagttgacgacagtaacagaaaattagatgagagtggacgggagtggcatgatttcaattttaaaaaattttagtggcatccagccgataacacgaaatataatgaatttttcaatatggtatatttgtaatagcatatgatctaattaagagtttggattatttttatggccctctgtcattttcaatgtatttataagtgcaagatttttttaaaagaaattatagagatgttggaagtaacatatatgtcttgctttgaagagtacatgaatattacggttgattatttatctaatcatatatatagaaccacgatcatatacattatcttcctagcaacatgtgacgcgttttttttataatggaatagaacatcctgacctttgctcaaagagttacagtaaattattacaatctcgcactcaaaatgagaggagtttaaagtgtggggattatggataccccatatctatacggcatatatagtccgactgggtacggggtaccagatataaatagaatatctttaagaggactcgggttaggttctaaacttgtatgtcaaggaaatatccgggatcctagtcggttacgattgtattttatctgtaatcacatattccgttagggatatggactgtattttgtaatacggaccccttcccctatataaggaggggtccgggtccctctggggacacgattttctcccagatcatacgatcaataatacactcggcggatcaatccccggacaggagtagggtattacttcttgattaagaaggcctgaacctgtataaaattccttgtctccaaacccatccacttttctagcttgatagccaccctcttttagtattgccgaaatcttgtttcaacataaagaaatttaaaagacgaaaccaaccatcaagaagaaacaaactaaagactgttaaccccaaataaagagtacacaattattgaattctgtttgtgagcctccatccaaaattgacaaaaagttacataaccgttgactcaagaatatgacatgcatcctacatgtgacgtatttgccacatcacatgccttgtcatgtttgtaatcaccaatagaaaataatacatgtgccacttagaactctactccctccatcccaaaataagacaacctactctgtccaaaaaagacaacttagtaataggatgtccagattcattgtcacaagctagtactaggtagcttttttttttgacggaggtgttcatttgaccatttcatagcttatatgacttggggcctgtttagatcccaccctaaaattttacaccctgtcacatcaaacgtttgaacacttgcatgaagtattaaatataggttttaaaaaataactgattgcacagattgcgattactttgtgttaatgaccaaatttggtaatatcagtatcggggatgaagattagatcgaagcggaatcgaagatgaagatcgtttcagaaacagagtaagaatcggctggagtccaaatcggctacgaccagggtcggttgagttcgagtcagactggataagccgatacagccgattccgacaatatgactcggtatatatcatcgggttgagttaatgtgcttcacgtggattgccacacatggattgagtcctaagaaggcaattgtatctattaattaagatattttatgtaatttccttagagataagtgtgggcaaaagtctgccgcaaagacttatggtatttagagttttttagagataatagtcgtgtccgatatggacatatcttgtaatcctcgggtataaatagacccgaacctcatgtaatcaaactaacacacgttcaatacaatctcggcggatcgccacccttttcatacttatagctgcatcagttgagtttgatcttatgagtcgtaattagaatctcaatctctagtctgccttttggttgccgattagggtagcgtcggagtttcagccgatcttacctgatttaaccatatttatttcatatgcttgattgacacgttaaaatctgccctttatgctaagatcttgccgcaattaagtatattaggcttttgtttagtatattctacttgctttaacatcttagtatagagtggtatcggagtattagccgatacatgctagatctatctgatcggctatgctatgaacgtgtatagcctcgttattaatatatatttcgatctaagtgatttatactgtctcggcatgacgatcgatctatcccaatcacttgatttaagtatatatcgatatagggattatatattgttaatatctacagccgatcgagtagatttagttcgttcatatttaataatgactgtcgatcgatgtagatatgacatcggctcaaagataaatgatatgtcatcggcacttagccgatcggctatcgtttattgatttaatcgcagtttctttgtctttgtttcttgttgattgcaggatcaaatcaactggcacgctagcatacctgaaggcgagttttggacctgcactagagttaagaagatctcccaggcctcgtgttttacatcaacactttgtgagaaatcttttaagcctaattgctccatgatttgataatatggtgctacagtaaatatatactaatgatagataattaggcttaataaattcgtcctgcggtttagttttttttataagggtccgaacaccccatgcaacaccctatataatacccgatgcgacacaccaaaactttacacccctaaatctaaatacccccttagactactatag

SEQ ID NO: 73770 - DNA, 1086 bp, Oryza sativa
cgtggttagtatagggatggcacatagaacgttagggtgtataggttagacgatgtcggtgtcaagcgcgtcgactaaccgcgccgttaaggtatgctggcgggcgcgacagtgtggaatgcagatggagaattctgtgcaaattaaaaccttgataacattgccttccggtcatggaatcgagctaggttttttttgatggctgtagaatcacgggcctcaccgaagagagactggatttggagagttggacccccagagatttttctagcaattacttacgataggccacgaagcagcggttgtttgggcgaaacgtcaaatatctgagggtccacaactggttttcaacgaggtgtttagtattcggatggcacataggacgttagggtggatagcttaaacgatgtcggtgtcaagcgcgttgactaaccgcgccgttaagttaggctggcgggcgcgacactgtggaatgcagatggagaattctttgcaaattaaaaggttgataactgtgccttccggtcatggaatcgagctaggttttttttgatggcttcagacccacgggcctcaccctagagagactggatttggagagttggacccccagagatttttctagaaattacttaccataggccaggaagcagcggtttattcggcgaaacgtcgaatatctgagggtccacaacgggttttcaacgaggtggttagtatagagatggcacataggacgttagggtggatagcatagacgatgtcggtgtcaagcgcgtcgactaaccgcgccgttaaggtaggctggcgggcgcgacactgtggaatgcagatggagaattctgtgcaaattaaaaccttgataactttgccttccggtcatgtaatcgagctaggtttttttttacggctgcagattcacgggcctcaccctagagagactagattttgagagttggacccctagagatttttctagaaattacttaccataggccaggaagcagcggtttattcggcgaaacgtcgaatatatgagggtccactgatgaactacttgcagagaacgcaaatcaaaggtagcgg

SEQ ID NO: 73771 - DNA, 8074 bp, Oryza sativa
aggcctttataagtttaaaaattgtcaccaatttgatcattaactttaataccaacatgtcccccttgaataaaagaggctatccactcacaccatttaagagagaagcccttcattctcaaagtctgttgtacaaaaaaaccatttaaccttatcataagctttctcaaaatcaatcttaaaaattatgcactcatgtttttacgatgtaattcatgtaaggtctcatgcaaaataaccacaccttccataatgtttctcccaggaataaaagcagtttgggtaggactaattaccttttgggccacactcattactctatttgtggcaactttggtaaaaatcttaaaactaacattaagtagacaaatgggcctatattgttaaatttttatggcctctacacacttaggtaaaagaataatagtaccaaagttaagcgagaataaatgtaaagtaccattatgaaactccttaaaaaggtttattaaatcaaattttataacatcttagaaaacttgataaaattcagcaggaaacccatcaagacctggtgctttgttatgttccatctggaaaatagcctccttaatctcctcttcagtaaattccttgtgttagagcctcattctccaaaagagaaacttgaggaatgtcagtaaatttactctcatcaaactgaataggagaatcatctggaggaccaaaaagacccttataataagtgataatatgcgatgtcaaattttcatcaccatttattaattggtcaccatcttggaattcaaaaattctagtattactatgtttcccatttgcaaccaagtgaaaatactttgtattagaatcaccctctagaatatccttagatttggccctcagataccatttgatttcctcctctctcataattgaagataatctattcctataaaaccatctaatatccaattcctcctgactcaaaagaatatcctctttgtctcccatgtttcttttgatttctggaagtgcgtcattgcatgtacaagggcaaagtttcatgggtactggctccatcagtccgccgctgcttccactcaaaagctctgttgggcgacacgggcagcgaccgccgcttgcacctctaccccccacctctctccctcccgcctcaccgccgccggagccagacaccgaaaacgtacggcagcatgaatggcggcggcgagggcattaacgctctcctgcgcgggatctaggagctagcggttgctaagaggacaacggtgacgattgccactgctggcagcgtcgggcagtcgcggagaagttcaaagccaccggcgagagctcagaagcgcagtgggaggatccggcgaggaggaaaggcaacggcaggcggatccggtgaagagggcgatggggcggtggctcgcacgtcgtcagcagcctggcgctgccggcggcatagggttgtccaaggggagacatcttcgaccctcgtgactgcctacgcgcaacccctctttgccgccggtgaagctggacctgttcattcgcctccttggccgatttgtctagatccacttactccttggccagatctactcggttggggctgggaggtcggtggcagcggcgccctgacctgcccatgggggcggtgtgtgatggtgtcttcaagccgctagcgtccgtgccgccgccgcgtgagctatctgactagtgtcctggctggctttaccccctgctctgggttgaaaaccccttttggtttccacagcgtacgatggcgtcttctttcttgttgtcgtccttcttcttgaaggcatcatatttggaaatcccctgccataaccctcgggtggcttcttctcctcgtcattgttgtgccctctacctgtttgtcccctggcatccatcgtgtcctgcctacacctatcctcgacgcctttggtccaccttgccttgtcttttcatctaaccagtgttagtgttcctcctagtttccttggtttgagtcattttggttgttgtttcttgccttgcttcgaccaccttcaccttgatccaccataaaccacgagtatgcagtttcccctttcctcctcagatttcttccattttggcatgctagaatgattgatagtttggggctgcaagttggttagaaccattggctttctcagtgaacctatgactcctcaaccatcgtggatgatgtttcctccaccattgcaattgctgcctcccaacttacctcttttgctttgctccttgttctattttcatcttctttgcttgggtgtccttgtccacaatgttcagcgaccatcccaccattggggcttccttctcccttggggcgtcgggggcgttgtattaattggcaatttgctaatgccggattgaagccgatttgatgtgtgcggcctttacagcaacccttagttgctctccctcttctggggcatcctttacccaaagggcgttggcgagcattgatcaatatttcaacacaatgaaatcgggttttgatggcttgatgcaggtggtctttgacatacacaacctctaatctccggaaactgagtcggcttgtgcgtggcagatggccttctgacaattcaactcccggtgcttgaaggttgcgtgtagagtagatgttgtcaggctagggagctagctttagctcagattaggattgtggttttgtgatcttgttggtgaaaaacatcaaacacctcctctctctctttctctctctctctctctctctctctctctctcgtagtcctgctagtgtggctcaggtgcccttcggggtggttgtgtttctgttgtgtttctcttccttgtttttccctgtatactttctcttatcctccaggactactgcgcttgtgtagcagaagctttgccctgtgtaagaccgtttgaagtaatatatttaggtgggcatttcgccccccggtgacccgtctaaaaaaaagttgcatgggttctgacaggaatattcagccttaattcgaaaatgacaaggtcacttgacaagcaattaaagagtagagagagaaatattaaagagaagagagacaaataatcttgccacataggatttttcatgtcagcaattaaagagagaaaatggtgtcttgaatctgacattatcatgcaagtaaaagagcattggaggggagggcagtatcgacaacataaaatcaaaggagagagatggacaaagaaaattattatctgatccaacaagtagaaacaatgcattggataaattcactaatacaaaaatggttttttttttgcggccaccggcattgctagagaccaatggccagtgaagatgcagcatcttcaattcactggcgatcgccaactgccagggaatatagcttttcgctggcggctagtttaaggtagccgccaacaaaaatggtagaggtaatgccttagtctagttgtatgagattagatctgtatttgagtatgcgcggtacaacgtgtgaatagcacgtagcacgtatcgtcctctccccagaattagggtttttggttcaccctatatagaggtaacatatctcctataatctggcaacctaccatcgatttacatgagataagatcggttgccttatctagccacgcatgctcctcataggctcaggcctactcggcccaccacatgctatgcggcccaaaggcccaacagttggtacctaggtaccgtgtcccccacattagcccccgactctatacttagttaagcatcaagcaagtggagagtcaagaacatgaactcccaacagcgtgtggttgagtaagacaaaccctagaggatttgcctcatccaatggaaccagccaaaccatggaggtgaggaagccagttagtgatcacaaagttggccaacatggggacgtagttgctcggcggtggtgaaggagccaaccagcacaaggacaaagtcacccgacagcagcataggcaaccaacctggagacgcagcccccagccggcggcagaggagccagccaacatggggatgaggtcacccgacggtggcataggcagccagctagaagacacccgggacttgggagtgacgcccgagtaagacaactcagggggcgtgtcttgcccagtggagtggtagccgagtaaagcaaccaacgtggaggcatagccaccagccggtagcgacgaagccgagtaaggcagcactaaggagtgtgcctcacacaacaaagtgccagctgagtaagatagccaacgtggaggcgcaacccccaagaggtggcgacggagccaagtaaggtagcactcatgagtgtgcctcacacagcaaagtaacaaccatgtaaaatagcccacgggggcatatctcactcagcgacatggtccagtcctcaagtataggagatgggcgcatggtcccgagctccaattacacatatccatacctgggccctgcattaaaaaacacataaaatgagtagtatattgtatagaaaatatccactcaagaggaatacaagtttgtttaaatacatgtaaatatttgttcctcctttattagaattaatttccccgagtagtttactatttacgttcaagcactctgcctcgggcgtacggtatggggcgtagccataccgtgtaagtgtgcagtgagtggcgtagcccccgggcatacggtgttaagcatggccttgaccgtgtgagccgtgcgaggaaatagagcttcacgaatcagagtttgtgctactcaagtacttttgcaaccattaagaggaggaaatgaacatgcagtttgaagcacctaataggtgcagcccttgactttatgtttggttgggtgaccaactaaacagtaagtcagaagtaaaataaattactcaaatgaaaataccatataaaaagtgaattagattacttagtattccatgagttgaaaacaaccggggaggcggtgaagcccttcagctgccccggagccggccagtcggtgggtacgtgattgactaatgtggaggcgtagttgggtctgcgtgagccatacaagagtgaagccccagggcatacggaacagtgacgtagtcgggtagagagtagccgggtctgtgtgagccgtacaagggcgaagcccctaggcatacgggcacacgctcctggcgaagtcgggtcgagttagccgcgtgaaggccaaagctcccaggcgtgcagcgtcgtgcccaggtcttacggagatgtgcccgggcgaagtcgggctgcgtcagccacgcaaaggccgaagcccccaggcgtgcggagtcgtgccttgagagtacgtgccccgggcgtagtcgggccacgtcaaccatgtaaaggctgaagcccccaggtatgcggtgtcttgcctcgggcgtacggagacgtgcccagacaaaattgggccgcttcagccacgctcgaaagacgaagcccccgggcgtgcggcatcatacctcgggagtagtctgtctggggcgtagtcgggccgcgtcagccaggagaagactgaagcccccgggcgtgcggtgtcttgccccgggcatacggagacatgccccaggcgaaatcgggttgcttcagccgtgcgaaggccgaataccccgagcgtgcggcatcgtgccctgggagtagtccgtctagggtgtagtgtcgggccgcgtcaacgaggagaaggccgaagcccccaagcatgtgcggcgtcatagacggtgaagcctcatggtggcgttggtgccggctagcccggggacatgttcaccacgcggtggcgtggaggcagccgaccgcgaaattgttcaggcaatcggcagtgtaagcagatgtggccgacatgggaacacggttgccactcggcaactcgaagatggctgactacggaggcgatggagctaggctgctacgacacaaaggcggccagagtggagaccactcggcgacgtcgaacatctccggcgcatgtgcaaaatgattgttaacgaccgaatttggaaatatcgatgcgatggcgacagtgtgcccatgtgcgcggctaccgacgggcatgtcttctgtctacctggtcgtgtccgagtgcgtggccctcgcacctgtgtgcgcatggccacgactacacacgccatcactactaggaaaagcattttcgccggcaggggaaacacatcttcccagccggaaggccggtccgcctatagcacaacgcctaggaattcatgtgtattcatcctcttatgggatatcaatgggatgaagagttttgagaattaatccatttgattagggaattggtaacttatatcaattactcctaattgatggatggttgatggttgtgtagtggaggatggttcatggctagttgatgacaattagttgctctattcctcttcctattccatttgtaacctacatcaattactcataattgatggttggttgatggttgtttagtggaggatggttgatggctaattgatgagaattagttactctattcctcttcctattccatgactcttactcttcatcttccatttctcatataaaatgagaatggatttgatctcccaaaagagaaagtgagacacactttcatccattttccaacgctgttgctgctacggtaatcccatcccgacgagtgtgtgcacacgcgttgggagagtaggcctccgaaaccacgcgctgctgcgacgtttgcacggacgggcgggcgatcaggtttttggagagcgtaaggcgcgactactcactgttcgtcaacatctacttcaccttcaccaatatgtcgaacactggagacaacggcaacactggatacaaggagaaggaggctcccgtcaacatcaacggaggcaatactgcctcaaactccaacggaggaccattcttggggtataaccttcttacattatttcaattagaagttttactgttaatattcattgcaatgtcaacattgtgttattatgtgattgttgatgcttattctacattaagcatgctcatgttgattacattcaccactatcactggatcaaatcccattataaatatcatgtttattatcttgttattttggattaaaatatgccgaattatgaccaaatttccaacaatccaaaaacctgataggtcattttcggtagttggctttgctgcaacactgaaaccacatgcttttgatagttctaattataagatatggaaagcacgtgcactactgtggttgacagcgatgcaatgcttctatgtttcacggggcaaacgaagtgaaccgcctctctctcctgaggaggaggctaagttcgaggcttcggattgcctgttccgtggagcattgatcagtgtactcgctgacaatatagtggacgtgtacatgcacatgccttcagggaagaacatgtgggatgcacttgaggccaagttcggagtttccgacgccggcagcgagctgtatgtcatggagcagttctatgactacaagatggttgatgaccgttctgtagtggaacaagctcatgagattcagatgctagcaaaggaacttgagaacaacaactgtgagttgccggacaagtttgtggcgggtggcattattgccaaattcccaccttcttggtcagactttgctacttctctaaaacacaagaggcaagagttcagtgttactgatctcattggctctttgggtgttgaggagaaggcgagagcaaaggacaaccggggcaaaaatatcgagggaggttctagcgccaatttggtgcaaaataagaaccctcacgcatcccataacaacaacaagaagaaagtcaagcctgatgtcaaaccaaaggctacaaccaattttaagaagaaaggcaagggaaaggccaagggcgactgctttgtgtgcggtaagcctgggcattgggcgaagaattgtcctgatcgcaaggacaagaagtctgccaacatggttattagcgagggcggaggaacatcggggtacggttattttttacctacagttctctctgtttttcattcacctgattggtgggttgatact

SEQ ID NO: 73772 - DNA, 5088 bp, Oryza sativa
  unsure (1)..(5088): unsure at all n locations
gactttttctctccnccagtcttcggcttgtcgttcttgcgtcttagtgcgtcgtcgacgtgggcgcatctttcaacgatctcgaatacccttcgagtagttgtgatatgccttgttgccaactcttgggtagtgtagcgatctctgacgccagacttgaaggcgcgaattacagaagcgtcggtgatttcggggatggtattcctgcacttgttaaagcgccgaacgtattcctcaaagattcacctgagttctgtgttaacgcatgaagatcgtcctcgatcgcgtggcgcttgtatgttccttggaagttggcgacaaactgctgccacaggtctgcccacgaagaaattgagtagggagggatatgcatcagccacgaacgtgcagatcccttcaacgcggttggtaaatagtttgccaacgcgttgtcatctgctccagcggcataaagcactatcgagtagacttgaaggaattcttctgggtcggtgctcccatcatacttttcaatagctccgggtcgaaatctctcaggccatcggacatcacgtagggaacgaccgaaagccctacacccagcgctcggagtggtgggttgtcggtggtcgcgtgaccttcgtggatgtcggtctgacgatgaagaggacgcggaggatgatgatgatgacgatgggtcgcttggttccggcgtgcgattacgagggtgacgacctggatctcgggaatcttgtcttcgtctctcgttgttgtctcgacgccgatctcctccatcttcgtcgttacggcgacggccgtgactagtgttgtctggccctcgccgatcacgatcatcgtggtttcggttatcgtgtgggcgacttcctcgatcatggcgtagtgaggagacatggtgccgagagcggtttgcttcatcccgtgtgcgtcgtgcttctcggcgcccattgatttgatctcgaaggtcacccgtgccacgaggtggaggggtagctcgttgaggtgattctctatgttctggaatttcaccgttagcatcgccgatgggtgattggttttgttgtgccgcggtggcggcttcttcgaacgcgttgctgaggttagccaccgatgcccgtagtcgttccgtccaacgctcgaggtctttgttcaggacaggatcgtaaggtgtttccctcaatatggcttgaacagccctgatatgttgggctggggtggtcgattgatccgccgtctccgcgtttgcttgtgctgatgtgccaacgtcatcgatagccaacacctcccgcgccgcgtctgatgtcgatgacccataatcttcgaggagatgtaaaacagatggttcgtggggattaagattgattaccccaacgaaccgatctggggccagagtcgctccttgttccttgccgttatcccggactgggacgtatgacttatgagacggagttttcatggcgccaagtggaactttgcaactcgagaggtcgtgattctttgtcttatggatgggacaatagacgttccgagttggagaagtacgctggattccacgttctttgcaggcgcggatctcagcacgagcattgacgaatacccagcaatcttgaagagtatgtttcttggttttatgaataggacaccaagacctgatagtttcggaagtcatctttgctggcccgcggtttgtgtcggagggacaaggcctggtcgcatcagaatccttcacgaacttagatgtagtcggcaatccgttctccgtttcaacgggtggatctttcgacgtagaggcgtcttggtttgtaaccaccgcgttctcgtacccagtcattggacgactggttgagatcggcattgtggtgtaaaccgggcagacgatttcgccgacttgagtccataccagcattgtcgaggtgggaagaacttgaccggagttggtgttgacgttgttgtcgacgaagcttgatggcataatagtagaaccttgaataccaaggccccctacctggcgtgccactgtcgacgggggatacccgtagaccggatatagagggtattggggtacgccggtataaggatctacgtagtacgacatcgagcaatcaaaagacaagaattatactggttcaggccccttgacaggtaatagccctaatccatttgatatgggattatatggtggaaaacacagattacaaaggaaaagatggaactcgggagattcgacgagatcgtagtcgagatgatctgactagctctcgtcgacttggctctttgtaggctctgacttcgtaggctgtgttggttgtccgagctctgatattcgatgagctatggcctccccggggggtcccttttataccgtaggttgggcgatatctgagtaggactcggatgtaccaaacctggtacgatacgtaggtaacccaattcttgtccaagaaggtttgttgtctttacgaagaatttccttaagtgctagaggatttatccatatacacgtggatataccttgtcgatacgtgacgtatatcgtggggtgaagggtatgcctgacccgtaaccctgacagatggatctaaggtaggtaggtcatcggatggcttgggttttggcttcttagctttcttcttaggagctagggccgatggatcaattgccagtgtcttgatctttcttttcctgccaacatcggttggttctctcatttgccattgaagcagaggcctggaggggttaatccaccaccagttggcaagaggcctggagcatactctatatccctgccgctgttccttttgtggggaggagaagattctgttgtctgcaagacaaagaaaagtcagtcaagatctaagtcggctaacaattattcaagcgaaattaacaaagtaaaggtgtaccggagggataacatcagggaacagatctgtcatatacatggaagccgactgatggaatatgtgttgtttccattctccccaccatctatcgaagttcctgctcctgaactttgccagctctatgttttcaatgatgcccaaaggaggtcttgggatgttgagtagccgatccatcatcagggttgatgaaatatctcctcggcattggattttatcggcaaagaacatgccgattggtagctgtcccattccaaattgcctggctgagctcatcggatggtagaattcgttggacacttgtatatttcttccttggtggatgccaacacgaaggatgcatgggctgatcgcagctgagaagacttctctggatttctgatatctctcatgattgatatcttcaaatctaaagtccgatgggagatcaagattcaatgagtcttcataagggaaccaaacctgaggttctttctgaaagccttcataaaagctgcagaaccaatccttgagtagctcagccgataattttgctccagcatcggctggtgtggatgcatattctccataggacatacatttgcgatgggtgcgctcttctccatcatcatttgtagtcggctctaatcttgggaattcagcttctgtcacaggtggccggttgacagctttcatggctatcaggtttagtcaagtttgcgacaaccaccatggcccgcttgcactaataactgagccgatagcaatcttagccgatgcgttgttcagtgtttgatacaaatagccgaggaggatcttgcctaaaggaaattgcctctttgtttccagggcttcggctaaaaattgccagttggttgtggggccgcaacttgatccacaaaagagaaacttctcaagccacatcagaaggaaggcttcgagttctcaggaggtgacaaatccttttcccatatatgttgctacatagccggaccagccacctatgctcttagttctgaagtcgaactggttcttggtgtttaagctcatggggttagccgatgaggtcacgtccaaaccggtgatcatggtaatgtcaagtaaagtggggatcatcggcccttggttgaaaaggaaggcattgatggtattggaccagaaataggtggctgcggccatcaagggttcatccttagccaactttgctatggtgtgggcaagtgcctggctaattccaagttcgtcccagtgaacttgcttgctagccgacacacgcttataccacacggcccagcttttctcgagggaggttttctcaagagatggccaagatttgaatgtgtttttccagtggcccaggttagggttggctaatctaaaggggattctgttggtttcggcgatgatgaattcagtagggtcaagattgccaatcggaccgagaaaataatggttctcatgtgacagacttggaatcgctaccagattggacaaatgctacagatgtaaacaagaacagagaagaagaaaatgagataaggcaagagaaaactaatctgttgcgaaaggaaaggatctagccgatgggtacttacctccgcgtatttggctaatggcgcgacggacgggctggcggaggacgacatctctgtcaccacctgccatcttgtcgcgaccgagaaaattgccttttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtattcagcaagccacaccggcggatgcatgattaatgcaaggggtacaaggggtgataatatagggattaagttttgcagaaaacagcttttaaaagtcacttacttgcccaaagccattttaaaaagacgatcctagagctacacagtattattaatcaaggccgtgacccctcacgaacctgccttaacccaaggcctacgatgattcagaccgaactggcaacccgaccct

SEQ ID NO: 73773 - DNA, 1178 bp, Oryza sativa
ggcctatggaagtaattttctaaaaattctcgggggttcaacttctaaaaatctagtctctctagggtgagggccgtgattaagcagccgtcaaaaaaaacctagctcgattacatgaccggaaggcaaagttatcaaggttttaatttgcacagaattctccatctgcattccagtgtcgcgcccgcaagcctaccttaacggcgtggttagtcaacgcgcttgacaccgacatcgtctaagctatccaccttaacgtcctatgtgccatccctatagtaaccacctcgttgaaaaccagttgtggaccctcagatattcgacgtttcgccgaaacaaccgctgcttcgtggcctatggtaagtaatttctagaaaaatctctgggggtccaactctccaaatccagtctctcaagggtgaggcccgtgattctgcagccgtcaaaaaaaaacctagctcgattccttgaccggaaggcaaagttatcaaggttttaatttgcacagaattctccatctgcattccacagtttcacgcccgccagcctaccttaacggtgcggttagtcgacgcgcttgacaccgacatcgtctaagctatccaccttaacgtcctatgtgccatccctatactaaccacctcgttgaaaacccgttgtggaccctcagatattcgacgtttcgccgaataaaccgctgcttcgtggcctatggtaagtaatttcaagaaaaatctctgggggtccaactctcgaaatccagtctctcttgggtgaggcccgtgattctgaagccgtcaaaaaaaacctagctcgattccatgaccggaaggcaaagttatcaaggttttaatttgcacagaattcttcatctgcattccacagtgtcgcacctgccagcctaacttaacggcgcggttagtcgacgtgcttgacaccgacatcgtctaagctatccaccctaatgtcctattgccatctctatactaaccacctcgttgaaaaccaggtgtggaccctcagatattcgacgtttcgccgaaacaaccgctgcttcgtggcctatggtaagtaatttctagaaaaatctctgggggtccaactctccaaatccagtctctcttctgtgaggcccgtggttcttgagccgtcaaaaaaaacctagctcgattccatga

SEQ ID NO: 73774 - DNA, 1393 bp, Oryza sativa
taaaaatctggcagatcagtttaccaaggggctaccacgtaatgtgatagacagtgcatcgagggaaatgggcttgaaacccacttagagttgcacaatagtggaaacctgtccattgtgatcggagatcccgtgaatttggatggcgaaacaaactattgtgtaaccgagagaagagacccttaaatgggctcattttcatgatgtacttctcttctactctgtgtggtaggatggcttatgcctcggcttttattaagcagagatgttgacctgcaaaacatattagaaggagtacacctatatgagttcgactactagtcacagtctatgagatttgggtgatctctagatactcatgaaaggcctggagtatgacttataagctccaacctgagggaatactaacggttgcctagtatcagttatggaattgagtgaaacctaactgcacaagactgacaattcaaggcatagtccattgttcagttgtggtccggtgtagctccttttctaggtgaaagttcaacttaacagtcttcaccaaaacactggtatataaaagctgctatggaatagagagcattctcatgagccttgaaatttggtggggattgttagatttaattgggtaattgatccaattaaatcaattaaatcatataaattccaaggctcattatgctaggaattcatgtgtattcatcctcttatgggatatcaatgggatgaagagttttgagaattaatccatttgattagggaattggtaacttatatcaattactcctaattgatggatggttgatggttgtgtagtggaggatggttcatggctagttgatgacaattagttgctctattcctcttcctattccatttgtaacctacatcaattactcataattgacggttggttgatggttgtatagtggaggatggttgatggctaattgatgagaattagttactctattactcttcctattccatgactcttactcttcatcttccatttctcatataaaatgagaatggatttgatctcccaaaagagaaagtgagacacactttcatccattttccaacgctgttgctgctacggtaatcccatcccgacgagtgtgtgcacacgcattgggagagtaggcctccaaaaccacgcgctgctgcgacgtttgcacggacgggcgggcgatcaggtttttgggagcgtaaggcgcgactactcactgttcgtcaacatctacttcaccttcaccaatatgtcgaacactggagacaacggcaacactggatacaaggagaaggaggctcccgtcaacatcaacggaggtaatactgcctcaaactccagcggaggaccattcttggggtataaccttcttacatt

SEQ ID NO: 73775 - DNA, 1318 bp, Oryza sativa
ctcggtctgcccatctgtctgcgggtggtatgcggtgctgaagtttaatcgggtacccagctcttctggaagcttcttccaaaagtgagaggtgaattggctgtccctatcggatacgattttcttgggaacgccatggagactcacgatccaagtgaaggtgagctcggctagtttgctccctcaatatgtggtcttcacaggaatgaatcgagctaccttggctaatcgatccaccactacccatatgaattcatacccaccttgggtcttttggagtaccgggaatgaaatccatccaatttcatcccatttccattcaggtacttggaggagttgtagaagtccggccggtcgttggtgctctgccttgacacgctggcacacatcacaaagggccgcgaactctgcaatttcccgcttcatactaactcaccagtatttctccttcaagtctaagtacatcttcatactgccagggtggatggaataaggactttcgtgagcttcctgaagtaacagctgtttaagttctctgttatctggaacgcatactcgatttccgttccatagggttccgtgttcatcctctgtgaaaccagcggctttaccctgtttcatattcttgaggagtccatgcatgtccggatcgttcttctgagcctcgcggatttgatcgagcaaggtaggcttggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattctgacgcgaccgagaaaattgccttttcccgaacgctagtgtattagtccccgtcccaggaaaagccggggtacaccacacaaacatgatataaaagacacatctttattatatcgataatatttacattattacaaaggcacttaaggcctgacaatcaaaaataaacagcagcggactagcgggcctacagctccatcttcacaggcgctcaactggggtataagccaggactccacctaggacttcatctccaaagcttctcttactgaaggggggaaagattgagcaagaatgagtacaaccacagtactcagcaagccacaccggcagatgcatgattaatgcaagggggtacaaggggtaataatataaagggtaggttttgcaagtaacagcatttaaaagtcacttagtttgcccaaagccaattttaaaaagacgatcctagagcttcac

SEQ ID NO: 73776 - DNA, 773 bp, Oryza sativa
  unsure (1)..(773): unsure at all n locations
ccgttnnnangatgaagtaccacnttatggaacagcncatcattagcagcgtctacacgaccaacagaaaagaaaaggcttttactctaataaactccatataacaagcagcaacaaagcacattaatgggttcttgacttcttaccataggccacgaaacagcagttgtttctgcgaaacgtcaaatatctgagggtccacaactggttttcaacaaggtggttagtataggaatggcacataggacattagggtggatagcttagacgatgtcggtgtcaaatgcatcgactaaccgcgccattaaggtaggctggcgggcgcgacactgtgaaatgcagatggagaattctgtgcaaaataaaaaccttgataactttaccttccggttaaggaatcgagctaggttttttttgacggctgcagaatcacgggcctcacccttgagagactgtatttggagaggtggaacaccagagatttttctagaaacgacttaccataggccacgaagtagcggttggttcggcgaaacatcgaatatctgatggtccacaactggttttcaacgaggtggttagtatagggatggcacatatgacattagggtggatagcttagacgatgtcggtgtcaagcgcgttgactaaccgcgccggtaaggtaggctggcgggcccgacactggggaatacaaatggagaattctgtgcaaataaaaaccttgtaactttaccttccgggcatggaatcaagttagttttttttatggt

SEQ ID NO: 73777 - DNA, 818 bp, Oryza sativa
  unsure (1)..(818): unsure at all n locations
agggccatctctatactaaccacntgttgaaaacccgttgtggaccntcagatattcgacgtttcgctgaataaaccgttgcttcccggcctatggtaagtaatttctagaaaaatctctgggggtccaactctcaaaatctagtgtctctagggtgaggcccgtgattaagcagccgtcaaaaaaaacctagctcgattccatgaccggaaggcaaagttatcaaggttttaatttgcacagaattctccatctgcattccacagtgtcgtgcccgccagcctaccttaacggcgcggttagtcgacgcgcttgataccgacatcatctaagctatccaccctaacgtcctatgtgccatccctatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctcttgggtgaggcccgtgattctgcagccgtcaaaagaaacctagcttgattccatgaccggaaggcaaagttatcaaggtataatttgcactgaattctccatctgcactccacagtgtcgcgcccgctagcctaccttaacggcgcggttagtccaggggcttgacacggacatggtttaagctatccaccccaacgtcctatgtgccatccctatactaacctcctcgttgaaaacaattgtggacccctaaatatttgacgtttcggcgaaactacccctgctttcgggcctattggaaggaaagtctagaa

SEQ ID NO: 73778 - DNA, 4090 bp, Oryza sativa
taatgaccttctgtgagattgcattaaaaaagcagcacaaccttgtgatagcaaccttcaaatgttctggttttatggcacttattgcaatggcaagaaacacggtgagcaagacatgacagtctgttaacagtgaaatttggtaaacctcgaggatgtcatcggcctaaaatcagtatcggcttcagagtcctggaatcagtcgatgggagttatcaagtcgccatagtcggattcttactatattcggttaaggaaattaatctattaaagaaagcttatccaagagtaaccgagttcaatgaggatgcagcatggcagttatctattaattaggaatagtctgttagtttcctttttatctttaggaaagtgtgtttagtgtccgattaggactttatgttttccttttatctttaggagagtttctttcttgtcctacaaggactagtatctacccatgggtataaatatgtaaacccggggtcattgtaatttatctctcgatcaataatactctcggcgcatcgccaccctctttcctgaggtttttacttgaaatttggcacctgacacggggctgcatcggttcagttcgatctccggcgaaggggtaagtcctacgttccgccggccctggtgaatctatcggctgcttcgatctcttggatcgctctggtttggttgatatatttgcctacctgatatctcaattccatctctaattgcattgtgtttagagacgcatcggtttagttgggactgtctcggttaggtctgatcttctatcttagctgatatatctctacaatcataatgttgttctaaatagatttgttatatctatcacattagacagatctatcggctcatctagtattagattatcatatacaatctcgtgctgcatcggttaggttcgacctactagattgttgttgataacataagtcttgtttagccgataggttcatgctagtgttttatcggggtgctagccgataagttatctggatgttgcatcagcttataaggatagcatatgatatatatatatatatatatgtatatatatatatatatatatataaaagttggatttagccgatgacaacaaaagtttcattgatttatctaatcttgtagattttatgacatcggacctccagcgtattatttacccttcgaatcagattggtttctactggattatattgctatattattattgtttatcatcatcagccgatcgcctttatatcattatctacattggacatatagccgattgctaaaaaccctatcgacatcgactgaaatcggcatcggctaatttcggctatcggctggaattactccatcggcttgtcagccaatcggctttttttatctgttttttacatatcttgtcagttgcaggatcaaactgactggcacgctcgcatgtcatcaacctttggacatgcactggagctaagcagatctcccaggccagtatatgtttttcgcatcagcacagtcgtgtgaattataactagataacgtcaaatctttcatggagactagtcgactgatgtttgatgagaaacctatgggcactttcacatcacgaagtgataagcaaaatgatttcttctcctcaggtgtcggtgtgaaacaggctggtgaaatatatattttgccgttcttctctctttcttgagggtgtaactcttcactaattcccatctcgactaggtcaagtcgtgattgcagaccatccttagtcttctatggtatgtccaacaatgtttcaattacgttgtcaaacacattcttttctagatgcatgacatctatggcatgccgaacctctagatctttccagtacgggaggtacttaaagaaaattgaatgtttcttgaatgggggagggagttgatcacctggcttctttctatcttctggtttcttggtcttgtcaggtttcttgcgctttgtaccctttgaaggtttcttagtcccttttccaaattcgcaaactattttctctgtcatttcacatactttctccccggatgtatatttttgtggaggatcactctcttcaatgccatcgaattctgacttcatcttgcggtacttgtgatctgtgcgtaggaaccgccggtgctgcatgtacacaaactcgttggaacccggaaggtacctatagtacgttccattcaagcagatcacacatcctgttttacctttaatttgccctgaaactgaaaacatggcggggtaatcgttaatgatcacgaagatgatggccttcactgtgaagtattctctcaagtactcgtcccacactttcaacccctctttccataaatccgctgtatcttccaacaatggttcaagaaatacgttaatatcaataccagactgtcagggtccctgtatcaagatacagagtaatacgtattttcacttttgacaaagccaggtagtaagattatacatggtgaaaagcactggccaagtactatgtgagctactcatgtctccaaaaggattaagtccatcagtactaaggacaaacctaatattccgtgggtctttagcaaactcttcgtacttagcatcaaagtttatccactgatgagcatctgtcgggtgttggagcatcccatctttcttgcgcccttcttgatgccagcgcattagatctgcatctcgtagatttgagcatatccgtttaatgcggtctttgactggaaagtaccacatcacacgctgcgggatttttctcttagttcccttgaatatgttagacgcttctaggaaagtatttctatttgatttgtaccggctagcaccgcaagttggacattcatccaaagaagcgtactcttttctgtacagtatgcagtgattaacgcacgcatgaatcttttctacaccaagtgaaaggggacatatgagtttcttcgcttgatatgtgttgtatggtaatgagttaggcctcggaagcatgttcttcgaaagttcaagtagactgtcgaaactactatcagacaatccatatctcacctttaacctcataagttcaagaactggccgtagtgttgagaactcactgtcacagccctttgactcttcgtacaaaacttccttcgctgctttctgtaaagtttcaaagttatttaaacctctagccgacccaatcagcacctcaggttctgcatgacgtaacatttcctctagatcaattttgtcttcaccacaaccaacgccgtacaccatgtcttcaacttctgtcggaacttctttttcaggcccggccacttcttgttcgccatgacgtgtccatatttcgtatttttccatatatccacgagttactaagtgttcctttactttaccaacatcttcccaggccctttcattcttacaatcagcacatagacaaattatcttcgtcatattgttctgttcagcgtgtgccttcacaatactaataaatttacatttcttccctatataaagccaaatacctcggcgaatgatacatccattgccgcctgtccatatctctacaaaaaatgaccaacaaatatttacgctattcataccaaatttctagggttcactaaaaatgacatagcactattcataagaacaaagattatttaatttcatactaaattaatatcatagaaaaatctaacaaaatcatatcatcataacacaaataatttttttaatcgaccaaattaacatacataaaaaattttcttctctatgtgtctagatctagacctaggagatggagcttttccttcacaattttgcatgcatagatccatcacaaattaaggtctaaaagcataaaaaaaattacatatctagagtggaaatgagtagatctaaccatcgtagaaaaatccccctgagatttgaagttaacagcctacacaaacatatcaaaataaagtaaataaaaaaacatggagcttttccttcacaattatgcatgcatagatccatcacaaattgaggtttaaaagcttaaaaaatgtatacatagagtggaaatgagtagatctaaccaccgtagaagaat

SEQ ID NO: 73779 - DNA, 911 bp, Oryza sativa
cgggaggagtccgatgtcttggatccaaggctataaataggagcccctagtcctcttctttcgtttgccccctctcccgtggtctcccgtgtcccgtagcctcgccgccaccaccgcctagctcaccggtgccgccggccatctccggcgaggtagcgcagccgtctccgtcgtcgtcgccgcttgccgctgccgcgtttaggtgcgccgtggtgaggggaagcccggccgcccgtcccctttcgtcgccggccaccggagctccatctccggcgaggtccgagccgccgccgccgttcatctcgtcgccggccgtcgtcgttcgtcgtttggttcgagggtgagtaccgttgggttcgtctcgtcgtcctctatgtgttcatgtcctccaaatccgcagccggtcgctctatctccggcgaggtcgtcatcttggttcggccgccattgatgatgtcatcatgacatcatcggtttttctttttcccgtttttctaatagattaaatcttctgaaaatcataactaaataactgtagatccgattcgagtggttcaagttgctaaatttttctaaaatcaagatctacatgttaaaaatattcacatgtactgtttatgcttgtttttgtactgttttgttgatttttattctttcgctttagtttccgacgttccggaggagagcgttttcgttgagcaaggttcggaagtgtttgcggaagctcaaggcaagtcacacagatcccaaataaccctttgagcatgttgaacccgtttaaagctattattttatttcaactatgcattattttttaatgtcatcgggtggtgagcctttccccgttaattaatggccgaagatgatcttattttcctatgggttataatttgggtaccgagctcgaattg

SEQ ID NO: 73780 - DNA, 1500 bp, Oryza sativa
atttgtcgatgagatttgatagtatatttgtaccatgaattacaagactgactttgcgtagaccggttcactttaatagcacccaaagttcaccccgttcccatttttaacacttttgtcaattctcaatcgttttccgtccgccttggtcgctattgacagccacgtacgcgatatgacgtttttacccctcacaagtacaagtagaatgcatggcaatgaaagacgaatgtatctctattatgccatctaccattctcgtgactaactttctgccactggtcctcccctatactcatggttctcgtgtatgggctgaaacacgcgtgaagatgatttgaagcgaataaatgtatgtaattgattttgcatataaaaataattgattaaaacgttaccagtgcacatcgcgtagaagccaaatatatggtgaggtggaaaaagatatgattatctctttatatggaaacaaacaaaactatgcagttactttcgcgcgaaacggacaatacaccgcgcgttacacgtcagagtacgtggagaatgtgggagtggaggagaaaagctatgagcatgaaacaataccgtgagcatcgaaggaaaacaatgtggtgagatggcatgagtaatagcgtagaaaacaagccacattacacgagaagaacatttgcagctcggaaaaagaccaaaaggaacaattgattcgatttgcagcttatttttaaataaactgcaccatgaagataggaaaaaaaatctaaattttcaatttaaaacaatgcaaagtatttcgacatcatagttaagggctaaggtacattaaaaatataaatatgacaatcctagcgacaagtagatattaaatcaatagagatcgaatcaaaatcgcattattcacaaaatatcatcataacttaaatcataaaatacacaatataacctgataagaaagatacatgagaaataaatgtatcaacatcaacgatcacaaacgttacacgaagccaaacaccaaacagaaaaaaataaataaaggaaaataagtccaaaaaaaagaacacaacacacagctatatactataaagctctgcaggacatggaaggagaagaaaaaaaaagaaaagaaaagcagaggagagagtagcagagagaaagaaaagaaaagaaaataaataaataataaaaagcaaaggaagggaaggaaggagagagagatagaatagagagagacacacaaacacctacaacaccaacaacaacaagagaaagagagaaagaagagaaggaaaggagaggaagaagaggtggtggtggtggtggtggtggtgtgtggcctccttcccctccctcctctcgcgaggttgccatgcctcccccaagatcctagaacgcatccccacaacctcacctcgctcgcaagaatcttcttcccaccatcgccctccctcgggatcgatccaacccgatcatcaatcggtaaaattcatttcgttcgttcgt

SEQ ID NO: 73781 - DNA, 8078 bp, Oryza sativa
agcaaccttcgcaaacttagcatcagtgttagcaagaaactgaagcgtgcagaagatgagctgaaagtgcttgccaattttgccagtctcgcatcactgaagattacatggggaatggtatctccacgagatgctgccgacgaatcagatgctgcaaaatttaaccttgttcttccctctaatctttcaaagctggatctctactgcttcccgtcgagacaatttgggacgattagttctgacagtttaaagaaactgtattttactggtgggaagttgcatagtctggaaattcagaatggggagtgcaaagtagaggtgctgcgcttgagatgcctcaaggatctgcagttttgttgggaggaattgcgtgaactgtatccaatgctggagtttgtcgaagctcagcactgctcaggagtagctaattggccgctagacaacaataaagtatggacgaaggatgctgaaaccagtaatgctgcttctgcacagtctgaagaaccaactgcgcctgatgtttgtcctgaaattgtggaagagggataaaagcaaaaacatagttaagccggtgtgtttttttagagagaactgccggtgtgtaagttaagccatgcaaggtgacttttaaaaaactagctgggtggtccgcgcaattctgcggctagcacccaaacaaaatcatatatttttttagtatgattttacttaaaatttattaaatatctatgtcgttgtcttaagattttgaaaatccaaatcttatcatccctatatttctaattatatagtttttaaaagtcacaccagttgctaccctttacttctgtcatatgcttctttatttgcttgctcaatctaccactatttctatttattctccctgaaacctttaaaaattgaattttgtagtttttagagtttaatgttttgttgggtttcatttttataatttctagaagtcccgtcaaacgctgccattatactcctctatggcccgtccactgtcttttctctttattgtcattgggattttaaaaataaaacataattatcgttcgggttcattttttactttatagaagtcccgccaaaccgtcagcggctttgccattgtactcctttgtggctcacctgctgccttccttctttattgtcaccaagattttaaaatcgaacatgattatcattgggtttttttattttttgaaagttccgaacctttaaaaattggtccttatagtttttagagtttattgtcttgttgggttttattttttataatttttataagtcccgtcaaacgatgccactatactcctccacgacccatccgccgcctactctttattgtcattgggattctaaaagtcgaacataattatcattagaattcattttttattttttattttctagaagtctcgccaaccgtcagcggctctgcaactacactcctatacaccccgtctgctgcttctccttttgattgccattgagattttaaatatcgaatattattatcaatgggatttatttatttttaatttctagaagtcccagcaaccgccttgcccgttagcttcacggtctgcctgtcgttcctccttttaatcgtcattaggattctattttgtgttttattaatagtttttgtatgtcgtatcaaccgccaccactctacttctttatagacctgttacttaatttatctcgtcatgtgttttagatgatctttttttttcaatagtctttattttttatcaccaatttttagttatttattgtattcctaattgaaatcttttttatttttctaatttcataatttattttttttatttttgaatttaagttgtttaaaaattgtattcctacttgaactctcttttagtttttctaattttggatattattttatttttcattctgaattttaattaatcttgtgttgggttcttatatggattcttctttcaatattgcttatttttaattccgaatttcggttaattttaaattgtattcctacttgaactcttcttttttttttgttgctaattttggattttatttttatttttactagcaatagtgcccgtgtgttgcaacgggaaaaacaccgtttgatggtgtgacaccttgaaaacctcaaatctgtaaaaatcaagtataatttgatatattaacaaataggtagaaccgagtctaatttgatcaattagcataggatttaggatttagttttagatttattttttgagcctacttagcagtttatccgacggactttaatttgaaaaatgtgagccacattgtttgatcaaatttgctttcggcccaagccttcccaagccggcccaaacttgggcttgcccatctttggcgagttgagtcaattcgacggcccacaagctgagcagctaagcgcgacctacatatgcggggacggtccgatgcacttccgcggcccattgggcgtagcataatcaatggcggcgacggcccgacgctgggcgaatctaagccgtccgatctaatggacggctccaatcgtccccgcgccgaatgaagcaccgaccggggagaggggcaaaaccctagctcccaaatccctctcatgatcccatttctctccggcgacgagcgagtggaatgacggtggtccggcaagctggtgcgcgcgtgcagcgacgaccgccgagcggctcctgcttcgccggctgggggacgcaaaaccgtgccacgacgtcggcggtccggctaggtgggcgtgcaaacggcgacgagcaccgagcagcctggacctcgtcgacggtaggggtgacgccaagctgacgcttcccgtcttcagcaaaggatggtggaggggtgctccaggacagcgtgcgcgcagggaacccgacacgactgcgaggaggtgaaggtgcggcggtgccgcttcctggaaagctccggtgagctctggggcttcaaatccggtaagtaacccgaacccttaacttaattgatttggatttgactcttatggttcttacccgaaattagagttcttcgaatttagagaattttgtcgggaaatttcaatctattttattccctctttacgagttaggggagtttcaatatcgtttaccctcttttaattttggaaacttcaatctagtttatccctttgctcaatttcgttttttttttgctttggctggcgtttcatcccgcgggtgaggacggagggcaccgctcgtcccctcggaaagattgagattaagataagataagattttcacggacgacggaagtaaattgaatcgaactttcttttatttgttctaatgttttttcgcccttttttcattattacggacaacagaaacattttaaatttttaagtagtagatatagataagatagagatatatagtaccgtgtcaaatataataggattcaattttttttaccgcgtcacatataattctttttttttttggaatcagacatatttgttttttatttctttcgctctttttttaccgcgtccacgcagattcatttttttttgctggtctttttttcacctggtttttttcgcccttttttaggaattggacagattccttttttatttcttttcgccctttttttaccttggaatcgggttcgtttttcttttccttttttttcccttttttgatcggacagatttggtttttctttttttttcacccggtttttttcgtccgtttttttcgcccgttttgttttggatcagacagatttttttcgcccgtttttttacggacgacggaagcacctcttatttttgttttggattagactgatttttttcgcccctttttttttacggacgacggaagaacctcttattttaagtagtagagatagagatagagattctgaatattaattaatctcgtattaggttcttatatcgactcttctcttaatattcctgatttttaattccgaatttcagttatttttaaattgtattcctacatggactctccttttcttttctaattttggattttattttatttttattctaaattttgattaatctcgtatcgggtttttatattgactcttctctcaatattgcttatttttaattctgaatttcagctatttttaaattgtatttttacttgaactctcattttctttttctctggttaatatgggaaattttagtcccccacagcgaacgtggtgcctcattttaaagctgtttaataatataatagattgaaaatataactttttttaagattttgcatttatatatatgtatgggaaagatttgcacaaatatatctctttacggcatgatgggcacgcgggagcgctacgtaattgcggcgtagccacgcgagacagtcggctgggtcgttcacgtaagatgagcgtgcggcaccgctttggtcccgtaggccagaattgcggcaccgcgtcaatgctgcggcctgggtgtgcggcaacgtggtggagggcgggaccatgtcggtcccgtggcatccatgcggtaccgccaggggcggacctaggattttgaaattaggtattcgaaatggaaaggggtaaaaaaaaaagttttacaacacaagcataatatttggtatgtatgatcaacagtatgatattttagtactgcttattgaattagaacttgcgtcaagattttcagcaattttcttgatttattgggatatactttatgaaaaaacatatgtagtacaatctaaaaaataaattgggttcagatattcacattaaacacattgggagaatgtagattgaacgggttacctattgaatcgaatcggaactgttcggcgaggcgatttggtaggggcagtagggggtgcagtggtgcaccgcgcgttgtgcggaagcggccgcggcagcgcgaccaacggtgccggaggcgtggggcgggccatatgacgagagagagagagagagggtttgaccgagcgagggaagggcgtccgcgacctgttgagggtgaggcctcgataggcgtcggcacgccgcgggctactccacatctgcgcgtgcacgacggcagcgcggcgttgcgttgatgagcaagacggagggacatgttgcgacttggaagttggaacaaccaacagcgaccagtggtggtctaggttgactttgccccttcttttgggctattgggcctacataatgagaagataagacaggtgggatgagggagccagtgtgctaggctttcttgttaggcttcttttgatcaatagtatttattttctttatttctctgcacagatacaaaatatatttttttaataatggaatgaaataacatcccgacctttactcaaaagagttacagccaattattacaaactagcactctgtaagagtgcagtccaaatgaaagcaaacacaccaaccaaaattaaaattaaaaggaaaccaataaagataaaataacattatttcagtgtattggtaaatctccatccatgattgacaaacagttgtataaccgtcgtttcaagcatacgacacacaacaattaggaattcttcatcttcatcatacttttgtaactgtgcccacagacgaagccaatatattgccttgaaaataacctgcatataagtaattgtaggtgatttgtcaaaaaccctatcatttctactcaaccacaaagcccaacacaagacagaagctccaacaagtatcagtttactctttttgtttacaactccctaaagccgatcatcaaaaatatgagatatgctagtaggaatatataaaccaaaagaaaactgaactgctctccaaataaactttgcaaaatgacattcaatgaacaaatgttggatatactcatttttcgtacaaaagcaacatcttaaattaccattcaaatttcgtcttgctaaattatccttggttaacacaactcccttaagcaaataccacataaagatcttgatcttaagcggcatcttaagtttccaaattaacttatttctgtcaatgtaaccattgttaattaaagctaagtacattgatctaactgaaaactggccattctgatgatagtttcatctaaaacagatacgaaatatatacctcatattgtattttttatctaaaaatcttgggtattcatctgaatactcttgaattgagctaggcccgtaccgcagcacagttgcgctgcacagagtaggaatccgcgctgtcaatacaatgctctcaaactttgagcaatcaagcacggtgaaaacgtcactcttttcgttcctctttcttgctcacctcacgccatataaggagaagagagtttgcaccagacgaggtgctcatgccataaaaaagagaagagaagagcttgaggaagagagaagaaatgaagaggtaatggtccaagccaagagggatataagtcgaagaaaatagaggtaaattttagtactttaattattatgaagtatagatttagcgatgatttatgtattagatgaaaatattaagtgttggataagtaataattaatgtagtgtgcatatattacatataaatagtttagttatgtgagaagtttagaatttttaggtactatgtatgttaggactcaagaaatattatagtatgaatgtagtagaaatataaaatggttttagtattatgtttcattatacataagacatgcataaattttattaatatataaaaccgtgtgaaaaattgtatatatgattaaaattttctttagttgtgtgtacgatttttgaacgagtaagagaaatgaggaaaatatatagtatgaataacaaactctatcagttatatagccgttgacctgaatcttattggtttcggttaggcccacaattccatatagaccgaaatagccaacgggtcattttaatctaatctatctgtattttatcttgttagttgtatgatcaaactaactaacacattctgaaatccataggacctatactaaagctaagcagaactcacacgcttccgtctgttcttttagattttacgtcaacaactgcacatcatttgtacaatatttttaacatgcatgtttctatcattttgatagtagcactactacttaagggcaagttctattaattaataggtaacaaatacaacatatcacatctaatacacaaacttcaatattggtttattaattctcacatcgtcttatattttcttaaagattgtgtggaggttgcctcttgtatgaggctggcacattctctctcttctaacttctctccttcatatcatcacctaatcctatgtgacatctttaggagcaacatgtagaggcttatagtacttgccctaacctatgtttattcagagcaaggccaataatacagccaactgcttactgtatagatttttatagcctatctctaagcttactcatatagtggttaacttttcagtataaatatatggtccacctgtctgtctcacagatttcggccacctcaataggggtggaaaaaaaagctcggattcatgagctcagcttgggcttggctcgagcttggttggcttggctcggctcgtaagccagacgagccaagtccaagcctcttatttagctcgttgttgaaatgagccgagcccgagctggctcgcgagccgcttattttggctcgcgaacctagaccatcatgtgtttatatcgattattttgcttttcatggagttattatttatcaactttaaatttatcattaagattttgaagaattgaatatataaacttatttaattttacatgtcgatgatttgctcttgcttttttgttaataattacaaaatatatatgaagagatgttttaacaggaaggcttgcaagccagctccagctggctcgagctaggaaacgagccgagctcaagttttagcttgtttccctaactgagccgagccaagccaagcctagcttgttgtgagccactgcaagccgagccgagccagtattcagcctacacctcagtattcagccttcttagggcaagtgt

SEQ ID NO: 73782 - DNA, 1120 bp, Oryza sativa
acccatgaattcaaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccccgttgtcctcctctggggcaacaaacagcaggccgagttggctttggccggaaaggtggccaaa

SEQ ID NO: 73783 - DNA, 6561 bp, Oryza sativa
aatctgagggtccacaactggttttcaacgaggtggttactatagggatggcacataggacgttagggtggatagcttagacgatgtcggtgtcaagcgcgttgactaaccactccgttaaggtaggcttgcgggcgcgacactggaatgcagatggagaattctgtgcaaattaaaaccttgataactttgccttccggtcatgtaatcgagctaggttttttttgacggctgcttaatcacgggcctcaccctagagagactagatttttagagttggacccccagagatttttctagaaattacttaccataggccaggaagcagcggtttattcagcgaaacgtcgaatatctgagggtccacaatgggttttcaacgaggtggttagtatggagatggcacataggacgttatggtggatagcacagacgatgtcggtgtcaagcgcgtcgactaaccgcgccgttaaggtaggctggcgggcgcgacactgtggaatgcagatggagaattctgtgcaaattaaaaccttgataactttgcctttcggtcatggaatcgagctaggttttttttgacggcttcagaatcacgggcctcacccaagagagactggatttcgagagttggacccccagagatttttcttgaaattacttaccataggccacgaagcagcggtagtttcggcgaaacgtcgaatatctgagggtccacaactggttttcaacgaggtggttagtatagggatggcacataggacgttagggtggatagcttatacgatgtcggtgtcaagcgcgtcgactaaccgcgccgttaaggtaggctggcaggcgcgacactgtggaatgcagatggagaattctgtgcaaattaaaaccttgataactttgccttccggtcatggaatcgagctaggtttttttttacggctgcagaatcacgggcctcaccatagagagactggatttggagagttggacccccagagatttttctagaaattacttaccataggccacgaagcagcggttgtttcggcgaaacgtcgaatatctgagggtccacaactggttttcaacgaggtggttagtatagggatggcacataggacgttagggtggatagcttagacgatgtcggtgtcaagcgcgtcgactaaccgcgccgttaaggtaggctggcgggcgcgacactgtggaatgcagatggagaattctgtgcaaaataaaaccttgataactttgccttccggtcatggaatcgagctaggtattttttgatggccgcagaatcacgggcctcaccctagagagactagattttgagagttggacccccagagatttttatagaaattacttaccataggccacgaagcagcggttgtttcggcgaaacgtcgaatatctgagggtccacaactggttttcaacgaggtggttagtatagggatggcacataggacgttagggtggatagcttagatgatgtcggtatcaagcgcgtcgactaaccgcgccgttaaggtaggctggcgggcgcgacactgtggaatgcagatggagaattctgtgcaaattaaaaccttgataactttgccttccggtcatggaatcgagctaggttttttttgatggctgcagaatcacgggcctcaccctagagagactagattttgagagttggacccccagagattttactagaaattacttaccataggccaggaagcagctgtttattcggcgaaacgtcgaatatctgagggtccacaactggatttcaacgaggtggttagtatggagatggcacataggacgttagggtggatagcttagacgatgtcggtgtcaagcgcgtcgactaaccgcgccgttaaggaaggctggcgggcgcgacactggaatgcagatggagaattctgtgcaaattaaaaccttgataactttgccttccggtcatggaatcgagctaggttgtttgtcacgaccggaattgacccaacgggcgttccttacgtgcgtgtattattccttgtcccaggaggcaaggtacaccaaaaattgatacatttcagagtttatcaagcggaagcgtaaatagttaatttattacatgggcggcgaaggcccagcacacacaaagacaaacgagaaacagcggaagactagggtgacgaccacaggcacttgacagcaggcacgagctagacaccaaagccttcatcttccaggggctcctcttctgggtttgggaaaaattgagcaagactgagtacaaccaccatactcaacaagacacacccacaagtgcaggataaatgcaggggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccaactcgtcccaagccaacccaggccaaccattccacattttagttgttaagcaggttttaagaattaaaacactaacttgggtacattgctcggcttgcccataaccgagggcgtggctattcgaatagattatactctgatcagaggtgtacatctttacccacaagacacatcttcctcacgtgtaaccacgtgccgcataccaccacggtatacggacggaagacgtgacatagtttccaacccatcctagccatagacaagagtaccgacccaaccccacctacggccagaacccccgggacaggtaggcaggactgagcctctagtagcaggacaccagccctgtgccatgacatctcggctaccgggccgcagctcgtgtagccttcatttgtcctagagatgtccatcgacccgagccacaaactaagccttacccactagacatgtggaagtacggtagcgctttgcaacagaggcccgaagaccggtccttatatggccgaggtgctactatcaaaaccatgcaccccgagcccaacctaaaactattttgagggttttgaatagagggggaggtgtgaatccaattccacaatgatccaacaaatccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctaggatgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgtagagcggatcttccgaagctgcagcgtctacacaaccaacggaaaagaaaaggcttttactctaataaactccatataatgagcaggaacaaaggacaaaaatgggttcttgacttcttaaggaaaaattagagacttgaacggtccaattccgagttcaaatggccaagttatgaccatttgaagtttatatgctctttaaatgaatatttgcgaatttcttcatttaaattttaattttaaaagggtttattgcgtcagccgaggggaggggcgcgcggaccgggtccacgggagtggggcccacgcggcagcctcacggtccacggtggaccaggtgcacccgggctcacaccagccggcgccgtgggccccacgcgtcagccgcacccgagggcgcgagcggctgacggccgggccccacgcggcagccgctcggtgcgcccgaaggcggccacggcggagcggcggccgagagaagggagggaaagggggaaacgaggcggcggtccacggctcaccctaggtcgacggcgacgacgaaaaggcggccggagcggaggaaggcggcggcgtggttcgggtcgacagggacggcggcgctccggcggtcgacgagcgaaatggaggggtggacgaggtcggcgaggatgcggcgaagccgaaagaggcggcgccgaggtgggaggtggtccggggcgacgacgacggcggaccggagctcggcggtgatggcgaagagagagagcgacggcgcgagctcgattccggcaaggaggaagggcggcgagaggcggaaacggacggaggaggtgcggggagggtttatatagggttggaagggggagagagcggccggcggggaaggaataggcgcgggaggtccggccgccatcaatggcgccggcgagatttgcgggggcaaatccgcccgtttgaacgcgaggaagagaggggaaaatggggggaaagggtgagggaatcacggggaataattcccccctattgattgcacgcggggaataatcaggcgggaataatggcaggcgcgacactgtggaatgcagatggagaattctgtgcaaattaaaaccttgataactttgccttccggtcatggaatcgagctaggttttttttgacggctgcagaatcacgggcctcacctagacagactggatttggagaggttgactgtcacgcccagaaattctcgaatagaattccaagcagaatgtgcattaaaacccccgtccaggaccggccggggtacacaaacgatgaaattgacatacagatccacgtcttacaaacatcagaaaagtcttacaagaatgcagcggaaaaattaaaaggtaactggagctaagccttgacttggaccgcagcgggaacaccactccacaggcatcctcgacggcacggacgaagcctactcctcggaaaatccaccatcggacgcatgctcaaactctgaggtttggggaaaaagagcaagactgagtacaaccaccgtactcagcaagtcataccggaatagggggtatgatgcaggatatatccaaaggataggtagagcgattcatttgcataaagtgagcatttataaacagtagttgaaagcagtaaaaatagttgtaataattaatcaatattaatcatccactgttcaatgctatcccacgttgcaacaggcccaaccctccacctgaactaatcaatttcactagactaagctaggatgagactaatcacggtgaacctggttgaccgcgcataaccgcgggtatggctattcgaatagttttactctgatcagagatgtacaattgtacccacaagacacagccccacgacacgtttccgtgcaccgacatgccaccatgacataccggaaagaggccgtgacaggacctttcgcataaccccctctaaccaagcacaccacacctcaggtttcacccccactcctcgcaaggaagcgggcagtcccctctcgtgcctaggtgaatccggaagccgcataagtcgtcgcagggcccatccaaactccatcacgcccacccttccctggatgcgtcagctagaggaaagcaacactacaagcccagccgttgcccacactggcttgtggtaagtacgataagttcttccagggcatcccgcgaaccggtccttgattgccatgggtgcgactagcaaaaccatgcacccacagcccaccatttaatatatttaattaaccatcactagagcggtggcactaatccaacatcaacactagaacctgaagtctatgcattaatgtgattccccattgtgtgctagttgaactaagcatggctaagcaatccctaatccaacttctagtcatgattcaacccaagctaccaaaggaaatgatggtacaacaatcatatagccgagtacaataggtaatataccatacagaatcattgtaaaacaatgcataacttagagagaataaatgagaatttgcaatataggatcaatatgatcaagagacaagcatgacttgccttgctctgttgctggagggacctcggtgactatttcaaagtacaccggagcgtcgggagagccggaatctaagcgacatacaaagcaaacaatacaaacaggccataagactactgaaacagagaacaaaatcatttttaatggattctatgcatttttcttgatttactgagacttgaatgggcttaaacggagctcggatgaattttctatgaattttagaaggtttactgtgctttaactataaacagaaaagccttaaatgatttattgcgcaataattaaaaccctggagagagaggaggcggcgccgacaggcggaccccacatggcagtggctcggggtggcggtccacggtggaccgggtccatggaccggggaggaggcggcacaccacgtggtgcacacgtggcgccgacgcggcgcacacgtggcggtcacgtggcaaccacgccggcgggggggttggaccgccccgatctaccaccccggagattcgacg

SEQ ID NO: 73784 - DNA, 30962 bp, Oryza sativa
  unsure (1)..(30962): unsure at all n locations
gcggccatggcgatggccggcccggcaccggcggtccaaggcggcgaccgacaaccggcaaagggtggcggcgtcgcgccaacgcgaacgccgacagcggcgattaagcggctagcgggcccggagaggaagagaaagggaagnaggtgtctcaccgaagcccgtccgccggttgccgtcgtcctcccgtggcttgccatcgccgttcgctgtcatcttcctccgcgccggccaccctcggtgaggcttcctctcccctctattcccctccctctccttcctagccgccgcttagcgccgccgccttcgcgtcgcctttgcgccgtcgcctccgccaccggttgccgtcgctggcaacgcgttcgcgcgcgcgcgccgtcgccatcgccgtggccggtcggctggccttgagccgagccgagccgggtcgccaccgcccgtccgatcggccccgggtcgatccgggccatcgatcctgtggaccggcggtggaccacccgcgtggtcccggtccacggtggaccaccccccctttgagccgctgccgagtggggcccgtttgccggcgccccttttccctctctcccgagccgctgaccggtgggccccgcatgtcggcgccgcgccccccttgatgacgtcagccctgggaattattgcgcaataaatgatttaatgactttttgttatagtaataaacacagtgaatcttctaaaattcataactaattcatccgagctccgtttaagcccattcaagtctcagtaagtcaagaaaaatgcgtagaatccattaaaaatggttttgttccctgtttcagtagtcttatagcctgtttgcaatgtttgccttgtatgtcgctagattccggttcctccgacgctccggtgtacttcgaaatagtcgccgaggttcctctagcagcagagcaaggcaagtcatgcttgtcacttgaacatgttgatcctatattgcaaatgctctattgtttttcttcaaatattgcattgttttataatgttactatggggtgtttacctattgtcatagccatgctattgttgtaccatgtccctttgtcagcttggggttataacatgactagagattggactagggattgcttagccatgcttagttcaactagtgcacaatggggaaaattctattaatgtttagactgttggttctaatggtattgttggattagcgccaccgctttggtgttggttaattaaaataaatcacatggtgggctgtgggtgcatggttttgctggtcgcacccatgacagttaaggaccggttcgcgggatgccctggaagaacttatcgtacttaccacaagccagcgtgggcaacggctgggcttgtagtgtagcttacctctagctgacgcatccaggcaagggtgggcgtgatggagcggggcgggccctgcgacggcctctgtcgcttccggattcacctaggcacgagaggggactgcccgctgccttgcgaggagtggcggtgaaacctgaggtgtggtgtgcttggttagagagggttatgcgaagggtcctatcacggcctctttccggtatgtcgtggtggcatgtcgacgcacggaaacgtgtcgtggggctgtgtcttgtgggtacagttgtacacctctgattagagtaaaactattcgaatagccgtgcccgcggttatgggcggtcaaccagattcaccgtgattagtctcaccctagtgtaatctttagaatttggatagtataggtggatggttgggcctgtcgcaacgtggcatagcgttggacagtggatgattaatattgattaattattacaactgtttaaatcttccaacttctgtttataaatgctcgctttatgcaaatgaaccactctagctctcctttgataattccctgcatcatacccctattccggtatgacttgctgagtacagtgggtagtactcagtcttgctctttttttcccaaccccagagtacgagtgtgtgtcagatggaggtttctccaaggagtaggcttcgtccgtgccatcgaggatgcctgtggagtggtgttcccgctgcagttctagtcaaggcttagctcctgttgtctttcgcttttccgctgcatttatgtaagacttttatgatgtttgtaagatgtgggtctgaatgtcaacattgtcgtttgtgtaccccggccggtcctggacggggattttaatgcacattctgcttggaattctattcgggaatttctgggcgtgacagaagcggacggcgtggccctcgggctcgcgaacgcgacggcgttgacggcgtggctcggtgcagtagctagcgatggctagcggcggccgaagatggctaaggcggcagcggcggcgggtgcacggcgctagggcggtagaggccatgggtgagctcggtgaaatggggaaaaggatagggggaggggcgatgatgcttaaataggggaagagggggccggacatggccgagagacgacgggagaggtggccgacgtgggggagtgggagaggagagagaggcgggattcgaaaatagagtcccggccatctcatgggcgcgggcgagcaggagagagagggagtgggcgcgggcggcgacgtgggcgacgtggcccgagagacgcgggagcgagcgggtggcggttgcgggatgcggcggcgccggctggaggtgggagacgggcccgacaggtggggcccacctgtaggtgaccctaggggaggaggagggggcgcgggctgagctgggccgtggcctccggccggcctagcaaggcgcaggagagagaggagggggaataggccggcggcccattaagggaaaaaggagggaaaaagaaaagaaaaagaaagaaatgaatttgcagggatttaaataatgcttgtgctcatttttagttgattaaaattatttctagagctctgaaaattccactaaaaatcttgttagcatatttcgacatgtagaactcaagaaaaattctacgtgccaattccgattattatttgcattaatttattagggtttcactcttgcttttacaccgatatttttcttgagaccatttattaattcattttaggcttgggagaagaacttcagggtgtgacatggacccccagagatttttctagaaatgacttaccataggccacgaagcagcggttgtttcggcgaaacttcgaatatctgagggtccacaactggttttcaatgaggtggttagtataggaatggaacataggacgttagggtggatagcttagacgatgtcggtgtcaagcgcgtcgactaaccgcgccgttaaggtaggctggtgggcgcgacactatgtaatgcagatggagaattctgggcgaaattaaaaccttgataacattgccttccggtcatggaatcgagctaggttttttttgacggctgcagaatcacgggcctcaccctagagagactggatttggagaggtagacccctagagatttttttagaaatgacttaccataggccaggaagcagcggttgtttcggcaaaacgtcgaatatctgagggtccacaattatagtagcccccgactgataactcaaggaagaacttgatgttagcagtcaaagaggaaaataccaaaaaatagtgcctaagcataaaaacgacggagatgctcgatattccaagagttgtcaacatgagtactgtcttcacgcttgagtcggtatgaatctggccgagtaacttcagaaattatgaacggtccttcccataaaggagataacttgtgccgatctcgtgtagtttgaattttcctcaaaaccaggtctccgactaagaaagctcgtgatcgaacgttgcagttgtgataacgtcgcatcccttgtaaataccaagccgactggattaaggctgcttcacgggcttcctccaatcggttgagatcatccactcggttttcttcgtagcgctcctctctggagttacgaaatcataaagactcaaattctacctcagtcggcaacattgcttccgcaccataaaccaaaaagaatggtgactggcccgtagcccgactgggtgtagtgcgtagggaccaaagtacagacggcagctgatccacccatttgccagcgtagggacgcagttggtcaaaaactcgtgcttttattccttggagtaccataccattggcgcgttcgacttgtccattgctcataggatgcgctacggaggcatagcagattttaataccaaagtcttcatagaaatctttaaatactccgccagtgaactgagtaccattatcggtgatgatccaattggatactccaaacctgtgcacaatgttaatgagaaaatctctagccttgtctgctgtaattgtgacgactggtttggcttcgatccagttggagaatttatcaatagctacaaagagatgagtataaccaccggttgcctttttgaacgggccaaccatatcgagccgccaaaccgcgaacggccaggataatgggatggtttgcaactcctgagctggtagatgagtctgtcgggcaaaaaattgacaaccctcacacgtccgcacaatcttgtcagcatcggatatggcggtaggccagaaaaaaccctgccgataagccttgccaatgatggttcgcgcagctgcatgattgccgcagatgcccgaatgtatgtccgttagcaattgcctcccttcctccaaagacacgcaacgttgcagaatccctgacggacttttcttgtacagttcagccctatgcatgatgtaaagtttgcttcacctggaaattcgcttggcttcgtctttatcttgagggagttcttgcttagttaaaaatttgatgaagggctctctccagtcggcttcgagcatgttcacttcttgagtgtccgtggcatcggttgtttcttttcttggtacggtcagttcataaagatgttcaacgaacacatcggaaggagctgcttctcgttttgaaccaaagttggctagtctatcggctgcctcattattgtgtcggagaacatgagttagctcaaggccatcgaacttgtcttctagtttgcgtacctcttgccaataggcagtcatattatcatcgaggcaggaccactctttcatgacttgattaacaaccaattgagaatctccatgaactgtcagacgccgaattcccaaagaaatcgcaatccttaatccatgaagaagcacctcatattctgccacgtaatgggacgcagaaaaatgtatccacaacacgtacctcagccgttctccagtcggggaaatcatgacaactcctgctcctgtgcctgaaagcctttttgacccgtcaaaatgcatagtccagtactcctccttttccacagttgtgtcttcctggcattcggtccactcggcaacaaaatctgctagggcttgggacttgatcgaagttcgtggcttgaaggataaatcaaaagacattaattctaaagcccactttgtgatccgtccatttgcctcacgattgtgaagtatgtctccgagtgggaacgatgtgaccaccgtgaccgagtgactttgaaaatagtgagataacttcctaacggtaattaaaacaccatataacagcttttgtacctgaggatatctggtcttggagttggctaaaacttcgctgatgaaataaatcggccgctggactttttgaacatgtccatcttcttcgcgctcaacaaccaggaccgtgctcacaacctgagaagttgccgatacgtataacaacaacggctcttgtgggtgtggtgaagctaagaccggtggagtggtgagaagtttcttgaagtcttcaaaggctttttgcgcttcgggtccccactggaaattgtcggttttcttcaatagcttgaaaaagggcatcccccgctcgccgagtcgtgagacaaatcggcagagcgccaccatgcacccagttagcttttgcacgtctttctgggaactcggcggtttcatgttgaggatggcattgatcttctccgggttccctatgggataccataaagccaagcagcttccctgacggtactccgaagatgcatttttcaggattcaacttcatcctgaatgtgcggatgctcacaaaggtttcttctagatccgcagtcaaatcgtccttctgcttggttttgacgactacatcataaacataagcttcaacgttgcgaccaatctgtcttgaaaagcatctctgaatcatgcgttgataaattgctcctgcgttctttaatccaaaaggcatggtgatgtagcagtaggccccgaagggtgtgatgaatgaagtcttcaggcagtcggactcctttagtcggatctgatgatatcccgagtagcaatccaaaaagctgagtaactcgcagctggccattgaatcaaccacctggtcaatgcgaggtaatccaaaaggatctttgggacaagattagttgaggtcggtataatcaacacacatatgccattgtcccttcttcttccgaaccaggactgggtttgccaaccagtcaggatgtaggacttccttgatgaagcctgctgctaacagcttggtcaattcctccttgattgcatccttcctatcctgtgcaaaacggcggagtcattgcttaatgggtttagcgtcttccttaacatgtaaagagtgctcaatcacctctctgggaatactaggcatatcagatggtttccatgcaaagatatctttattattttgaagaaaggtgatgagcgcgctttcctatttacaatctaactcagcccctattacagcagtcttagtaggatcagagggatctagaggaattttcttggtcttggtgtcgctttctccgctctttgacatcttggttgcaggcacttctccttcggttgcagttgacgcggccagtcggatttcttcttgagcgagcgtgatctcacggttctgggccatctcacaactttccttatcgccggtaacggcttgcttgatatcgctctgcagggatataactcctcgaggacctggcatcttcatcatcatgtaggtgtaatgtgggacagccatgaacttggctaacgcggggcgtccgagtatggcgtggtacgctgtctcgaaatctgcgacttcaaagcaaatgttctctgtgcgaaagtctcccgagtgccaaaggtgactggcagagtgatctggccgagtggagtagcagatagcccggggatgactccgtgaaagggcgcactactcggcttcagctccgtccgagggatctgcatgtcgtccagagtcttggcgaaaaggatgttgagtgcgctgccaccatcgatgagagatcgtcggagcttgacgttgcaaaccactgggtctagtactagggggtaccgccccgggtggaccactcggtcagggtgatctgagcggtcaaacttgatagttgtctctgaccaccgaagatattggggcatatcgggctaaacagcattgatctcccgctcggtgagcttttgcttccgcttggattcataagctagaggtccgccaaagatgtggttgagctccttgcgggagtcttgaaaaccagtcggggcatcatctccatcgtccttcttcttcgacatgccttggtctccatcagtcggcttgcgtgcgttcttggcgtattgctctgcgacctgtttgtagacgaagcaatctttggccgcgtgattggaatttgggtgatgtggacattgggagttcatgatcttgttgaaagtgttgacgcgcgaacgttgccgggaggatggtgtggtagttgctacaagttcctcgggcttacgcttgtgatccttgtgattggtactgttaacagtgaaatttggtaagcccaaagttaccatcggcttagagttagtgtcggcttcaaagttctagaattagccgatgggagtcaagtcgccacgatgtcgtgttcttggttgagtcggatcaatcaaaggaagattatctagaagagtccgagttcaagacggatgcgacatgacagtttatctattaattaggcatagtttgttagtttccttttatctttaggaaagtgtgtttagtgtccgataaggattttatcttttcctttttagtttctttcttgtccgacaaggacttgtatcaacccatgggtataaatatgtacacccggggtctatgtaatctatctcttgatcaatacaatttggtgcatcgccaccctttttacttctacttttgtttttacgttccgtcggaacttggcacccgacgcggggctgcatcgtcttcaatctccggcgaagggataagtccaatgtttcgccggtccaggcaattgtatcatctacgtcagcgtcgttcaaggctgcatcaatacattcgacctcttgaattgctctggtttggatgatatatttgcctacctatttatcatatgtctctgttaatctagtcttagcatatcaatttagctctatcggctgcttctcgttttagggtttatgtcacgtcccaaaacgactctaaaatacatcctctaaattatgcctagaataattaaaatccttgtgaaaccctccaaaaattaaaatgtgcaaagtaaaagtcaaataaggcttagaggatttttgtatatttcctaaaagcctaaaatgcgtaaataaatattagtggaattttcagagcacaaataataattaagaagaaataaacaaagttgagaaagttttataaaaagaaaaaccctaaaaatcctccttccctctcttgggccgaatccggcccatctccctccccctctctcctctcccccgcggcccatccggcctctccccgcgcgcgcgccgctgacgggcgggcccgcctgccaccctcgctgacgggtggggcccacccgtcatccccgacctcccgctgctcccgccgcctcgcccgcgccctagcgccgccgccgccgcgaatcccgccgcctcccaccgtccccgcgtgcaataaagtggggggaattaatccccgtgatcccctctccctttccccccatttttccctctctctctcgcgttcaaacgggcggatttgcccccgcaaatctcgccggcgccattgatggcggccgacctcccgcgccggtttccttcctccccgtccgccctctcccccttccaaccctatttaaaccctccccgcacctcctctgtccggttccgcctctcgccgcccttcctcctcgccggattcaagctcgcgacgtcgctctctctctccatcgtcgccgccgagctccggtccgccgccgtcgttgccccggaccgtctcccgcctcggcgccgcctccttcggctttgccacatcctcgccgacctcgtccacccctccgtttcagtcgccgaccgccggagcgccgccatccccatcgacccgagccgcgccaccgcctccctccactccggccgcctcctccgtcgccgccgtcgccccggggtgagccgtggaccgtcgcctcctttcccccttccctcccctctctcggtcgccgctccgctgcgccggtggtcgccggcggcgaccatcagggcgcgggctcgccgcctcccgccgaccgcgccggcatggccgccctcgggcgcgccgagtggctgccgcgtggggcccgaccgtcagccgcccgcgcccttgggtgcggctgacgcgtgggacccaccgcaccggccggtatgagcccgggtgcacccggtccaccgtggaccgtgaggctgccacgtgggccccactcccgtggacccggtccgcgtgcccctcccctcggttgacgcaataaaccctttttaaattaaaatttaaatggagaaattcgcaaatattcatttaaagagcatataaacttcaaatggtcataacttggccatctggactcggaattggaccgttcaagtctctaatttttccttaagaagtcaagacccatttttgtgctttgttcctgcttgttatatggaatttattagagtaaaagcccttttattttccgttggtcgtgtagacgctgcagcttcggaagatccgctcttcgtggaggttgaagccgacatttgggaaagcgagcaaggcaagtcacatcatccttgaacatattggatcccattttataaaattattttgatttaaattattgcattaccgctttacttaaattcccgcgttatcactgttttatttatccatgcctatttgcctttgttatgaccttattattagtgttattgatattattaccttgttcaccctagattaaacaaaaccccaactagtggacactctattcatggtaccactagtatgaatttaggtagatgcttaggcaacattatgtggttttacaactctagactttgggaatattttcatcacctggacactatggaatggttggattattgtggaattggattcacacctccccctctattcaaaaccctcaaaatggttttaggctggactcggggtgcatggttttgatagtagcacctcggccatataaggaccgctcttcgggcctctgttgcaaagcactaccgtacttccacatgtctagtgggtaaggcttagtttgtggctcagtctagttataaacaaaagtacacggatggagatggacgaaatcgggggttgatggacatctctagggcaaatgaaggctacacgagctgcggcccggtagtcgagatgtcatggcacagggccggtgtcctgctgctaggggctcagtcctccctacctgtcccgggggttccgtccgtaggtggggttgggtcggtactcttgtctatggctaggatggattggaaactgtgtcatgtcttccgtccgtatgccgtggtggtatgcggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggaccgtgtttacaaagtagttttgagcaactaagtgacttttaatgctgtttactgcaaaccctaaccctttatattataactcccttgtactcccttgcatttattctgcacttgtgggtgtgtcttgttgagtacggtggttgtactcagtcttgctcaatttttcccaaacccagaagaggagttcctggaagatgaaggctttggtgtttagctcgtgcctgccgtcaagcgcctgtggtcgtcgccctagtcttccgctgtttttcgtttgtcttctggtgtgttgggccttcgccgcccatgtaataaattaactatttacgcttccgcttgttgaactctgaaatgtatcaacttttggtgtaccttgcctcctgggacaaggaataatacacgcacgtaaggaacgcccgttgggttatttccggtcgtgacagtttatgccggtatcagctaaatcgtgttgctagattacattagcttagacatctaccaccctgaaaactcagtcaatggcttgattgtctagatattatgtttcttttcatacttagtgctgcatcagttaagtttgatctactaagttgtgcttagaaccataatctctagcctgcttcttgattgccaataagggtttcatcggggtttcagccggtgagttatctagacgttgcatcggctaataaggattgcatatacatataagttggatttagccgatgacaacaaagtttcactgtttaatctaatcttgtggatttcatgacatcggacctccagccgatgtgtgctttaaccttcggatcgatgcttatttatttgccgattggtttatactggattatcttgttattttattacatcatcatcagccgatttcctttatatcatcatctacattagacatatagccgattgcttaaaccctatcgctatcggctggtatcggcatcggctattatcggctatcggctggaactactctatcagcttgtcagccgatcggctgttttgtctactatttgcatatcttgtcaattgcaggatcaaactgactggcacgcccgcatctcatcaagatttggacctgcacaggagctaagcagatctcctaggccgccatgttcgattttttcgtcaacaggtacttccactcccccctgtagtcggcgcatctttctttggcttccaggtgctgcccgactgcttggatgcagtgaccgcgtcttcggctttggcatactcattggctttctcaaacatctacttgactgtcctaggaggtttgcggccgaatttgccgactaaaagctcatgacgaatgcccttggtgaaggcggcgatgatgacgtcatcggtgatgttgaagatcttgttgcgttgcttagaaaaacgacggatgtaatctcgaagggattctccgagcttctggataatgttatagagatcaaactgggtgccagggcgttcaaaggtgccttggaagttggcgatgaagtggtcgtgaagctccgcccaagatccgattgtgccacggggtagcccgtggagacaggaccgggtagaatctgctagagccacaggcaggtagtttgccatggcttttgaaagtgcatctaggacccctcatttattttggtgttaatgataacacaattagaggttcactaatgctctttgttgagatggatgcaaggataaaaaggagtggaacttgagtttaaaagtattgtggcatcttttgtggtaattgtcttctaatccatgtatatcttgtgttctttagtattaggatgtcatactattaagagggataccacatgcttataattggtagaacactagtgctcgaaatcctgtttttgaagtgttcttgttcttctcctgtcggactatccgatcctgatcagactatccgatgctcagactatccgaaatttctcaaaactttgctctctgtctttggtctgggtgttggctcaaaaatattggactatccgatataaggtcagattgtctgatacatcggactatctgaaatttctcagaacttcactctctgtgttgaattgctttttattcctcttgagtgatttttttctctaagtcaaatcagactatccgatgtaatcggactatccgatgatacagagactccaaaattcaatggaacttgagtctctgtgaggatgaagattttgcttcaaaatatcggactatccgacatgacttcggactatccgacatgtcagatagtctaaaattctccagaacttcgttctctgtctctggctagtttgggacgcaaaaacatcgaactatccgatgtcatctcggactttccgaggtgggatgaaaagatttccttcccaatggccacatttcgggggcatctataaataccccccacctaacccttttctagggttacccaactcattcattcacattcactttgggttgagcttggtgctaaggtgctttggatctttgagctctttctccctctctcaaatccctcctcgttctttgtgtggtggatcttggtggttctggatttggtgtttgagggcctagtgtgtgtttcactcgatcttgagcactagggtttgaccaagagttgtgtggtgtttgctactcttggaggttgaggactcctagatggctaggtgttactcccgagcctctgatctacgtatggttggccgggagaagtttgtaaaggccgaatctcgcctctgcaaggaaagagataccccttagtggaaggaggagtgcttagtgcaacctcttgaggaaagggttagcaaagacccggctcttagtgagctcctcaacagagagtagaatcccctcaaggatttgaactccgggaacaactcggtgaacttcattgttggtgatatctcttcatcccctatttagctttgcttattgtgccgctatagatatagtcgctgtttgcgctatactcttgtttgtgcactagatctacttcatgtgtttctttagtggatcagacagtctgttccaacatcagactatctgatatttttggatagtctgactgtggatcagactttccaaccctaactcagttttagcttccgcataaagttttaaattagcctattcatcccttccctctaggcctaattgaccctttcagctttgttgtctcctcctgctgcgcggattgcgagaccgtagacggtgagccaagattcagggttagtggtgccgtcatacttctcgattccagtcggcttgaagccagccggccaatccactcgacgcaggtcgtttgtgaaggcagcaactccatccacatcgtcatcgtaacgatctggtgaatggtgggggttgtagcctcttgtcgcgcgacgctggttgatggtctcgcgaagatcgatgggacgcctgcggtgtggggagtgggcacgttcagctcgacgctccctatgccggtcagggggcgagtggacagatcgttcgctgtgatccctgctcctgcgattggatccctcgccgacgacactaaggcttggttggtgatagtcttgagatcgaagaggtggaactcggctgccggtcggcgtgcggatgctcgtggagttaactgggaccgagacggtgatcatggccttggtctagttcaagatgttgacgacgtgatcggcctgattgagtgcgccttccttgaggagggtatcgaggagggtgatcgctgcaaccgtgttctgctgaggggtgcgaaaaaccatcgtcccctcgacatcttgttgcctgatgagttctcgtgctcgtcgcccggattccaaggtgcgctgtcgtcgatcctcagcctccttcgcagcccgctcgcgatcttgttgttcacgctgcaatcgttctcgctcttgtcgttgtcgttcttcctccagtcggtgacgttcagcttcttgtcgtgtgcactcttcttccgcttctcgggttcaccactgttccgccgtctcgttgtcggccatgaatacgccaaagaagagaggcgtgtagtcgtcttcgtagctttcgtcgaagtcgtcgaagttgctgaagtcatagcgatagccgaagtcgtcgtactcgaggatctccgttggtcgagaactgacgccgggggagctgaggtagccgtccaattcttccgtcgagaccgtcccgagaggttggagtataacgccgacttccctagagttagattggattgaagccgaagctgggtcccgtctaggccttcggggagaagacgccttggtggtgaagacagcggccagatcattggggagtctcatcaggattgagggatagggcccatcgtcttgatcaggtcgtgctggagtagattggatctcgtccaagtggtttgaagccgactcgatcgagatgatcttggggtagatctcggccgagttcggaataccgaacggggcggagacctagcctctcctcgactggttcggatccgagtcaaggagagaaatcttgccgaagtcgttggtgatgaagtcgaggctgccaaaccggaacgcctgcctgggagggaagacaaagtcgtcgatgccggagacgaaacccatcgcactaatcagcgaaaaacttgacactacccctacctagcgcgccaactgtcgaaacaagatttcggcaatactaaaagggggtggctattgagctagaaaagtggatgggtttagagacaagaaagtttatacaggttcatgccttcttaataagaagtaataccctactcctatccggggattgatccgccgagtgtattattgatcgtatgatctgggagtaaaaagtcataccccaagaggcgcccggacccctccttatataggcgaaggagtccgtattacaaaatacagcccatatccctaacggaataggtagttacaaatatggcctaatcgtaaccgacttggatcccgggtatttccttaacatacaagtttggaacttaacccaagtctccttaaagatattctatctatacatggcaccccatacccagtcggattatacatgccgtgtaggtatggggtatccataatctccacaagtatgctcaaccatgttgaggctctgtttgtcgcactgtaccactaacttggcgtttccctggatagtgattatcccttttggtcctggcatttcgagcacttgataagcatagtgggacgctgccatgagctttgcgagtgcagttctccctatgatggcgttgtatgcagtgtcgaactctacgacatcaaaggtgatctgctctgttcggaagttgtcggcttgtccaaaggtgatggccatgggtattgtgatcttacccaatggcttagatgatgattctggagtgattccatggaagggctaatctgtaggcgccagctcgcttcgtggtatccccatggcatctaaggtattggcgaaaagcaggttaatggaactaccaccatcgatgaaaacccgtgctaccatgatgttccgaatagtgcgctcgaccacgatcagatatctgccaggtccggttgcaattttcgggtggtccgcctgcaagaactcgatcttgtgttgggaccatctcatcttgggaccatctcatcttgtgttgggaccatctcatcttgggaccatctcatcttgtgttcggcaatatgaaaaaggggtagcgcacgagacctaaaagtggatggatgcggagacaaaggattaagacaggttcaggccctctcaatgagaggtaataccctactcctgtttggggatttgaatccgtcgagtatgtatagatctgacgatctagttgtctcatgccccctagagggcttcctgcccaccttatataggatgggggcgggattacaagatagaaaccttaaccaatacggtatcggtttcctaaatctattttacaatattatcaaatcaggactttaggccgctccataatataaaaggaaacgtaatacccaagtcatgatcggttacatattccatagatataagctatcccctatgactaatcggataaccatgccgtgtgggtatggggtacccataatctccacagtagcccctgagaccttcacagtcgtaaagataatcttttcttgaactagattacttcaaagccgagtgcttcaatcatctccgccatgatctcccgagtgcttttaccaaatatgaagactgtggagggctaaaaaataaagtcaggtgcatcgaatagatgtacctaatagatgcaccaactgagtggttttgataattgtagtcaaccaagcgacttgatattaatatgtagcatatgcggtgtgaatccttgaacgacatgatccgagtgatataccgactgctttgtaaaatatgatgagtgtaacctaaagttggctacattattgaaaattcacatagcaaaacagctataaagaagcttgaatgccgtgaataaagaaatttccaaagtattgggcatacgccatgcgcacactgctttaacagatgtgcttaagtccctaaaagacacatggtttcaccacacccagaaatatacggcatatgtggtgtaaaatccgagtaaataaactcataaaggatttaccaaccacctagaaaatgaccaagatatataatcagcctaagccataatattggtcaataaaaatgcacacttacgtggcaaaaagcaacgatattgtatccaatcaattgcttgataaacccaaacagcgccatgactatataaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgtagacatattaggcctaggccaaaaaaatatgccttcgacaccctttaaaggatgacgcatataacatgctcccgagtagtaaatcttccgggtgatatagaccaagtgttgctcatatcaatagcttctgatatgagtgattatcccttatgagatactccaaaatagatataataattgaatcccgaccgccttatggggaataataaatagtccagtctttgagcatagaaaatagacccatgatcattaaattcatgttgcatgtatccgaaacaagtccaaattgaaggtatgatactggtgtttgaggtagtaagcccctgagtatatagcttgtccttttggagtagttgaaattatccatcggtgatagctgatgcaatcggcatggaagcgaagaaaccagtcagcagcagtcagatcaactaacagtgaagatgaatgcacccagcaatagcgacagagttttgtagccttggtgacgaaataatcagtcggagacgacgaggcggtcggtcggtgaagacgtagacgcccaacagacggcggcataataggccagccgtgtaggcggagacaccagtcggcggcggcgaaggcaagccggtcggtgaagacgtagacgcccaacagacggcggcataataggccagccgtgcaggcgaagacaccagtcggcggcagacgaggcggccggtcggtgaagacgtagacgcccaacagacggcggcataataggccagccgtgcaggcagagacaccagtcggcggcagacgaggcggccggtcggtgaagacgtagacgcccaacaacggcggcataataggccagccgtgcaggcggagacaccagtcggcggtagacgaggcggccggtcggtgaagacgtagacgcccaacagacggcgacataataggccagccgtgcaggcggagacaccagtcggcggcagatgaggcggccggtcggtgaagatgtagacgcccaacagacagcggcataataggccagccgtgcaggcggagacaccagccggcggcagacgaaggcaagccgatagtgatgttctgactgatccattcctgaagcgtaggagataagcttaaagccgtgaatcccttttatgcatatctggatctggatcctacagaacaaacagataggatgagtagtatctgatgtaaatataatactcgagaaaaatgcaagtattttaaaatatttataaatatgtatttcttctcttgtcaattttgatttctccgagcagatgactcattacgtttaaacactctgcccgactagtcatagccaccaagcaccgggagtcggcctaagcacttcccaaacatgcatatgagtgacatgagttcgtcattaatggaacaaagtttcatgggtcagagtttactactcgggtacttttgcaattattaagagcagaaaataaattatcttatctctatgcttttgatttattccgaataatgcttagcaccttgcgttattcggtccatccaacaagccctcgggtgctaggaatcggcccaaaggcaactatccattggcaaaccaaacggaaagcataggaagatggaactccataactcgataggcacttttgtactcagaataagtcgcaagcaatcaagataaatattatgaaaattgtttaaaaaatatgatataacatttgtagcccccgactcactagtcaacagcgaaccagttgatatagtgaggcaaaggaaaaggtaaaatatcatataaagaataaaacaaatgatgacttagctttgtcgtattccctcggtgacagcagaagtagccgatgtgggaatgaagcagtctatcagtggtgacaaaaacaccagtcggtgccagtggaaccaagccagtggtgtagataatgaagcccattaacggcggcgaagtccgccaaccgtataggcgaaaacaccagtcagtggcggcagaggcaggccggcggtgaagtcgtagacgcccaacagcggcggcataatagaccagccgtgcaggcggaaacaccagtcggcggcggtgaaggccagccggtcggtgaagacgtagacgcccatgtatggtggtgtgaccaaccaaccgtataggcgaggacaccagtcgacggacgcccaacaacggtagcatataataggccagccgtgcagacggaaacaccagtcggcagcggacgaggcagccggtcggtgaaaacatggacgcccatgaatggtggtgtgaccaaccaaccgtataggcgaggacaccggtcggtggcgacggaggcaggccggcggtgatgatggcggaggcaagccggcaacgatgaagtcagggaacggagaaacagcttcgcactccagccggtctatccatgtggtagcatgcgacgtctgcccagctcgttggtttgactctgtcgactcgtcctcctggcgacgtgcctctgtgcatttagatcaggcactcgtgtacagctcggacagaggtggattgatcgataccatccggtgattaaatcaagtagtagttgcatgaatcttaattactccatattagacaacgttgcctatgcatggcggcaaagtccaagctcccaaaacaaacaaatttgcctgggaataacgatagtatatatgctggtgcttcagtaattggagacacgtgctgcaaagtctgctaattataattccagataaatctgttgtcagtggattccgctatatgcatgtatattgtatacatggcgaaatcgcacacgattactattccgattggatagatgactgccttccgtcgttctgcgtctggctaatcgcagctgagttgaaatcaggccgaacggataattggcgtgggactcgtcctggcaatgatcggattccgacggcggcaaggcatgtatatatatggtatttgatcttgaactgaggtcttccaaggaggtattgacggcggcggaaattgaatccatcgaacatgtcgaggcggaaattgaatccatcgaacatgtcgagactgatcttcccggctagattggatccgagtcgaagagcaagagcatgttgaagtggtcggcgaaaaaaactcccgaagcgaagatgaattcggtgactcatgaagttgattccatcgcacttgtcgacaggtaactcgacgcaacccctacctggcgcgtcaactgtcgaaacaaattttcggcaatatgaaaagggggtagagcacgagacctaaaagtggatggatgtggagacaaaggatttagacaggttcaggccctctcgatgagaggtaataccctactcctgtttggggatttgaatccgccgggtgtatattgatctgacgatcagtttgtgtcatgtcccctagagggcttcctgcccaccttatataggatggggggcaagattacaagatagaaaccttaaccaatacggtatcggtttcctaaatctattttacaatattatcaaatcaggactttaggccgctccataatataaaaggaaacgtaatacccaagtcatgatcagttacatattccatagatataagctatcccctatgactagtcggataaccatgccgtgtgggtatggggtacccataatctccacagtagcccctgagaccttcacagtcggaaagataatcttctctcgaactagattactccaaagccgagtgcttcaatcatcttcgccatgatcttccgagtacttttaccaaatatgaagactgtggagggctgaaaaataaagtcaggtgcatcgaatagatgtacctaatagatgcaccaactgagtggttttgataattgtagtcaaccaagtgacttaatattaatatatagcatatgcggtgtgaatccctgaataacatgattcgagtgatataccgactgctttgacagatgtgcttgagtccctaaaagacacatggtttcaccacacctggaaatatatggcatatgtggtataaaatccgagtaaataaactcataaggatttatcaatcgtccggaaaatgaccaaaatatataatcagcctaagccataatattggtcaataaaaatgcacacttacgtggcaaaaagcaatgatgttgtatccaatcaattgcttgataaacccaaacagcgccatgactatataaaaaagttagcagggcagctatataaagctttattgtttgacaccttttaaaatgcattgtaccaactcctaaaaagttgagtaactgcggtataaaaggattttaaagtattgggcactagatcacgcgcactttggcctaaccaaaaagtgcctaagtccctaaaagaacgtgacaggccacacctgaaaatatgggctgcagacatattaggcctaggccaaaaaatataccttcgacaccctttaaaggatgacgcatataacatgctcccgagtagtaaatcttccgggtgatatagaccaagtgtagctcatatcaatagcttctaatctgagtgattatcccttatgggatactccaaaatagatataataattgaatcccgactggcgcaagtattcggttgatagcccttacggggaataatgagtagtccagtctttgagcatagaaaatagacccatgatcataaattcatgttgcatgtatccagagcaagtccaaattaaaggtatgatacttgtgtttgagctagtaagcccctgagcacatagtcacaattgttcattgatggtagctgacgcagttggcatagagacaagactaccaatatagaggcgaagaaaccagtcggcaacagtcaggtcagccagcaatgaatatgaaggcgcccagcgataaagttgtgtagccatggcagtgaaataatcagtcggtgatagacgatgcagctggtgaagaagatgaagatgcccattagtggcgacataataagccatccatgaaggcaaggataccggtcggtggtgacaaaagcaagccgacagtgaagatgtagacatgcatcaaaggcgatgacgaaatccaccaatcatgaagatgaagaaaaatagtcgacggcgacaaacacaaccgacatgatgaagatgatgatgtcagtgatccagtcaatagtagtattgcggccgatgataatgacgaagacgctcatcagtgtttgcatagtaggtcaaccatgacggtgaaataacaagctggcaatgatgaaagcaactggaggcgaagacgtagtcacccattagcaacggcagagatgtcaggaccgatgaagtaaaggtgctggtgatgatgtcagtgacaataatccatcaaactgttgagaagatatcaaagctcgagtagtttccttgatgcgagcgtgtgcataaagaagattgatgcaacgctccttgatttatgaagatggcagtagaacttggtgttatagctgttgcagatgcttcatttggaggaaaataaatgatgttgtccaactcgttgaatctgagttaattggttgataactccaaactcccgaacatgtagattaaatcttgaacttgatacttgagaattttggaatagattgtggcggcgtggagaagccaaaattgccggtgtaataattagagtcgctgaaattaaatgtcggctctgaagcaaagacgaagataataactcccagagttgactcgtcgattgattgattgcttcatcttgccataaagcttgtcgaattttgagagtcttgtatttgtgtagcccccgactctttggttagttgggaaacaactgaacatagagtcgagaattgtagcttcttgtcgtcgagtactcattgcttgagtaaagatgcatgttgaagatgtccgagtagaaatattgaagattggaacaccacttgttgtaataaaataacacggcatcatatttggtgacgcatgccgagatgtcgaagctcttgtagacgtcgtggttggtgaagtagcaaaacttgcgaagtagcggcaatagagtttgccggtgccgaagataatgaagatgaagtcgctccaccatgatgataaagttgcatagccatgatgaagtgaatacgagtcgacggcaacataaacaaaccagtagcaaaaacgcatagttatgaagataaaagcaccagtcggtggcggcataaccagtcggcgacggaagacgatgatgtccatcagtagtggtagcagtcggcagcagacgtaggcagcttgtgttgaagatgctgacgcctattagcggtgacggtgatgtaaccagccatgaagaagatagcatcagttagcgtcataacaggtcaaccgtgcaggtggtgacaccagtcggcggcggatgaggcagccggtcggtgaagcagccggtcggtgaagacgtagacgcccaacaacggcggcataataggccagccgtgcaggcggaaacaccagtcggcggcggacgaggcggccggtcagtaaagacgtagacgcccaacaaaggcggcataataggctagccgtacaggcggacacaccagtcggcggcggacgaggcggccggtcggtgaagacgtagacgcccaacaacggcggcataaaaggccagccgtgcagacggaaacaccaatcggtggtggacgaggcggccggtcggtgaagacgtagacacccaacaatggaggcataataggccagccgtgcaggcggaaacaccagtcggcggcggacgaggcggccggtcggtgaagacgtagacgcccaacaacggcggtataataggccagccgtgcaggcggaaacaccagtcggcggcggacgaggcaagccggtggtgatgttctgactgatccattcctggagcgtaagagataagcttaaagccataaatcccttttatgcatatctggatctggatcctgcagaacaaacatatgggatgagtagtatctgatataaatataatactcgagaaaaattcaagtattttaaaatgtttataaatatgtatttctcctcttgtcaattttgatttccccgagcagatgactccttacgtttacacgctctgccctactagtcatagcccccaagcactgggagtcggcctagtcacttcccaaacatgcatatgagtgacatgagttcgtcattaatagaacaaagtttcatggatcggagtttactactcaggtacttttgcaattgttaagagcagaaaataaatttatcttatctctatgcttttgatttgttccgaataatacttagcaccttgcgttattcggtccatccaacgagcccccgggtgctaggaatcggcccaaaggcaactatccattggcaaaccaaatggcaagcatagaaagatggaactccataactcgataggcacttttgtactcagattatgtcacgagcaatcgagataaatattatgaaaattgtttaaaaaatatgatataacatatatagcccccgactcagtagtcaacgtcgaaccagttgatgtagtgaggcagaggaaaaggaaaatatcatataaagaaaattaatgatgacttagctttgtaatattccccttggtgatggcagaggtggccaatgtgagaaaaaaagtcgtccatcaataacaatgaagacaccagtcggcggcgacgaaggcggttgatggtgaaagcgaagatgcccaccaacggcggcataataggccagccgtgtaggcggagacaccagtcaacggcggcgaaggcaagccgattggtgattagatgatgtcacccaggaacagtggcaaagtcatgttgccacgaaggcatatatgcacaaaaagagcaaaccaatctggttagtaccaacaaacagaatagttatagatatatagacaaatatatgctcctgttggcatgggcgattgtgttgatagcgccatgattagttgaggcgtgctgacatggattccggccgaaacaatcgctaggtgacattcatgtgacagcacaattaataactgtcacgcccagccacggacaaccggttgatcttggtcagcatatacatacatgcaaagaaaacgattagtagattaatctgttatcaagcataaaagcatgtatataagcatatgtatatatcaatgtatggctcagagctccttgtaatcggctgctcttatatgcccctggtaatcagcaatgcttctcgcgtgaagactgccggttaacctatgctggcgtgtagatcggtacagagcgcgaacggaattacatcagcaggacacatgaggtcgccgaccgagtggcagattaaaaccgttgaactcattgagatgaaggttgaaaccgtcgaactcattgagatcgatctcagcacatctccagaaattgattccatcgcacttctcgatggaaagctcaacgcaacccctacctgacgcgccaactgtcaaaacaaattttcggcaatatgaaaagggggtagcgcatgagacctaaaagtggatggatgcggagacaaaggatttagacaggttcaggccctctcgatgagaggtaataccctactcctgtttggggatttgaatccgccgggtgtatattgatctgacgatcagtttgtgtcatgccccctagagggcctcctgcccaccttatataggatggggggcaagattacaagatagaaaccttaaccaatacggtatcggtttcctaaatctattttacaatattatcaaatcaggactttaggccgctccataatataaaaggaaacgtaatacccaagtcatgatcggttacatattctatagatataagctatcccctatgactagtcggataaccatgccgtgtgggtatggggtacccataatctccacagtagccccctgcgacgtggagcagacttcgcgttctatatttttgtactccctctttgaggtgtaagatgtagaaccgctaaagatgtgtgagacgtggaggtcgtattctaggaatacggagtcagagtcggaagtggccgtctcaacaatcgtttcgacaacacgtactctctttcccctctcgattgctagttgtcgcgcgagctcctttttgaagacgcaacaatcttcaatggagtgactgttcgtcttgtgtatagggcaccattgtttccgtgagtcatcgttctgggcgtttgggcgcttgggtgggtccgtttgtgtaacaacccagcgcccggaaacggtattgggtcatctcatttagttggaccacacctaacactattaactcacttgcgtttttgtcctcgcttcacgcaaaaggttcgaaccggagttaacaacctccaggctcccatccttataagctgctgctgctctagctgaagtagcgaggtggtactaaactcggctgctacagtgccgcgagctactactgctgcacttctgcatgcacggacactattaactcacttgcattttcgtcctcgcttcatgcaaaaggttcaaaccggacttaacaggaccccatccttataagctgctgctgctctggctgaagtagcgaggtagtactaaactcgggtgctacagtgccgagtactgctacagtaccgcaagctgctactgctgctgtctgctgcgctgctgcatgcacggacggcccagcccagctgttgcttgctcacatgggccggacaaggcccaaggccagctagcttgctcttttttttagggtgttacagtttgctcagcagcgaggacctcttccgagggtttgcgcttcccacaattatgacttctcttcttgctcaactctggtgcgtctttattggctggtgtcacgcccggaaaatatctttcccgaacgctcatatattaatccccatcccaggaaaagccagggtacaccacacaaacatgatacaaaagacacatctttattaattatcacgataatatttacattattacaaaggcacataaggcctaacaatcaaagaaaaacagcagtgtactagcgggcctagggcttcatcttcacaggcgttcaactggggtataagccaagactccatctaaaacttcctcttcaagacgcttctctgactggagggggaaagattgagcaaggatgagtacaaccaccgtactcagcaagccacaccgggaaaatgcacttaatgcaagggagtacaaggattcatttataagggttattttgcagtaaacaagcacttcaaacatttagttatttaaaggcattttaataaaatcacatcctatctctagtcaaattactaccaagtcgtgctacaacgcaaacttacatgggccgcgcaacgatgcgaacccacttaaggcgcgctacgacccgaccttaccttaacccaacccacaggctccaaccatgtgttccaactctacagacagaaaccactaactttgggtcattgctccgcttgcccataaccaagggcgcggctattcgaataaatttaaccttggccagaggtgtacatctttacccacaagacacagtcttgactacacgtcaatcgtgcatcgtgatgccggaaaggtacccgaagagccaagatcaccacataacccatcgtttagtattgtcctaaacaaagaagaccgacataaacttccacggccagtagactctgggacaggtggatagtctatgcccctgggcgcaactgccaggaatgtccattgcaaactagacatgtggtactacggaatatgctttgcaatcatgccccgaagaccagtccttatgtcggctgaggtaggacaaacaaaaccatgcacctcgagcccagctgaaaatgagtttgggaattttgaaaggggagatccaacctgtctaggctaacaagcctctaatccatcattatcaagattatagagtcattcccaaagtctagattattataaaacaactaaaattttctaattaagcagggctaagcataatcctaaaatgtctagtaagcaccacatatagagttctcactagctggtttttgttacctagggttgtcaaaggtaaatacacaatattcaataagtaaagccataacatggaaatgtaggaatggctaattaaaacagttataacgcggtaaatttaataaagcgaatgcaataatttaattaaaatacttttcgcaaatgggattcaatatgctccaggagagcgtgacttgccttgctccgagaaaaggagggcttcggaagcttctgcgacaaactcgaacggcaccgcaggagactccaaaatgacaggaactacacgaacaacacaacaaggctacaacgctaagaaagaaacaagaacaatacataaaaacaacaaatacaggatctttaagttataacaaaaattagacaatttggacgggtcaatttggagatcgtatggccgagaaaggaccatccgaattttaggtgcaattaaagtggaaatttctgagttgtttaattattattaaaccattaaataatgtgttcttcaacatcgctcgaggaaacaaaggaccgaacgactggtagctaagacccactggtcagacggctagctcaccgtggaccgggttcacagagacgatccacgggaaggacgagtgagaccgtacgtgtcaaccaaagcaagtggccgacaagcggggactcacacgagtgccacacgggttgcacacgtgcgcaagcacgaggcggcaacacgggcacacgacgacaactaccacccgtgcacgtcaagaccacacaaacgatggccgatgccggcgcactggaccggagccgacaaaagcacgacgagcatggggcgacgtggggaggacgaggacggggcagcgaggagaggggtccttaccaccacgcacgaggcgaggaaacgatgacgatgaccgacgacgaacggaggagactggcggcgacgaacagggcgacgactcaaggaggatgacttcggtggcgacccttgcatggaggcgaggatgggcttggtgcagtgacgacgatcgaacgaccttgacgatgacggcggctttggcttggtgaagaggcggacgacgataggatcagcttgacaggaacggcagccgaagggggatgaagcaggaccgaggacgaagacgaggcaacggccagggaggaggacggcgatgtcgggcggcacaccggggaaggcgacggcgcagccggccatcacagcgggtcgacaagccggggacgacaatgccacggcgcacgggtgccgcggcaggggtgacgatggtgggggcacacttccggcttgcctcgggtgaaacagaggcgaggccgggggagaaggggtggcggatgagaggccgagggtggcagcggaagggtttggcgcggctccaatcggcggggaggtgcggccggggctcgccgacgcggtggagagagaaggccgagcggggagacggtggggagaggcttggcttgcggggtgaaggaaaaaggggaggaatgggaggggcggtgccattttgtaggccgggaggagggaggggaacggccgaagggagctcggccggccatccatggcggtggttcaaggaggcttaaatccggtgaattaataccgaattaggccttgttcggttacgcccggattcaatccgggccaggaatgacaagtattgatgaactacttgcagcaangcgcatcgaccgacacg

SEQ ID NO: 73785 - DNA, 8769 bp, Oryza sativa
tcctcggctctagttttcaccggcgaggtatttgctcaaaagcgtatgtccggttgcaaaaattttttgccgacgtctgcgaaaatgctttttccagtagtgcgtaggtcgcatgggacatgcaaacaagcaaaacaatctcagattagccttaaaaaaactaattttgtagatgcaatgggcatgcatgtatcgatcaactatgcactctgtttgccagatgtgcatgcatgccgatcaatctcgtgcatcgacgccagatccatcgacgcatatgcgtgattgaagcagctccgacgacggtcaagcggatgcgtggcaaggtgcggcatcaaccggggccgcgcggggaagcaagcatgaatcatgatgcgggaggttgcacgggacgagaagggcggtcggcgagctgcgtcgcccaccgcgccttcctgcatgccccgacatgaacagcctggggtcgcgccagctcgtgacgcgtccacgacttgcgcgatcgccaccccggccaggatagcacgtcgcaggcgtgcactgcatcgtcctgcgctgcttatgccatcaacgcgatctcgtcgacggtatcaatcggtgattgaagccatctcctcctgatgattgatctagcgcccctctacctggcgtatcaacagtcgattctctggatccgcaatataatttatagggtgcacgaaattaaggagatatggttacacagagtttatactgattcaggctctcaggggtaatgccctagtccagtcgaaattgctaattggcgccccccgcgcgcgactgggcacgtggcgcgatgggggagggggagggctgagcggcgcgatggggaagggccacatggcaccggttcgttttttcggttctctgttggttttttttcggttttcctgttggttttttttggttttcctgttcattttttcggtgtttttatatgtttgtacgacgtatacaaagtttgtatatgtcgtatacaaactttgtatacatgtttttttctttctcggtttttttgtttttaatatgcacgtatacaaagcttgtatacgtatgtatacaaagtttgtatacatgtatatattttttataaaatatatacatatagaaaattatatttatatacatatatataaactttgtatgtacgtatacaaagttacatgtatgtatatacatatgtatataggaatagtagtatatatcatagtagtagagtatatagtagtagtatagagactagggggagtggggctggtcgcgcgccaacgcccctaagtccagttgtatgagattagatttgtatctaagtatccgcagcataacgtgtgaatagcacgtagaacgtatcgtcctcttccttgaattagggttttcggtcctccttatatatacttggaggcggccaattatggtaggtaacaaatcacttataatataggaacctaccatctatttacatgagataagatcggttgccttatctagccacacatgcactgcataaactcagacctacgcggccctctctatgttatgcggcccaatggcccaaccgtgggtacccgggtaccgtgaccccacaatagcatccctcctcatcgctgtgaaaagggcggacgtggttggggaatgaggaggcatgtcgtcgtcccttctcgctgccttggggaggccggacctggcaccccggaggtcgaaataactagatcagggtgggcgatgctaaggaggtggggggtagatcacagtgctcacatgggggaggaggtggcggtgcactactacaggattgattttcctggacgccaccccattttgtttccatgtagtccataagttggactgcacggaaaaatggggggagcgaagccgggtcgttgcccgcacacgaaaatcaattttcatgtgcgggttacttaacaggcccgcacgcaaaaataaccctattttcgcgtgcgggcctcctaatctacccgcacagaaaaatagccttccctcccatcctattaaaaaaaattttgactttcttctctccccctgggcccccttctctcctctctctctcccccttatcttctcactttcctctcctcctctcattttcctctctctctctctctctctctctcaccttcttcttctcaccacatggccgacgcctccttcttctcctcccggcggctctcaacggcgggcccgacggcggctggcgggagcggcgggctcgcggcggcggtgggtgggagcggcatgcgcgtggcagcgggctcacgatgggcagacgtggggaggcggcggtaggcggacaggggccactgccgacgacgacgcggcggccgggagcgtcgtgcacacggcggcggcgggcggacgtgggccactgccgacgacgaagatgaagcagcgagctcggcggcggcggacagacgtggggaggtggcggtgggcggacgggggccgctgccgacaacgacgacgaggtggcggccgggagcagcgccgccgccgccgttcgacctagggttagggttaggattttgtaattttattttttttttggattttgattttcgtgattttcccagacgaatcattccagacgggcgaaacaaccgcacgcaaaaatttgctattgtagtagtggtggtggctatcgagaatggggggcgcgtaggcggcacttgggtagggtagcagagccgactgcggtgctcactattgacatggagaagagggacggtcgatcttaatctgaagggagggcgcttagcaagagtgtttcagtaaacaaattgaggagctgggtattcttgctttgctaggctccgaacttataacggttagagatactaacctctgttagagattagaatcaggcattgttacaggacactgcttgtgtgtgttttatctctaggataagtccaaactcacttttggggggaaaacactccataaacgtggtaatttgccagtggacaccgcgctgattaaaataataatttccggttgaagaggagagagaaatcgcgtaaaatatcaaaaatacccttgggcccacatgtcagctctcctatctcacttctctctctatcccctccttccagctcgtccgcaatggcctcgaagcacctcccgcttccacgacgccatgcggaccatccacgccgtcgtggcgatggctggcgatgaaggggcggcgcggcgaggcgaggttggtgctcgaccggacgtcggacaccgccggccgagggcgagcagtggctgcaggacattgaggacgtcgtcaccgccagctccgtcggtggcaacagcggcggcgcgcgccggcatatggaaacaaacgatccaacacatcaccggccgtcacgtctctctttaaagcatgcacacacacatatggatggatcagcagctagctgcacaagcaatagcaatacatcgccagcgagaacacgagctatctgcatcaatgcggcggcgcacttcgtgttcgtcccgctcatggcgcagggccacctcataccggcgttggacaccacactgctgcgggccacccacggcgcgctctgcaccatcgtcaccacgccagccacggcggcgagggcgggccccaccgtcgactcggcccggcggtccgcctcgccgagttcccgctcgactacgccacctcctcctccacgctcgcccgacgtgcctcgtggcggacttctgccacccgtgggcgtcggagctcgccgccggcctcaccgtcccgcggctcaccttctttagcatgtccgccttttgcctcctctgccagcacaacgtcgagaggttcggcgcctacgacagcgtcgccgacgacaacgcgccggtggtcgtgcctggcctggcgaggacgatcgaggtcacgcgggcgcaggccccgggcttcttccgcgtcgccaggtgggacaagttcgccgacgacgtggagcgcaggtgatgggcggtgatggcgcggcgcggccgtgcttgagcgctggccggctcggcgcggtgtggagcatggcggcaaggtggaacggagggaggcggcatgggaggaaggaggtcctccagcggccaccggtgccgagtagaccgcgcgcgctccgggcatcgccgctgtcaccgagcaagccgcgaccgagaggaagaagaagaagggagaaagaaacaaagagaggagagctgacatgtgggcccaagggtatttttgacatttcacgtaatttctctcacctctttaaccgaaaattattattttaatcagcgcagtgtccactggcaaattaccacgtttatggagtgttttcccccaaaagtgagtttaggcagtatcctaagattaaaaccacacattagcagtgtcttgtagcaaaatttgccttagaataaaatctataataggtttagaatattgaaccattacacagataggttgtcgtcagtaaccagtgtttgatcctacctctatctataacagtctatataattaagtgttacaggttatgtccttgcaaactgtcttagctaagcggttacagatggccgcggttactgctggttacacgttccgtagtagtgtgtggagcccaccagcaaagatccggccttcctccctaaggatggaaactaattcttctgaacgcgtaaaagactcattagtatataattaattaagtattagtatattttttaaaaaaaatagattaatatgatttttgaaagtaacttacaaaacttttaaaaaaaatgtaccatgcgatgcaccatgcaccatgcaccaccatggacggaaacgcaaatttgtccgtccatgcaatgcaccggaccggggagagtcatcgtcgatcgtcgtaccctcaccccctctctttttctcctttttcgagaggaaagggtaccatattgttccttcgttgggaaggcaggcatggcatgtgtgtgccgtggtagaaaaaggcggatgcgtcgcctccataaataaagccaagaaacaacgcatatatagtataattcaattatccgtccacgaatcttggattccagcgctgcctcctgcactgcactgcaagtagactagagcagatgccgtacgtcagtgcttgatagcctaagaaaaacggtggtaattggcgtgcttaatttttaattttggtttcccgtacgtgtgagtgtgtgtacatgcacctgcgaatcgacgaggaagcagcagcaggggcagagcaggaggaaatggaggaggaggacgtgaagggcggcatcgcgaggagcgccatggcggcgtcgtacaacgaccagatccggccgctgctggacgccgtggaccggctgcggcagctgaacgtgagccaggagggcatacagctcccgaccatcgtggtggtcggggaccagtcgagcggcaagtccagcgtgctggagtcgctggccggcatcagcctcccgcgcgggcagggcatctgcacccgcgtgcccctggtgatgcggctgcaggacgccggcgacgacgacgagcctgcgctgcggctcgagtacagcggcggccgcgtggtggctacctccgaggccgaggtcgccgacgccatcaacgccgccaccgccgagatcgccgggtgcggcaagggcatctccaacgcgcccatcaccctggtggtgcgcaagaagggcgtgcccgacctcaccctcgtcgacctgccgggcatcacccgcgtgcccgtgaaggggcagccggaagacatctacgaccagatcgctggcatcatcaaggcgtacatcgcgcccagggagagcatcatcctcaacgtgctctccgccaccgtcgacttcccgacgtgcgagtccatccgcatgtcgcagcaggtggaccgcaccggcaaccgcacgctggccgtcgtcaccaagtccgacaaggcccccgagggcctgctcgagaaggtcaccgtggacgacgtgcgcatcggcctgggctacgtctgcgtccggaaccgcatcggcgacgagacttacaaggaggcccgggaggcggaggcgcggctgttcgcggagcaccctctgctctccaggatcgacaagtccatggtgggcgtcccgacgctggcgcggaggctgacgcagatccaggcgagaatcatcgcccggtccctccccgacatcgtcaagcagatcaacgacaagctcagccgcagcagcgacgagctcggccagatgccgccggagctctgcaccgtggcagacgcggtgagggaattcttccacatcgtcaatcagatgcgcgcgtcgctggagaaggtgctcgtcaggggagagttcgacgagtaccccaacgaccgccaccaccacggcacggcgcgcctcgccaagatgctcgagggcttcgcgcgcaggctgccggcggcggccgcgaccgacggcgagccgttcctggtggaggagatgcgggtgctcaaggagaccaagggcatcaacctccccaacttcatgccgaggtcggcgctccacgttctgctcaaccggaaggtgaagagcatcgcgcaagtcccgcacgatctcgtcaggcaggtgtgggactacgtggaggacctggtgctcaaggagctgcagcgccactcgcgcagctacccgcaggtgcagccgtcgtgccgccccgccgtgcagagcctcatggacaaggcgcgagagcggtcggcgcggtacgtgaacgagctcatcgacatggagatggtggccaactacacggcgaaccccgagtacatcaagacctggaccagcatgatggatggccagagcaggctccgcgaggccctggaggaccgctccaagccagtggcgaaggtatatagtgtttggggggtgcacatgaaccccctaaattcctaatttctcacttaaaaacactagaatgtatagcgttgtactgaaattttctagattctcaatggtagtgcaccccccttgttttgatgctagcttcgctccttctccaagcccacggcggtcgccctcccggggttcggagagaccgacgtgtcgcacctccaccagctgccgccggagcaggtggagctcgccatgcaggccttcgacctcaaggcgcgactcgccgcgtactggaacagcgtcgtgctccgcgtcatcgacggcttggccctgcacgtcctctacagcatcaagcgcctcgctgagaaggatctcgaggatgagctcgctgctcaggtcatgggcaataacatggacggagtggagcggatgctggtgcccacacccgccgccgccgccaagcgtgactgtctcaagaaaagcatcaaactgctccgggaatccagggaagtcgtcgccaatatcatggacagattaacgcggcaagcaccgaccatgtctgataactactactccacctagtactccacttcgcgtgtagctgccacgcataataatactctccatgagacattccctccctcgttggttacatgttattcaaatagctataaaaaaaatttaaaaggatatcagcgtagccactagctacctagctttccttccatccatcaccactcgcgcgtcttgcgtgtaattttcagattgttatcagtgtcctagatatgggatatcctatacatgtgtacttagctcggcggggaccaccatataccaaatcctgtacggaatcaaacctcatacgtatggcaaaactcttaagtagataagagaggagtctcaaataaagagaaacatagtcctatttgggcctaaccagaactactcgaatcgtacacatatttgtcttcctagttctacttagataaggggacacttgagggtataaatacaggaccccaaggaagggagggataagccaacacatcccaacaagccaagagagatacaaaccaatacaagccaccatcaatctcgtagagtcactactcgaggaagccaactacagctagccgccgaccaccatgctcgagctttacgccaatatactggcagcctagattaggctttcctctatatactttgtactcgagagattgatatataaaggcaacaccggcttcgtccaatagtagtagggctattacccatcatccaggggcccaaacctgtaaaaatctcgggtctcccattttcctattcctatcttgtgtataccctggtaccaacattccctatactctacaagcatagttgttgaatctactccattgacagtatgcagtattcctagacatggtaagtacatgtatatgaggtataccttatctatgacactaacagtaaccctcgacctctacgcaaatgctcattcaatgctgacaactctagcacacccgagaagctatgatgtcgaaaaaataaacttactcattcattgccctctttgtcttccatcatcttcaaactcccagagcccaagaacgaaccctaacctccacaacaatcttgctttctcataatccacccatggatcttgagaaatccaccatgaataaagcattactcaaggcactccaggtggaggaattaatccttggccaggaaacaattgtcacacccagatattcataaccagaattcagaactaaattgtgcattaaacccctatccaagactagctatgttacacaaatgatagtgtattatagatctaatgtcttacaaaacatcatcagatgtttatacaaatgcagcacaaacttgaaaagataaactaaacgataacatcaagcagatcaacga

SEQ ID NO: 73786 - DNA, 20589 bp, Oryza sativa
ttctatcaaaaatttcttactataatttcattcccggcccagattgaatccgggcataaccgaacaaggccttaaagggggggaaagttgggggaattgatgaggaggaggagaggaacctattgagagggaacaactggggagggagatcaagaggtggcggcggtgcttctgttcatggccggggaaaggaacggccgagcaggaggacgaagacgactgacaggcggggcccacgcggggggcgtgcggtcaccttgcgtgcggcgcgcgtgagggcgcgggaggggagcggctcggcttgggctgggcgaagcagggcggcccagggaggaggggagggcggcctgggccaaggcaggccgagaggaagagaggagggagagaaaaagagagagggaaggagaggaggaccttggccacgggccaaagcagaaaagaggagggagactaccgatcggtcgcccgatccaaatcggcaaaaatcgggcactcatatcagcatgacgtcagcgccacgcatgcgtgcaaaactactttaaactaatttttctcttaaattatttattcaaatcataatccgattgcaccattaaattcgttgcaattaaatctttaaaacaagaccacacatggatatattccgatgaaaaaaaattagcttattattgaattatttttaaatgttgcacgatgttccaccaagtatatcggaattatttcactaagtggatcgaaaatgtttcaatcgtttaaatcaggcgttgtttcaccttatataaaaacaatgtttcagcaaatagtgaaagaatatttcagttcactacaacattagatctatacgaaatattgtgaatatactaggtgaaacatttttggtggaacaaaaaatgaaacaaattcccttaatagagggtttccaaaatatgtgggtgatttgttgcaaaagaatgtttcgttcactgcaacattagatctatacatagtgaaacattatgagtacactaggtgaaatattttttgtggaacaaaaaataaaatgaattcccttaatagagggtttcctcaatatgtgggtgatttgtcgcaatagagttaattgtgtagatacgtggtgggccagggggccaactgcacgcacgcggggggcggggggagcgcccaatttttgctcccccagccgatcgcgcgaggataagcatttttggggaaaagggggaggactttgggccgaaaataacccaaagagaagatgggattatttttaggttttctattttaattgactctgaaattggtttttgttgcttagaattatttcttgcgctctgaaaattcatgtaaatattgagggctcctttcataccaaggagaatttaagacaaatacccccaagccacattcgaatttttcttgtacgcattttaatgtttgccattttctatcgaattttaattaattatatcgttccattttagagaatgatttttaaaacgggatgaatttatcaggacgtgacagctggctttttctcctcgcccaccttactttttccttcctttcatcttagggcgtcatctgcatgagcgcatctgtcgataatttcaaatagcttgcgagcagatgtgatccgtcgtgtcactagttcctgggtggtgtatcgatctcggacgcctgacttaaacgcgtggatgacaaaagcgtcggagatttcagggatcgtattcctgcactcattaaagagtcggatatagtccctcaacgattcaactgggttgtgagttagagcgtgcacgtggcgcttatatcttccctggaaattggcgacgaactactgccataagtcttcccacgaagagattgagtggggtggccacgtcatcaggctctctttcccctcctctcccttccacctcctctctctctctcactcatctccttgggcaggctgactggcgatggggaggaggtcgccgggacgatgaggaccgacggccggccggtgacgcggcggcggcgacatgggagaaggggagggaggcggcggcaggagcacaggggagatcgagcacggcggcgggcagagtggggcgatggcgaggcggagcagcaccacaccccctttgcgcccggcgtcgtcatctggatcgcgtcgtccctcctcctcgcccccttcgtgccctcctccgccaacggcggtgacatctccattggtcgcgaggatcccctccccgagcaggaacccgtcccggatcccgcccccacctcttgcgcggtaggcaccacagctcaagctcgaactcgccgcccccgaagccctcagatggtgaagcacccagcgggtgagtcacagcggtgggagagaccgtgacagagtaatcagcctggtcctgcatacatttgaatgcctcaagatcttcctcttgattgtcacctttggctttgtcatctttgccggaactggtttctacgtcatccttgttcgacagaactaccttatatttctgaaccatggtgccggagcgagtcggtgcgaacgaatgcagaaatcggttttgcaagtcgtctttcatcttttcaaattctgccttctgctccggggtcagcttgtccatcgttattgggatgacgttctctgggtcaacctctcctttcttgaggcttgccatgaagaagattttacgaaagtcagtcccactaggtgtgccaagaggtgtgttgacgcgaaaaacacgcactggactgagagatttgcttaactctagtgcaggtccaaagaaattgtcttcgggttctgagcgtgccagggtttgatcctggaaccgaaaagaaagaaaaaggaaaaagttaaatccatcaacgatagccgatcagctggattgccgatgacgtatcattcagggccatgccgatgtgacttgcatcggaccggcaaggtcagaataaacgtaggatcattagatctactcgatcagctgtagatgtcaacgatacataatctatccattgaaacacacttagatcgggtgattgggatagatcgggcgttatgccgagacagtataaatcactcaacaactaagtgtgccccaaagtacagattatgtaggttcacagcatagccgatagagcaaacataacgtgtatcggctagtactccgatactactgtatactaggatatcagcgcagatgaaatatacaaaactaagatcaatctaacaagcagggtgaactagtagactgataggaagcttaatatactttaaacggatgagatcttaatataaagggtaggtttagacagtccagaaccaagtagggaaacaggacggctaaatcaagtaagatcggctgaaactccgatgctatatgtattagcattcaaaggaagagctagataagacgtttcaagacaatacttaacagatcgaacctaacggttgcaacattaagcataaaaagaaacataagatctaagtaaatcgatgaaaactcattcaagatggtagatacaccacatagtctagcttgacattgacgcctaaacctatcggccgtttcgatgatagaggctagccgatgaagtttaggtgacggaatcaatctagattatgcggtatatatgataactcagcaattcacgtagacaggattagagtgtcataaagatgtaagcacgaatcccgagaacgcaatccgccataacaagctttacctcttcgtcgaagatcaaacccgatgcaacccaactcgaaagcaaagactcgtaaaatagaaaagggtggtgatgcgcagaagtattattgaactgtcgtcccttgatttcaagatgtcaggtcttatttatatccgaagtacatagcttgtccttgctggacacgactcttatctctattacaatttaaaatacgaacaagcccattaggtggactcttaccaaacatatctttaaggaaactgaaaaaacatcctaattaataaatacaattgcccctttcttcggacctcgatccttgtgtggcaatggctatgaagtgctttgactaatcttgatgataaatgtgggaccgtatttttccccctggtcgtatcggcttcactccatcagatttggtgctagccgatatgtggcagctgataccacttgtagctgattcgtgcagcagccgatgctgctcgtagccaatgctgctcgtagccgatgtgtgctctgccttctcaaacataatttatccaaatcggccttgaccctagctctgaatccggcttatggtactaccaaatttggtcgtcaacaagcgccagcgcaaaatcgcccaccacgtcgcacatcgatggacctcctcctcccctccacctccctcccccatccgcatcgccggcgtcgtcctactgtagccgttctttagtggcgagagatgaattactctgtgaataaacagattttactagcccagggagatgagtgtgagagagagaggaggggagagagagcctgatgatgtggtgtcctgaaatgtggggcccacgtgggtcccacgctgactcgcccgccacgtaggataaaatcggggtcaaaaccactgaaggatgtaaagcgaatggttttataagttaagggatgatatatatctgattttacggttaggggtaatttgatgacaagttgagggaccttcggtgtactttttccttttctactcactcttctgggcctctagtaggccatatgggccccagttttagagtgatcggcccaaacatggaccgggccatattgccagcctgtctaaaaaagaaaaagttcactttgagatcactgatccatcgggcacattagatagcattgaggacggtttggtacctatggggtagttttgacttgctcttgttaggtgaggtggcatcttatatgggacccacgcaaaactctttcaatgaattggttttaaaaaaataacatgacccacctatcatcttctcctcccctcttctctctccctttattctcctccctcttctccttctctccatctcttcgatgagtttgtgggggacttgagggaagagaatgtcgccggcgtggatcaaactctaagtgctctacccgcatcaacctcgacagatggcgaaatgccaccaaggatgagaaggtcaacatcccgcttctgctccagccaacaccgctgagggcgtcaagccgctcgtcgcctccatgcacctgccgctccaagacatccgcaccgatactggtgtaggtggccgctcctcctgctcacacgctagcttccagtagctctagtggggagaaagaaaagttacgagaggaagcgcggcattggtggccacaatgagggggcttgaccgacacgacgcaacgattgagcgataacgcgaacggccctagagcggcagtcgagcgacctgtgtgcgatggcggccgcagcgtcgcgctagcttgcggcgtgaggctgattcgcgggctggggatgcgcatgtaggcgccctagttgatgttgccctcactctcgtgcgtggtggacaagtacaatgcgtcgctgaacaatgccatggcgccctcatgcaaccctgccgccgcgacatccgacgtcaacacgatgcttgtccttcacctccactttttccccttcgcatcacaatccgacctctccatgatgcggttcatcgtctctggctctctgccatgggcaggtacatccctatgccttcttccttcgtggcctgctccgtatcacttgacgaggacctagctattgcatacgtcttcaccttcaaatccctcatggcgctcaagacccacgaggctgttgtccccacgcgccttgtgcgaggccgtggcggcactatccattggtcgtcaccccttccagttcgtggtgtgatgtgaagaggcgtgcctccgccatcgccatcgagcatggcagacatcatttccttgtcctcgattgtttgcgcacctccaccacatttgctaccgcagagatcgaagatatgaggagagagataaggtagaatatttgtttcaatgatacgggggtcccgcatgttcttcttgtttctagtgccacgtcaaccaaaaacacgctcaacactgtattgggacccaatgtaatcccgttttataatattagagatatgtagtatttcaattcaggacgattttaaaatttgacgataagacgagggagctccagcgaactttttccgtctaaaaacaatcaatcatcaatctggatctggcccatccacatttacttttctttcttttttgaaaaaaaaaaagctgcatctccaaattctccgtcttcttctggagcgaggaagagggaaaaaaaagaaaagaaagaaaagaaaacggaaagtagtacgatacagtaatggtaagatgtgggggtggaaacccaaatggtattggggagggcaggggtcaggggggcgcagaggcctgcttcgttgctccgccgccgccgcctcctcctcctcggttcctcctcccatctcctccgatctcctcctctccaaaccctatcaaatccgatcccgatctcagagcaggtgcgcgtgcgcccgcctcctcctctagatttcgatctccaccaacaataagggatcccatcccatcccatgcccgcctccccatctccggcgccgcgagccatgaagcgcgagcttgccttcgcactccagtcgctctccgccatgtccacctcccccggccgcacccgctccggccgccccctctcctcctcctcctcctcctcctcctcctcctccgcccccgcccctgcccccaagaggcggaggagaccggacaagccccccgaccacgaccccgcccccgcccccgcccccgacaaggatcttctcgtctcccctcacacgcctcctatggacgccgaggcgcccaagcccatacacctcctcaacgacaaggacaaggacaaggagggggacgatggatctcaccaggatacacccacgctacagtcaccccctcgtggatctgatgctcatccaataccaacggagctcaatgtttctgctgctgtcgccaggcctccacaaccaccccatgcacaaccaacggagctcaatgctgttgccgccgccgcgtctgctctaccaatggagcttgatgctgctgctgctgctgctgtgcctgccgaatcaacggagctcaatgctgctgcaaccgctgtgcccgcacaaccgacagaggtcaatgctgctgctgagattgtcaaaccaattgggctcaatgctgtcgctgctgagactgcaaagccagacatggccatggaattgcaggaaccgcctactgtaactgcagccaatgggagggatgtttcccatgaatcatttgaacaaaacctgcaacaccaggtcctggacaatgccttaaccgatccttctttgcttgccgagagcactgcaacaccagcctctactgctggcctcaagcctgcgaggcgcttcacacgatcgctgctcaagaacaaaccagaggaagagcccacagctagcaaaagtcaagaccctgctgtctccatgatatcggaggacaacaacgaggcctctgttgatttggctcttgccccagggaagccacagaggaggttcacaaggtctcttctcaaggtaaaggttgaggcgcgctctaccaacaatttgcttcaatccaaggaggcaattgacagcacatcagactcttctcggtcagtgaagaagatggagatgaagatgtctaagaaggtcgcctgcctcacaaagcacccaagcaacattagagagttgctcaacactggcctgctcgagggaatgccagtcaggtacatcatccccagtagcaaggtacgtgaggataatacttatgttttatgacttttaccaacagcttttcattttcagtccattatagcgagttccttattaattattgtgatggccaccatgctagtttttattatactatcttgtaagtttttagccaagcaatgttaagattactcatggaactttatctttagtctactgtggtatttaggaattttgtctttgacgtgacagtacatgtatgcacttataatatgtttactcatcagctaggtcttatccatgaaaatagctttaatcacctattctgttataatcgggacctcccagggtcagctcccaatcgatcttgtgatatattctaagaacaattgccaggccaacacacacccttgatcttttgctttgcttttcatggtacacttcttgtggacatggtgtgctattatttgagttgcactaagccaggtagcccctaaaatgctactctctacgaatgatacatctagccaagaatattaaaactatatctgcgtcttttcttctttttttttggggggggggtgttattgatgggagtatctttgagtgattcactgtggattatgttctagcatacttttgtagctcaatgcaattaaattatattttgtttgcaagttgcagaaggctgtgctgaaaggagtgattacaggctgcaatatccgttgcttttgtttatcctgtaatggttccaaggttagtactccttaatcgataaatcgctacacattacaaattgtttacattatccacctaaatttcacaggatgtttgttcttatttctttgaacaacatgctgggagcaacaaaaaacatcctgctgaccacatatacttggggaacggtaatagtttgcgggatgtgctgcgtgcatgtgagagttctcccttggaatctctggagaaaacaatacgttcttccattgatccaattgcgaagagaagctatgttaattgcctaaactgcaatggtgagggtttcatgcgtttgttttttgactgatagttttccttggtacatttatttacgtcttctaatgctgcagaacatctttcttcatcacaaactgaaatctttggaagctttttgtgtcaacgttgccttgagccaaaacaacatcaagatcccccttccccatcttatgcttgtaagagcaattccaggtaagcagtccaagcaccataatatgttagatgtgttttgcctaataactatgagatattgatttgtttgaaaatgcaaaatctttcctttggttagataattttgttcaagatatatgacttacatccttaactcacaagagtaacaaactatttttattttgctgcccgggatgtttttaattgtatgcaaatttcattgttttgacttattcagatgttaacagttttgtaatgttcaaacttatgctgttgcatttataaatcatctttttttttttgctccatgttgttttgggggctttagcctgataccaagctccaaggattttttgttgaagaagacaccattaaatacaaaaggtggaagtgctggaaaagtaactacaaagttggtatttctgtactgttgttttttttttcttctttcttatcatgtgactatatgaggcatgaacacgaaattaattggtcatttcttggtactttcttcagggacaccgggctacacaaattggtctttaaagttctgcttgatggtactgaagtagcttactatgttgatggtcaggttgttatactcagagctgctcactggttatgttaactacaccattttgcaactttggttaataatttgcagttgcattatgcagaggaaagttgatgggtatatcaaggatcaaagaatctactgtaatcactgcaaccgagtggtgcgctcctttcttatttatgatatataatttacttctatcatactccatgaaataattaactttttgtatatgatgagtatccaggttagcccgtcagcatttgaggctcatgcgggtgagggaacaagacgcaagccgtaagtctttgttatttcctgtacttagcttgtgtgagcaacttctatttcggttgcccttattatactatgtttctaccaggtatgacaatatttttacatcaaatggagtatcattacatgagctgtcaatgaaaatatcaaaggacatggaattatctgaacgcgaaacagatgatttgtgcagagaatgtggtcaagggggagatattttcccttgcaaaatgtgcccaaggtcatttcacccaggtagagtctcccatattccagaattaattgcaaataatgtttaagaatggctatgttttacttgggtgatgttttttctttaacgatcagtccaacacttgaccttctttttgtaaaatctgcagcctgtgtagggctgtctggagtcccctcagagtggtattgtgataattgcagcaaccttgttcaaaaggaaaaggctttagcagaaaataaaaatgctaaagctgctggaaggcaagctggagttgattctattgaacagataatgaagagagctatacggattgtcccaatctctgatgaccttggtgggtgtgccctatgcaagtaagtattcttacttttctttttcttttaatattttttctcaattcatacttccattctgcagttatagctagaatacgttttaaacttgttgtaattcataatatgcaagcgtaattttgatcaataggctgtaaggagtaatgcagtattcgatggtattgaattaacaatctactagcaagtagtagtacatcactttttttttggtccatggagaatggtacccgagcagcatgaaaacagtgacagactacttatggactgggaaaatcttttggtaattttccagtggcataagcataagtatgactggagctgaaaactcattgggctaataagaagagcaaacaatggtctaaatgactctgaacaaatgctctgatctagacagcaaaattatactaagtaatgtacctacccatcttttggaggactgaaagatagctcaagtcaccttgggttgttggaggaatggatttgaactcactcatccatgttcatgaatacagctgcagttgaatctgatcccatgatgggaccaacagagtcaacactatgtgcatattggatttcttatttccttttaaaaattccaacgttaaaatcacgggcccaaccgaatggcacccaactaactaatgtaatgagtaaagtcaaaacaaatattataaaagctctttgtatctttcttgaagtttcttgttatccagtacaacacctcaaaattgctagctattttgtttctgatgtttatcttcttttcactttctacattgtacccccgtgatattattaatggtaagaatttgtttctgcaggcagaaagattttaacaattcagtatttgatgagcgcactgtgatactctgtgaccaagtatgccttatatgccatcttgatagttcctgtttaagttcctgatattaaagcttgcctttgttttttttattggatggtatttttattttaacacttttttaaaatatttggtgcccctgcatttattgaattattctaattcttcactaacatggtttttttcgtcactatccagtgtgagaaagagtatcatgttgggtgtttgcggagccagtggcaagttgacctgaaggttagcatgaaatcttttttgtttgatcacccttgttcttcatgtgtgaaaagctaacattgcctgttttcttttctacaggaattaccagaaggggagtggttctgttgtaatagttgctcagagattcgttcttccttggacaagataatctctgatggagctttgattttggctgagtcagatattgatatcataaggaagaaacatgagatgaaagggttaagcatggacactaatacagatctgagatggcgattacttgctggtagaaaggcttctgaagatggtgacttattgctctctgctgcagtcccaattattcatgtaagtaattcatgtttttctcatatgtgtagacatgaagttccatgtctacagtctgaacatttgctagccagtttatgaagtggatttggggtggggttaggtcctcagtagttacaagcacgtaccagccatgtctattaaccaatgacttgctcggtatgatccactgagttttttgttttttaaaaaaaaacctttgtaagtcttaagaatttttgccaacattgatgagccttcaagtccagtccatgcataatttctagcaaggttttatattgagtttttgcaactggtggttcttctcaccaagtatctatctattgcagcaatcttttgatccaatcattgaagttcagagcgggagggatctaattcctgagatggtcaatgggtaagagaactatccttccatatttctcccaatgcattgtccctctgtctatgtgtaagaaatttcccatttcctctaatctcccaggaggagacccaaggatggaatgcctggccaagattatagtggaatgtactgtgcagtgttaactttagggtaagaattctttatgatgattaagatttggccaaaacttttgtgttcattgttgttgatacaaacttgaatgttgcagcacttctgttgtgtcagctgcattgttgcgagtcatgggaggtgaagtggccgaactgccactagttgctacaagtaaagaccttcaaggactggtgagttgtctaaatttgttctttatattatgcttcattcttgtgttattatctggcaacgaatgcacttgtgtaaagaagaaatatgctctttttgttccatgtttctttctaataatttgttgctccaaacagggctacttccaagctttgttctcgtgcatagagaggatgcttatttctctgaagatcaaacacttcatgcttccagccgcccaggaagctgaaggcatctggatgaacaaatttggcttcactaaaattcctcaggaacaggtttgtgttaatctgcacagtttttagtgatgacgagaaatttaaatctaattttaactctccacctggttgcagtcggatgcttatcttaatggggcacacctgactatattccatggaacgtcaaatctgtacaaggctattccttcgtcataatattggtttgaagccttgtgctgtgcatgtatgcagtcagacagatttgtgttttgaagctctgctgacaactgtacataagatgatgaagcatgggctaaaggatgatgatagcacacagaagaaagggggagaaaagatgaaagataaaagtaactcgaggcggcatgatattggtcgaccaaaattcttatccttcagtttggagatatgctggatgatggaggcaatgcattttgcttaattttgtttatctttttttaaaaaaaaaattggctttcagcattttcagtgtggctgctatgccgctgagaaatgcagctatttttgatgtacagacctcaaacatcagaaactgcaggtttaatgcagtgctgaccctgttctgtttggagttagacttttggtctgtttcttgggttggcattattgcaagatttggaagggcctgtttgatgtggctgtcaagttttgatgggaaagagcatattgtatttgtggatatacatgctagcttaagtaaaagttttgaaggaatgcagtaagtagtggtattgacatggaattcgggagaagtcatctcttgagtgtaaaatattacagagcttgctcctgttagtttatttcataggcaaaattgaatgtcgtgccggcgcgtgttgcttgctattggggtcttacttaacaggaagaagatagggcaggcaggccggcccatcttaaagcccatcccgtctcgatctcacgccaacagcaacaacaggtacaagtccgtccgccgccgccgccgagagcgagagatggagatggatccccctcggctgggcatgggcgcgtactccggccccgtccgcccggtcggggacggggacggcggcgccgcgggcgagacgatgctgctctgggccctcggccagccggcagcgcagcgccacaacgccttcgtccgccacggggcgcactccctcaccctagacgcctgcggccgccgtctctccctgctccagtccccgtcctccatgtccacgcccggcgtcaccggcgccgttgtgtgggacagcggcgtcgtcctcgccaagttcctcgagcacgccgtcgactcgggcctccttaccctccgggccgcgcgggcgctcgagctgggagcgggctgcggccttgctggctgcgtcgccgcgctcctcggagcccacgtgctgctcaccgacctccctgaccgcctcaagctcctcaggaagaatatcgacctcaacgtcggggacgacgcaaggggctctgctcgggtcgcccaactcgtctgggctgatgatcctcacccggacttgctcaacccacctctagattacggtcattcttccttacttttgtattactatcttctcactaataattgatagaaattaattactggagtactccagttagttagtagtaagaagaaatgaattggaatttcagtgcttgggtcggacgtgatctacagcgaggaggcagtggatgatctgctgctcaccctcaagcacctctcagcccctcacaccaccatcatcctcgcagcagaactccgcaatggtacattcagattcttaatatccaacctagtacaagtggaatccacttgacaatttaatttcgcatccagatgctgtactggagtgcttcttggaggcagcaatggcggacttccaagtcggctgcatcgagcaacagcaatggcacccagatttccgctctacacgtgttgccttgttcatcttgctcaagaaaccaccttcccaaccggacgtgctgctctagctccaaattttgggcgtccctcatcgaaagctgaattgtagcggagtaccagcatttactccatcctttgttctggactctggagtttaattttacaccttttgcatgtatggaattagggggtcaaaactgtacgcttttgttttctcctattgattacgtgcacttcggaaatgaaattgaaaattgtagagacaccatttaatcggtctactccttttatatatataggatttttaagacaaaatatatcatatagttccgacgattcattagaatgaaacaaatataaattctactaacaaatattagagtgaatcaacttgtgatgtaagataaaccataccgtttttgagaaaacaaattggctaggaaaatttcccatcctcgtgtcatgctccttcaatttagacggcccttttcttttctaataattggattaaataaacactctttactagctcctaaaagatatgatttttacaaactatatgtgaatatcttataatacttttttcaatatatgtttcaatttcataatagtataaagattaggtcatatgtacactcaaataattccactattcaaccattcaaacagttgagcatacattctgggcctctttggttcacaggatttccaaatcatataaataggaaaaacacagaaatattatagaaatgcacgtgcaaaataaaagattggaccacaggaatttttcatacactgagctgaacataagagaatggagtggaagttttcattcttatggaattaatacatttttgaggattggcgtagaaaactttcctttaaatcctataaaccgaatgtatgaatagtgtttatttcaaaggaattgagactttctttaggaacaaggcctcaaactagtagtgtttcatatcgtgctattttagaagggaaaaagtacactgaaggtccctcaacttgtcctcgtgttataaaatcatcccccaaccgtaaaaccggatacaacgtatcccctaacttacaaaaccagtgtaaactagatccctcagcggttttgaccccggtttgtctgatgtggcgactgagtcagcgtaggacccacgtgggccccatacgtcaggatgccacgtcagcgaccagcctctcccttcctctcctttcctcccttctctctctcccactcttctctctggattgggcaggccgcccggcggtggggaggtcgttgccggggcgaggaggtccgacggccggccgcgacgtggcggcggcggccgggacgaggacgttcttcttcacgggcatcctcctaaagctcccgacccagcgcaaggtccccgatttgcgcgcacgccgagaacgccgcggcggcggcgacggtgtcgatgcacacgccgctatcatccgccatggccgtacaagaaacgacgtcccggccagccggcggggaatccgtcgaagagcgcccacgtggaggcgagctcgacgcgcgcgaggtagagctcgacgagcccatcgcggacggcgaggcggtggtcgaggccgagcttggccgcgtgtgcgtgcacggccggcgcggcctcgccgtggtcggcgatcaagcccttgataagggccctgaggcaaagcggcggcagtggcgctccggcgagctcctcgccggtgcccttctgcgagctgcggtagctgtactagattaacttcttgcatttttttttgcctaattgtgatttgccagtagaatgacactgattttctatggcctcttagttggatgagataagaagagatgagtatgacgagatggcatttgtagcacgagattaatttcttgcctgtttctgctggatgctaaatttgcaagctttgattcccgatttaatggctgcgatggctgtagataaatcccagctggtggatcccttgatgtgtctcgatcgagttccgggaggcagcagcagcagcagcaatgtccggcaccgccaacgcgacctcgccggccgctggcgctggcacgccgcggtcgcggctgccgccgtggacgcggcacaagacgctggtgttgcttgccggccgccggcgctggcacgccgttgtggacgcggcacaagacgctggtgttgctcctccgtgctcccgccgcccgccgcccttcccttctgggtcgccgccccctcatcgccggccggccgtcggacctccatgccccggcgacctcctccccaccgccggccgtccagagccccacagaggagtgagagagagagagagaggaggaagtgagagaagagaggaaatagagaagaggctgacgtggcatgctgacatgtggggttcacgtgggtcccacgctgattcagccgccaacaaaacctggataaaaaccgcctagggatctatcgtaaccggttttgattagttaagagacgtcggatatctggttttgcagtttgaggacgtttttgtaactcgatgacaagttcagggaccttcggtgtactttttccttttagaagggaggaggaagacggtgaaaagaagacaaacagttgggcctaattgggcctggggaaaacttacttgggcggggcttgtggggggtgggaggttcgagagccttctgggagaaggagagagcgcttgcctgacactgcagtggccccacttgtcagtcacagtaggtggacccgtacacgtacacgcctctttcctttactcttcttcttctttcttcttctcctcgagtcgagtcgagaattgttagatttaggtctcccccatatccccattcccatctctctctctcgagtctcgacggcggctgctgctgcggcgtcgcctgcggtgcgatgtcgtcgtctccggcgcatgctcagcgcttctactgccaccagtgcgaccgcaccgtccccatcccgccgcccaccttccccgacgccgacgtcctctgcccgttctgcggtggaggcttcgtcgaggagcttggggaggacatcaaccccaaccccaaccccaaccctagccccttcctgccacaccaccccttcttccccttcgcctccccatccttcgacctccgcaaccctagcgacctcgcggccttcttcgggcccccctccccctccccctccccctccccagccgccaggcacttcgacccctccaacttcctccatgatcacttcaccggcctcctctctggcggcgccaccatccagatcgtcctcgagggctcctccgcctccctccccctcgggggcgccgccgccgggcccggggggatcagcctcggcgactacttcgtcggctctggcctcgagcagctcatccagcagctcgccgagaacgaccccaaccgctacggcacccctcctgccgccaagtccgccgtcgccgcgctccctgacgtcgccgtctccgccgacatgatggccgccgatggaggggcccagtgcgccgtctgcatggacgacttccacctcggagctgccgccaagcagctcccctgcaaacacgtcttccacaaggattgcatcctcccctggctcgaccttcacagctcctgccccgtttgccgcttcgagcttcccaccgatgaccctcaccacgcccacccaacccttggatctcaccgccccgccgcacccgcctctgcctctgcctctccctctccagctccaccacctaggctggctgagagaaggttcaggatatcgctgccatggcctctccgtgctgcgtttggcggccaggcggagagcagcaatcctaccaatcaggatcctgttggtggttctactgatgcttccggttctggcaacaacaatgcaactggaggtcatcgtggctacgatgatcttgactgaagagcatcggacaaagaggggatgaggaggtataagttactctatagcttttatatttttttttgtaagatgattacgctaatgttgatacttttacatgctctaccaacagccatattagttttcgagatataaccattcattttagtgttctaatattactacatggattgaaaaagaagggacccttcttttaaccttaagtcatccatttctgatatctgttcaatgacagtttggtgtgctcgatttagattagaggttttcgcgatctataacattcttcgtttatgtgctaaacatccgtgggttgagagttgggaacttgcgcctagggaatgcgtcatgccatgcggtgggagtcagtcttgtgaataaatctgtggctatgcgagtcggctggtaggaaaatgcttcagtaaggcccacatgtatcctcatttatttcagtcgattggccaaacatacacttaattggtggttaatgcttacatgtatttggtatgccacaagatgattggttgcatgtttaaactatcaatagttgattggcagtagtgtgtaatgagacacgtagtatgtgcttaaactggttaatcaagaaatctgagttcttttcatgtattccgatctaatggttcatattatctttcttggtttggtcaatcttaaattctgtatcgtgctagacaagcttgaaaaggaatgtattgttgaccgatggttcatattatctttcttggtttggtcaaactaaaattctgtattgtgctagacaagcttgaaaaggaatgcactgttgaccgatgatttcgaaaggagtttgtgctctgtaggctacagtagtttgatatacttctgccagctttttattggaccacgtggtgcagtaattttttcgatgtgggaggaacatacgtgctcttgatccgtctggatagatctgtacgtcttgatccgtctggatagatccgtacgtcacgctgctgaaaaagggaaaaaggaagaagcaatacgggttcacacacaggctggcatctagctgggccttagattgcttgggccttgctggctggtgaatggtggtcacacacgtaagagtaagggtgcaagcgggcaggaaaaaaacctatctcgattccatgaccggaaggcaaagttatcaaggttttaatttgcacagaattcttcatctgcattccacagtgtcgcacccgccagcctaacttaacggcgcggttagtcgacgtgcttgacaccgacatcgtctaagctatccaccctaatgtcctattgccatctctatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctcttctgtcaggcccgtggttctgaagccgtcaaaaaaaacctagcttgattccatgaccagaaagcaaagttatcaaggttttaatttgcacagaattcttcatctgcattccatactgtcgcgcccgccagcctaacttaacggcgcggatagtcgatgcgcttaacaccgacatcgtgtgagcattcaccctaacatcctatgtgccatccctatactaaccaaccttgtggaaaacaagtgtgggactttagaaaatcgacgtttcggcgaaacaaaccgctgtttggtggccatgggaaagtaatttctagaaaaaatctcttgggggtccaactcttccaaatccagtcttttctatgggtgaggggccgggatatctgtcaaccgtaaaa

SEQ ID NO: 73787 - DNA, 1325 bp, Oryza sativa
gccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggttagcgtacatccattgccgatccatctacatgagtcaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttcttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtgctaccaaccgggactaaagtcccacccctatatatatgtcttcttcctcctccagctgcccgagcaggcttcaaaatttcttcaaaaaagaggggaggtcgtgccaaaatttctattgaatttattttggggattacgtacaatcggaggggcct

SEQ ID NO: 73788 - DNA, 705 bp, Oryza sativa
tcctgcacccctccgtttcacaatgtaagtcattctagtatttcccacatgcatattgatactaatgaatctagatagatacatatgtctagattcattggcatcaatatgaatgtgagaaatgctagaatgacttacattatgaaacggagggagtactaaaaactataagaagtaataactagtaatctctgaaagttaaacttaaagatatctacttcatgccaagaatgacaagcaaaatgtttaccactgctttacactgcaggaagagccagtcatgggggcagttatcaagtagatatacaaaatcttttggctctgccactgccacaatgttttggagttgtcaggatggaggtaaattacacgtgcacagaaaaaaaaatggcaatgagaaacaaggtcacatcttaagaggtgaacttacatgttccaagcccaccccaacctttgttgatgatacctctctgtccagttatttcaagtgctttgacaatgacttcagtcatctttgctggatcttgaactggctagtatatatacgaacaaatgaaaggagtgaattttcaaaacacaacaatcatagtatcctaaaattcattaagaaaaaaactgaaccatggaatcactatttgcaagcagctactatatgcatgccacacagatcaacaccaccaaggcaccaacaactcattatcataa

SEQ ID NO: 73789 - DNA, 4466 bp, Oryza sativa
  unsure (1)..(4466): unsure at all n locations
caagtgaggcctaaaggagtatgtgggcgggatcttcgggatcggcaaccaggcgggaattgggcgacaaacctctccgtggcgcttcaaaaattatgaaggtgggcctcccgtgggtctaggtcgcttgtcaggtgcaaatcctccgacgaacgtccaggattctcatgttgttctcgaccatgccancgggcagcatntgatggaactcgatacgagccgagtcgtacgcctccaccacgcgcgccaggtgcatcatggtagcgtcatcctccgagctagcatcccagaaggtggagtagtcgcgggttcgtccgaacagagggtggtagcggtagttgtaatatacttanttttntgggcatgcccgcttggtaggagtaggcagataaagaagaaaagagaagtagaaaaaataaaataaagaggtacaaatagttttctgaaattatgagtatgatatactacaggttaagctgtagattgaagcaagtacggtaactacacagacatcctgtatgtctataaaatacgcctaaaaacaaaaaatagaaaaattaaatgtcttcgatcgaacttcttaagcctcggaaatctttttcagaacttatattccactaatactacaaatttggaaggtttatttgcaaaatttttgtgtcttatgaattcgctgcagttttgagaaaacatatctttgtttctccctaatggcatataatcatttgccaaagttaaacacacatccataactcaacaaaattattcacaaatataaattactatgctactttgatccatctcaacattgcaaaaatatttaaaatacattataaggtcttgtggaaattaaactttttctatattatgtacgggctataaataaccggcacgcctaaaggtgcgctgattttctaagacattaagaattaggtcaatatttattgattatataccatcaacctttgctgtattgcatgatcagtgtgtggatgggctttgcgctttggctattgttatttatggttaagtgctaaaatatcctttgtttgaccaaataaccaagttgctaggtttatgcactctacatctactgtggatagaagtaagtgtctgaaaaagtttgatctttgtttttgtagctttatttgattagccagctttaccattttgttattatcaggatacgtttcataatgtcattctagtttctgttgcttcctatctttggttgtgataagcattcaggccccgtttggctaatgggaaagggaaatcatttcccacccactaaaagacatctttaaatcctaaccattcattctccctcttccatttaatcctaaccctttattcatttcccaatcccaatctcaccccagggttaagatatcttattttccctgcatcagatactcaaattaaagcattatttttagtgggtaaccatgtttttcagaaccactcgctctgatgacaatttgttactgctatccacgctcatttttcatatcaagttcagaaactgaaacttccgccccatatagcctgctgccttttccactctattgattatttaatgtattatacaaaacaacctaatcgttgagggatctaattagtctgatgtgttttgcaccctcttgaagtatggtgaatgactgctaatttttgtgacacaagaaatgggaaaatacatgctaagtggactagtttaggagtctgggcggctgggcctgatgaaagttctgtgcgtctcctttgcagaacttagaatctattccgcgagaacactatattttcaaacggagtattaattttggtacaagggctggctaacaatgcagggagagggagcacgtgcatcagtatacacagatgaatgtgcctctgattttagctttcttgctataagttgccctcctgttgtaaattgggcataagtaaattttttctattttgttttgcaaaactattatagtaagcttaagcaccccaatccctttcctgatgcagtgttgatggttttgcttgcaggggcgagggacattgtttggagaagaggtgcgccgcggcaatgaagctagcctattccgttctattcacctatcaatgacgagaagaaatgttggattttttcccccttccttaattgtggcatggatttactattgctggttttggggtcctctggtggtgtagagaattttctatgggggcccttttcttggtgacatggacatagactggtggtgaaaaaaaagaaaggatggtggtggggatgttatacattttaagtactatatgttacttgtcatatatacatatctgggagatctgaaagctttcctctgattgctggcgttggcgagctaaacaaccagtgcacgatgagcgtcctcttttttaatagcgatcggatcgcgtacgtgctctcttcgacgcatcaacttttgtactggtagttctctcaatttggtctaagctcccgtcggagggctcatacaacttggattcggggtttgggtaatggggataagaccttggacgctgatttggttatactcagaaaaccattctctcgtccttggcgctagtttggcatggagcgctggaatcaatcaagaaagaagtcgatctttggccaagtccaagtgcagcgagcgttcatttgctcattcgttttagtgccttggtttgatgcaatgtggactttacaaaaattaacgggcctttacaattgaatgaacctttttacatgtttctaattttaaagaatgaatcaatgttaaatggattataatgtgtttagtatttaatttcaaaatatgaacttgtataaagaaattaaaaatgacagtggattatttagatgatgaatgataatggatttgaatttatgtttcacttgtaagttactttgatttaactaaaaaggcaatttattttaaaagaggtagaacgtattttatttataaaagatctgtcattatctttttagctgaactaatttttcgatgtgctataatttcttttatgaacatgtaattttaacgttgctactcctttcatcccataaaaaactaatctaatactggatgtgacatatctagtactataaatctggacatacctttgtctagattcattgtactataatgtgtcacatctagttttagattcgtttttttttggacggagagagtactagctagtgattgtggggctggctggcccaagcattggggcgcacaaataaatagcgccatggtgcgagagagagaacgacaagggtatatctatactttctatatagttggtacccactaaattattagaagctaaagcttaacatgcaagcatgccacatcatcacccactagcaattactattctagcctattttaatcccatgcaagcatgatacatcatctacaatattatattatagagatcaacaagtatatgtcaaatcatcttcctcacattattttctcaacatttcaactatcatcatttctacaatatttaacatatatttatccgtgaatcccgcagcaaagcgcggggtatcacctagttatacaaaaatcaaacccgatcgagtctcgctttctcctcgcgtccgatgtttctccgtctccagtcatatatatttgaagggaaggggccgaacaactcttccttggtttttgtctttagtttttttttctccgtagatattcggaatttatttgcgaagttagggatgccacgtgctcctggcctaacgggcagctttagaaaagtattctatatatttcatattacttaaaaaactgcccatgcctggcaacgatgagagctattttaatcctattattgttactagaaaaatgcccatgcgttgcaacggacgaagtctattttaatcttattattcttatatgatttagttaagatgaaattcactgtgagagttcgcttggatatatatatatttttagaaaatcataagctgcagttaggagtccaatcgtcttaagttagcatgcgagtttttttaaagagatttcttatatgatttcttctgtattaccaaaagtgaacaatcttaaaaaccgactcaaaaacggatatgtatttccaaaagcaaacgaacttaaaaaccaactcatacacggatgacgtaccaaaataccggcaaaaacatcttcaatgtttataatactagagataagtcgttgtttttttcataatcaagtttatagggtttaatatttcaaccaaaataaatatattatcatatatatatatatatatatatatatatatatatatatatatatatatatatatatatatatatatttaatgctaggtttaataaaattaattctataaactcgagtcataatacaatttgaataattagtagcattctttaacaagacggggtgtagctcatatggtagagcgctcgcttc

SEQ ID NO: 73790 - DNA, 3889 bp, Oryza sativa
tcatgtaaaattgatgttactagatttattattaaacaaactatcataatatgtaactctttttatttaaaacatcttacttttatagatattgctggtcagagtagcatctcggaaaccgtgtcaaagttcaaaaattcttatattttgggacggagggagtagcaaactttcatgctcattaccaattagaaaaatgtggtatcaaactgaaaggctaccaatttcagttggcattactaatattgacttggttcacagtgttatcacagcaaatactcaagcaagctcttttcaatacaacaactgaatgctataagaaagtcaaatgaaaagaaaccatacgaccaaatgaaggcccacaagttttaaaaactatacaatcgacggatgacaaggttaagcatgacgtgaaaagggataacatataaatctcagataaagctaatactcatcaggaacctttcggttttggaacaaggtgaggactccagatgtaaccatgaggaatgtcattcccagaaccctgtgcaccacttaggtatgttaccggacgcaacttcagcttcttcttcctaaattcatttatcatatctcggataccaagccaaatcatagagtcaacaatttgataagaaagctgcaagtgtaaaccatttgaagattagataacaaatcagatcagaagaaaatgagtgatttgagtatgaatctttcaacaagtgcttgatgtgagttagggagatgatctctaactttgacatgtggtgcatggttgtttttagggaatgcagcaaaattgcaacctatttaattacaagaattactataaattggatcaaggtcccttgcaacctaaagagcactcccaagaacaccagccacactgaatgaagccagaaactaactctctgcatacagtaactcacttgagtttaccacccaaatcagtctaacaacaaacgagcacaagcaggcaggccaaaattgtcagagttgggaccctatcccagagatgcacaacaatgcaaacaaagtaagcacaacaaaacctattgtctgattgccatttacaaaataacagttcaagccatttcaaatatctctactattataaaaattgaagatgtttccgccggaattttggtacgtcgcccgtatccaattcgatgtgagcctaaaataactattgtaactattattcaaaaaatttgtacaaatataaaaaataaaatgttgtgcttaaagtactttgggtaataaagtaagtcaaaaaaaataattctaaaatttttttgaataagacgagtggtcaaacagggcaaacaaaaactcaaaatcccttgtattatgggatggagggagtagtttgtaacttttggtcccattggtgtttttgattgctcagttgatggttttcttcatattgaggcccagagcacattctatcgtgttgctactgatattgcgttcactgggacctgttagttcttaaattcatcacttccagatttttcctccaatgaaatcttgtttccatttttccctttggcatgctatctttgaaaaatcatgttgatacagaactgaagtaccggttaactgaagaaatttttgttagacaactgattttgatattttttgagtctctacaagtcttgatccatgttgtaggagcctatttctaatcccatgtcattcttattcttgcagatgagtcttggttttcattcctgcaacgcagtgactgggaaatactattaatggatgctatccttgatgttcctactgacgatgggaaacaccaaacaattagggtaacaattccagacaacacgacaccatcaccacaaattgattgcaaggcatgcaagtcccaaccaacgccgacgccacctccgcctccatctccgtcacctccacagaagtgaatccatctggagaatacttttggtccggaaacagctaccatggattagttttttctttaccctattgctcatcaaccctgaaaagaaataagtgctgcagttggaacgggagaacagcagattttttgctttggtgttcgcaacgatacaacatagaataggttacctgattgtttcccacgcagcaatactttgaaaggtaggtccatcagtcactaaactagatttgctttaggacttgctagcggggcatcatatattttaactgaagttttgatactccatgagatctcgtagattcttgctggttgcacaagcctgctgattggcatttggcaatacatacatatagtacgtagcagtttgattagggatgtgggattttaagttcaacaaatgatggcttctgtgtagtcaatcattaaattgtctcggccgagctatccgccatgtcattatctttctattgttagtgatcaagaggcctgcttatgagatttatccccttctattatacctcactttatagttatcaaaatatggctatttctagctgtagctatattttatgaaggatggaggtaatagattcttaactgattgccctttgttagatttggtcctgttttctaccatgcatataaccaacttttggttatgaatatggacaaatatgtgttcagatttatagcttaacacttgctatattttgagagcatgcagtatttctttttcatttgacaagtaaattgacaaactactcgcccaactacccaagctacgccatttgccgatctgcaccgtatgccgttggcgacctgctcgtcttgtcccttgctcgtcgcgttgcctctacttattctcgaataaaaccgtacataagtaatagggatttgatatagggaaaattggcatatctcattaatatgaaagtagtattggtgggttggttggtaggtaaggggtattgaagggataaaactcttccatttgtgaaccaatagtaggtaagagtatagaaatcagctttttttttggcatttgacggggaacttgtagttacattttggaaaagttcctgacttgtaattagcgcgcagttcgtctttggcaacctttagaactcccgctacctctaacatgttagagcatgtcctagctcatccaaacctgatctaccatattaccatttgaatggtcataaaaaaatccatctctatatctcttttcactccaacaaatcattcatattacatcttcaataaaccacacctttttatattttattaatatctttcaactcctaactggtaaaagtatatttctcttcatcttttctctatgacaggttcatcccgggtgctcgatccagagaagaggaagaggggaagggtggactaggacaaccgagtagaggggcgacagtgggagctagcgacgcagatgggcacgggtggtgcagggccatcggagttgggtcagcggctcagcacgagaggtgcactggtcacagactgtgggccgctagagcctcctaggggagggcgtgagcggcgcaggtgatagcgcgggtcgcacagggccgccgaagttgtcgcaattggaggtgctgcaggcgtaggggcaggggtagttgatccgaatgggggcgggagcttgatctggaggagtcggttgcaatatggcgtgaggagagagaaacgccaaatataaatttggtgtttctctctgtgggatagcgtatgcaccatttttggaggcctggatagcatatatgctagagtcgcttttttccctccatatgccattttttcaatggagaacatgatagatgagctgctaggcatgctcttagcaagcgtccgtgtggtggattatgtttcacttgtagtgaaaagaaaatcttgaccgtggaaaatacataacatgattatctgatgtcaacttagtggaacgct

SEQ ID NO: 73791 - DNA, 994 bp, Oryza sativa
atgcagaattctgtgcaaattaaacccttgatactattgccttccggtcatggaatcgagctaggttttttttgatggctgtaaaatcacgggcctcaccgaagagagactggatttggagagttggacccccagagatttttctagcaattacttaccataggccacgaagcagcggttgtttgggcgaaacgtcgaatatctgagggtccacaactggttttcaacgaggtgtttagtattcggatggcacataggacgttagggtggatagcttagacgatgtcggtgtcaagcgcgtcgactaaccgcgccgttaagttaggctggcgggcgcgacactgtggaatgcagatggagaattctttgcaaattaaaacgttgataactatgccttccggtcatggaatcgagctaggttttttttgatggcttcagacccacgggcctcaccatggagagactggatttggagagttggacccccagagatttttctagaaattacttacaataggacacgaagcagcggttgtttcggcgaaacgtcgaatatctgagggtccacaactggttttcaacgaggtgtttagtattgggatggcacataggacgttagggtgtatagcttagacgatgtcggtgtcaagcgcgtcgactaaccgcgccgttaaggtaggctggcgggcgcgacactgtggaatgcagatggagaattctgtgtttttcctatttatatgatttggaaatcctgtgaaccaaagaggcccagaatgtatgctcaactgtttgaatggttgaatagtggaattatttgagtgtacatatgacctaatctttatactattatgaaattgaaacatatattgaaaaaagtattataagatattcacatatagtttgtaaaaatcatatcttttaggagctagtaaagagtgtttatttaatccaattattagaaaagtgatgaactacttgcagtgagcggaaatcg

SEQ ID NO: 73792 - DNA, 1695 bp, Oryza sativa
caggtggtgaggtcggctggccggccatccgcgcggcgcggtggtcgttttattcttagccaataaagaaactaaaattctgcttcacaatttttaattttggtagcggctgagaggcaaacttcgatgtgactttgtataaatttagtttattttgcttattttttatatactctctcatcctagaatatagcagtctataactaaatgtaacttacactactatgtaaatctagacaggaaaaaaaagtacaagagtactctccatcttatattaagtgcagttgtagaatttaattaaaaaccaaattagtaggacaaacgaattacctaaatgcccggatgggattgagagtgggatggcatgtaatttaaatgatgaatgataaaatgggaaggaattaatttaaatcaaaagtggttgaaacagaaaaaatgtgaataggttgccacttattatgtgatgaagtttgcatactaggaggtgtttagatacaggggtgtaaagttttggcgtgtcacatcaggtattatatagggtgtcgcatggggtgttcaggcactaataaaagaactaattacagtatccgttagtaaaccacgagacgaatttattataagcataattaatctgtcattagcacatgtttattgtaacaccatattgtcaaatcatggagcaattaggcttaaaagatccgtctcgcaaattagtcgcaatatgtgctattagctatttctttagcctatatttaatactccacgcatgtgtttaaacgttcgatatgacagagtttaaaattttggggtgagatctaggcaacttatcctatgcacacacctatcttggtgtactcatgcactcgaccactatcagctcttgtattctaatccaaaggctaaaaacctaagtgtggcgtttttgtaagagaaaccacgaggtaagacttcatgttagttttcctcaaaaaaaaaattccatcaaatggcccattccgtaggaattctgaagatgcttttcagagtcattcttttattcaaaacaatcacataagaattatttcccctaagaattcaatctttgataattcctccatttcccctttgttccgaaggagcccatagaagacagtgtcgatgtccaagactttacataattgcgaccacatagaataatctcacagtacacgtggaggctgacgtgccatggtcctatcatggtacactttcacagcccacttggcacgatcttatgaccttccaagacaataacgcccaaaagttgtggagattttagctgcaaatgttgccatccaacacaaccagggagggtacagtcagtagaaaatgtacaatcgagtggagcaagcggccttgccaagttgccacggcctacatcccagcatttgttgtcaaaacatgagtgacccatcttgttgtgttcgtcctccaaacgacaaaccgcaaaacatcatcgaacatatgcctagaccacccaagtttctgctgttcgctagtactgttggatccacaagaattaatactctgctagagacagacagagatgcccctaggtggtattggcacatgtacaatgctactatagtttgcaatgccatgacatgaaagatatcataaaacgagaactaaagaaaatggtataaaaggtacaatatgaccaatacaataaacctg

SEQ ID NO: 73793 - DNA, 1038 bp, Oryza sativa
cagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgctgagtatgtcatatactcaccttgcaatcattcatcagaagaagagttctacaatgaggctgatggtgtggaggattaggtgtagccttggtcaagctacctgtggagtggagccgtctgcgccgtttatttaatttccgctgcttagaactttattgattgagaggaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcagcttcaacttccacgaagagcggatcttccgaagctgcagcgtctacacgaccaacggaaaagaaaaggcttttactctaataaactccatataacaagtagaaacaaagcacaaaaatgggttcttgacttcttaaggaaaaattagagactcgaacggtcca

SEQ ID NO: 73794 - DNA, 44246 bp, Oryza sativa
aatatatgcatgcatgcaactaatgattattaagatggctatttggattccagtcaacaatttaatttagcacatggagattacaaatatgaccatcctcatttagaaaaactaaaaaaatggaatatgcttaacacttttggatagagagagtatatatatagctttccaccaatttgtatggactatggattggcatattgtcaatctccattcttccaccctagattgttgcatgagacgctaagactaacatgtaaatgaaaaggaccatctaaaatttcttaagaataaccatacagctagcagaagatctatgtatttatatctttacaacatatttgatgttttgcaaaaaaaattgtgccacgcccttagagaaaaaaattcaagatgaaaacaatccaaaagaaagatatacatattaaaatatcaatttactatatcgtcttatattttagtcttcatttcatcaactgaaaaaccatgtttattttgagcccatttttctttctgttttatattattttttacacacatttcatcatgtaattcattcatgtactgttaatttgtactgccgtttcttcttggggtttcactattttcagtaccatctcatcctaacgaccaagctgtagatactagatgtgcatatggtttttttttttacgggtagatgtggatctctgatgagatcttcagtgtggaatagtatgcaactttggtattttcttcttgttgttttctttatgggttcaagtgcaaatagagttgaaacgttggatacaactcatgggcattttcggcactttcaatttggcatgacaacatcaccatgtggaggttaatgatacatctcccatagctattagtagggtgtttatgttaagatcacacgtcattttcttggagggaatgatgggtaaattactttttaaattactggtacaatttatctaggtacaagcaaatttctatatatgtatcatgcatatgcaagttttagccttcgagtaggtattaattaaggagaggggtcaaaatatatggcctcatcttttcgcttatgcttatacttatcggctaaaatttaaattttcaaccttaaatttgaagttgattttaaggttttttttcatcgtagtttatttttagccgttgcttttagatcgtaagaacacatatataaaagttttactcaaattatttttgtttgcaaatatatctgtcttcttagagtgagtaagatataggtctagactagttaggactataataaagataaaagataataggggtagtatggaaagttaatttaatggtaaaaatcaaatttataagtactaggttgttatatttgggataaattttaaactctataaattgttgtatttttttagaaggagtgagtagaattttttttttttgcttatgtactcttaaaaaaatttgtatttttttggtatttgatttgtaatgttattggggataattatcaacaactagctagaaggttaaacttgtttatataatgggaatggataagattatctccctacaaatatgaatagtatattatattttgtattaactctatattggggtgtttctccattccaagatatatctcccttttccaggtctatcttgatgtagtcactgacatatatgctaattaaggtctcggttatttgacgccatccgtatcctaagctaagactaggcaattagctacctattctttatgattgtgacatgagatttgtatacataaaacctgattaattagagccactacttcatgagaattgcctagaagcgtaagccgttaattttttttgtactttggaccttgatggatttcttattggaggccaacaggggcaaaaaggagacactcatgcctctgcatggggtgtgcttttcaacagcttctttgagaagtttatgctcacactgtataaagggcttttgatgtgtagaaaagttgctacagatgatctagagagcaccaagcatggagtaaacatatattgctaaaagaagatgctacaatatctgcataccaaaaaaaaaaaaaactaagtctgcaaaatgaccatgagctgaaaaatacaagtccatgatgaaacttttagaattacttttctccttttccataaaccccatacaaagagggatatatgattgtatatatgtatgtgcctatattatattagaacagaataggatcgagttgaaatttgttatgaattattctcacacatgttacttgctagtttgacttctgaatttttgtctaacattttttttggaagaaattaaatgtctagcaaatatatgtatgtgttagataatttttaagtgtacccacatgtatacttgtactaggtgtattattgatcaattcagatacttagctagctgtcctatcgctagttagaagtttgcatgagttgactttggatgagtctaattagactttgatctctggctagtttgttagttttggttgtgctcatgccagaggcagctagccctcttatttccagccgcaaattgagaggctcatttttttttttttaatcttttgaagacttaagagttaagactgattcatgtggctcagcaccaaatagtacaacacagcagaagaagtgttattctgacccttttagcaacttaaacttcttgataatcatttttgctcagttttcaagcataatcacacagtgagataacatttcattaaattggttaatatatttgcatctgatatagataattaataaatataaaatactaacatagctgtgacacagcaaaaagaaatcgcgcctacagaataagagtagtatgacaattgtacattctcaaatataagtaatagtgacaggagaattacatgagatgtgcttgcaagataattattatttttacaatgtcgcatctgaattttcgatatgcatttcgctcattatatataagagaagaacaagtgctagtaagtggtcctacggcatttgctttctaataagctgattaaccaaccttgctagcaaagtatcaccaaacgttggcagccataaaaacgtaaccagagaaacaaaatgaaatacagatttaattaaatcgaactctagaaaattaagatggataaacggatggaatggttatgctgggcctttactgggctcacttatcaacgacatgggcttcatctatatgtccactattccctgctgcagtatttctttcaaaagagaaagaaaaaaaaagaaagagaaactgtgatctgcagtacataaggaagacagggatcagagcaattcaatataagtccatgcaattcatatgcttatcaccttgtaattagtttttttaataatggtaatggtttacatatctggcttctgcctacaagcacacaaccaatgtgttttagaattgaaaatgaaaggaaaaaaaagagtgatgggacaagttcccaactcctctaaaaagatgattaccagaattaaaagctctataggtgctattccatccaaaatggtacaaaagactcttagctaccaatttcaacagtgtagcaccactgtacatagtattccgcttctcctgtgatagcatcaaacactaagtatagaaccaaccggtagacattaagataacatgtataggattagccattttttattataaaaactttatcatttcaacatcgccaaattaattaacatagagcattggtcccaaataaaccttttcttcggtacctgggcacccccataagcgaaaatataattagttagttttcaaacagatgatgaattaaaaatctaaaattaatccccttaataaaagaagggaaggcaaatgggaccatgctatttttcccagagtacagctaggagtactagatcactactactgcaagtgcaaatgcaattatgcaatgcaacataaattagctcatgacagagagtgtcatgaatatatatgatcatgcaggggagggttgcaaattgctatgacttggtaatttgataggagcagagcaactagagaggtcccacatggcagggagtagtgggcactgaacatgttgatatgatacagctaggtagggttcaatgggccatacatatactctgaaacacaagtgtgagattgagaatgagtgagagggttggatgttgatggaataaaaccttgtggcccccaatgattgagatgcactaccatttgctcaaccaaacagatcagtaagcaaggcatgcatctgcatatagcagctgaacagcattattttcccttcaaaatacggttattatattaattacatgtgtacctagtcatatgcataaactcgacgtcctgatcagctatgtgctttcatctctgaagcatgcagtctactccagcttgcagttgcagaagatctcagtgccatgctgctagcaagctacgccgtgtttagttccaaaataattcttcaaacttccaactttttcatcacattaaaacttttctacactcacaaacttccaacttttccgtcacatcgttccaatttcaaccaaacttccaattttagtgtgaactaaacacagccctaattgcaggggtcctgagcaaatatatgaaatgcaggagtggtggtgatctgtgctgtgtctcttgattgaagctgtggtcctagctaagataatcttcattcttcagctagctgtagacatgcatgcagtggcaaatttaacttcctaggaaattactgagcagaacatgcatgcagtgcccctgcttgatgagcttgcatgtatagtgttaagaaaaaaaatgatgacaaattaatcaaaatgggtcagattctgaataaatctagagctgatgagcggttagatgtatggaagtgcaacactctcagcaagttgatcagcattacattgcccaacccttagagccttggaaaattaaatgtgcttctatttttcataggacgaagtatatatgtttgtttggatgtccctgttcttttgtagaaatagatggattaacgggcacgtccataaagctcttaaatggcacggcttttttaagagaaaaatggcacgatttttacaacagaaaaactttttatatgttaatttcttaattaaaatattattttaaatctattttcaactttataacaattaattcattcatttataccctaaaatgctgatactagacatatataccaaacatatataccatcccttttgcatctccaaaactttgtgtttcccggtatatcaacatcagtacatacatagattttcctagttagttgtatctcttgtgatttaacttttaagtacatatatgtgatggcatgattttgaatgaatttaagtatgtgaaaatgcaaatgcaactactccatctatttcatgttacaaatcatttgactttttttcttagtctttaggtttgatcaagtttatagaaaaaaataacatctacaataccaaaatagttatattaaatttaacactaaatatattttgataatatatatgttttgtacttaaaaattattagcatatttttttacaaatctaaactaacttaaaaaagtttgacttaaaggctatgttcggcagtcacggttggaaactaatccttggtgcacgtaaaatggaacagctcattagcatatgattaatttaatattaactattttttaaaaataaattaatataatttctaaaataatttttgtatagaaaacttttataaaaaatatatcatttaatagcttgaaaaatgtgcgcataaaaagaagagagatgaactgggaaaggagagggaataactgagcaagtactctacaactgagcgtgtgcagccgcagtagtgacgggggagatgaaagtactccatccgtcccaaaaagacttaattcttggatttccatatccaatgtttgaccgttcgtcttatataatttttttttatgattagtatttttattattgttggatgataaaacatgaataatgcattatgcatgatttatctgtttattttttttatatattttttaaaataagacggatggtcaaacgttaaacacagaaatataggaattgagttttttttaacggagggagtaggcagcatcgcggctatttagactgacgggtgggcccagccgactcattcgtttccccgaaacgtgcacgtgtgtagtgtgaacccgtcctccccacctaacctaggccaccactgactccactcccatctccatcaaggcatctgcccgagccttccgcttccgaccgtttataaaccccaagcgcagcgatcgagagcgaccgctccgaccgccgccgccgccgccgctctcaggtgatcctctcctctcctctcctctccgctcgtctcttccccctcccgtcaccgccgccgccgccgcaggctagctcgatctagctttcgatcgatcgaccaccagccggcgcacggcgacgacgtgcgtacgtacgtcgaagccacacgccgcggggcggcgccgccggccgtacgtcgcagcgaagctaggcgggcgtcacggctgcttgctgctgtgtccgatccccgccgcagtcgatcgatcgatcgccggcggtgaggtcgtcgtcgttgccagctggtgccacaccggccggggcgccatcgatctgatcgagacgatcgaaaccctagctagctccatatagccgtagcatcgccggatctgtggttggttgccgggtatacgttgaggatgagtttttttactttttttttgtttttgatgcaacaaatcaacaaatggaggtgcatcgatctcatttttacgatgagttgtagtatatatacataactagtacggactatggagtaggctagtatatatgggtgaactaagaattataggcgttatgcgcaaactagtttgatttcacgcgtgtgcgaggttatttgaaagggtgattttactatccttgaaaaaaataaacccaggagatactgcatttcataaatttgataccacaaagtaataagtatcttaaatactgtaaaattgatctatttgaaatagaatcgtacctttatgtgtctctaaaggttcatacgagggacggactacgtaatagttgacagagagtaaattgaaatcttagacaccttagatatagaatcatagataacgacaaaaagttaacgatgccatcgattgggagttacgaaaaatattaatcatctgacacgtagcaatcctgttaatacaatttgtatttgctatatatatgttgtagctatcattctatgccgctctaataaatatgcttccattccatcatgatggacacatatatctctcttttctctctgatcaacggttggtgggtgataacagggcatatatgctggacctttttgtggctttcaaaaattatattctgccatttatttaactcaacgtgaaaaatatttatgcgcgctgcatgtgaaggggaataattgatgtggaatttaactcgagtaattcaataatatctaggtttattttgggatgcgatcggacccttataaggtgcgatgagattcctatgacgtctcttgcgtgggccattgtgaacctgttggttatgtggctaacatatgagctaagttagaggattcagttcttataagggtaattttaccattctagtgtaaaattcgatatctctagatactgagtatcttgaggtaccaaaaaaatttagtttaaaatttaggtagctcagatacttttttttaagaactataaaatttctcttcttataatatgacctttatgcagctgatgactcatggagttaactgttccttgcaggtttagtagggttttaagtttcgatggcaccctcatcccgtcgaaaattccgtcggaagaaaccttcacaaaaggtcgactccataggccttcagacaccgcgctcttcggccttggaaaaccaagaacccttgctgagttctgaatattcaggacacaattctgccatacagaatgtcagttccagatcacagacattgcctcttctctagcaattgctatgaaaatagatgatgagtagtttatcaccatcgatgacgcctctaatttgcatctcatttttcattctcagatccctgaagatttgaccgtctgggatgttgtcaaaggcgacgtcgccattgttgccagcaaaatgaaatccatgacagagcggctgctggaagaactcaagatcgcgctccggttgctcatggaggacatcgatgatcagagccatgtagagcaactcgttcgtcttcagaagcatgtcgaaatcaggcctgacctgacatcggcaacgcttctgacggctcaccatgtgcagttggagatgtttgttgccctcaagatggggatcccggcatatctgcacgaaaatgtcagcgtgccacggagccgtctcgcggagatcttcgcctacgagagatgcaagaacatctcctgccagagtgttctcccagctgaggagtgcgactgcgatgtctgctgctgcaggagaggcttctgcaacctctgcatgtgtgtggtctgcaacgggttcgatttcgatgtcaacacatgccgctggattgggtgtgacggctgctctcactggacccacgctggctgcgcaattcgtgaggagcagatcaagactgtgattacggttgaagatggagttgcccactatgtgacagtgttcttctgcaaggcctgccatgggacatctgagctgctggggtgggtcaggaatgtgttccagcattgtgccaagatctggggcacggatgcgttggcgcgagagctcgagtatgttcaggaggtgttcagtgttagcgaggattcgaaagggaagaaattgttcgagaaatgtactgatctgatcgaaagactgaaggttgttcaagctgaatcgatgggtcctgaagttctgcttcaggcgctccaaggtatgtgtactaatttttgtcttctcatcttattattatgctgatttactcagtgcttgtgtttggttcttagcactgactatgttacggaatctatgctttactttttctttatttatagaaggatcatcacataatcagatagaattatcctgatgtgatgggtaattgatttcatttctaacttttttttaggagacatttccaacttttccaattgaaagcaattgcatatcttcaattgtaagctgattgattgtccactgcagtttagttttatgcatactgttttacttgtcagaacagctacagttttgaagccaattttttacaaattaaaaatatgtggggcattggaatcaacaacaatatgtttgatggctatttctcatgattgaatgaaattccagaaagtttatcttctaacgtgtcatatgcttactgtcattgatatctgacatggaattaaattaaatttgagctattacacactgacattttccatatttcccagagattgagctagatgatgctccagagatcactgaaaacgaaaaacaggtgcagcagaacactgatccccatgaaacctgcaacaatcaactctctgaatatgtccaagaaactgcaatgacgaacaagaaggttcgcctctctgtcgatgccatcaccgacggcgaggtggagaaggccaaggaggccgagcagcagctgcagcccatggcggcggagcaggaggaggtcccgccaccgccggcgagcagcagcggcggcgtggcggcgccgacgacgcagaacgcgatgctgtgcaagatactcgacgcgctgagcggcatgccgtcgccgccgtcgtccgagtccgccgccgcggtgtccaaggtgcatgagctgctgcgcgaggccctgagcatgccgcgcagctccggccgcgccaccgccgccgccgtcgacgacgacgacgtggcgcagaacgggagagacagaaatgacggcgacgacccgcggcagatgatgatgctgaaggagatctatgacatggtgatcggcatgacgaagacgatgacgaaatgatcatccgacgaacatgtttgtcacctcacatgtgtgtgatcagtgatccagatccattgctagctcgatccatccatccatccatgcatgaatggtaaccaatctctctgcactctgcaccgtgaacacaaaaaacattcagaatccatggtaaaatggtaagtggatctgtgtagtgttttaccaaatttacctgtatgtactgcagccagggtttgaagtttcgaaattaggatttctactgcatgtgggcgatagaaccgaaatttcagatttttttcgtacgatttttttaaaaattttgactgattttgaatgtatttgaataaaatctgaccaaattcacaaaaatttgcaaaaaactaaaagtttgggggtgagatatgagcatttcggtgaccgaaatttcaaaccttgactgcagctcatcgatcagccaaacacccaaccttgtttttttttagtatttttttactgttttactgatattgcattagttagttgttcaattgttgtattagagagatttatccatgtcgagataaggtgagctggatgcatgcacgggtgcgtgcccgtgggcgctgtcacgggtgcgccgtgcgcgcgctggcgtgcgcgtgcacggccggtcgatcgctcgaccgcgacagatcgcgacgccgggagcgcgcccggcgcgccgcggcgacgtggatctggtcggcggcgtggcgtgccaaagtcgtcgccgtgaacaagtcaacgggggcatcgtggaaacgaagacacaggaggaggaagagcacgccaagtcaaaacctgacagctcaatctaatacctcgtcagtgcaccatgcccatgaatcgaggcctgtatgcacgaatctcgaggggatttggacggatgggatcatcccggtgcagggatcggggtcgtggactcggaccacacctccctcccacggttggttcacgcgggagaagagagagggagagagcgcgcgaatttttctataaaagcccctctgcttgtcccaaatcaccacgcctcaacagctgctgcttcaactctctctctctctctctctttctccggcgagatcaccggcggcggcaggccacgcgacccgcggagatggtaagcgagcctgaatccctcaacacttctcttggaggcgtactactgtagctccctctcctgttgggtggaagggcgcgggtacggatcgggatctgggtgaggaaagggtctcgcctttatcgtcgagttgaggaaaaattttggtacaaagagatgctggctttcgcggatccgtgcggttgatgtgttgctttcgccagatctggtggttttttcgggtattctgttgatgtttgattgctggggttacagaatttgttgagatttgtagtcgagataggcagttttttttttctttttgtgaatcagtcttaaattggagtagtgattagcaaatattttctttccattctccaattgatccttcctttgtgaaaaatagagcagtagttagttctgattgtttctgacagacataattaatacttaaaatttaaaatttataagcttctatgttcttgtattctagtgtcgatatcgatgattctccagttagaaattatttttaggttacataacagaatagctttcgtacttgagtttggagtggtaatcattaggagcatggttaggcatgttagtatcatcaaggattggtcttagcctcttacgtagagcgaggtaaattgcataggttctttagcaaaatatgggtgatccatgtttgacttgtggttttaacaatgttcactgggaaagtagggaggcatctacccattgaatatggcttttttacatttaacaactaaaataatccaaagagtcagtctgagtcagagttgacttggtctagaaaggaaccgtgtttcaaaaacctgtagttgcaacttgttatctgattcatggtaggtttttatacactatttgggagttgaaagtgcttcttgtggaatattctgaatggtgtctgaaccgccgttgcatggtttaggttgtgcttttaggagaggtgtaggtcaaggttaagttttgccaacttttatgtctacctttttttttgcactaagctgcattgcaaccaatgttctggtttccattattttaattttacaacttttaggcataaatcggatataggaagaatagtgaatatttgatgtttaaagtaatgaatagtaatatctaaactggtagctgagcagcatttggttcagttagagcatgatgtgatacagattttgcacttttctggattatgacttggcatagtaaggtccattaactacttataaattctataaaaaagtgatcttctctttctttgatggaccatgagttggtctccaacttgttagtacatggatctgccatttattttacacctggcagatgtaaagtagttagaaaactgagtatgaatatttgtgtatgctgaatggttgggttgttttgcacgaccagactacttcaaggcgccttgctgacaggaagactgcaaagttccagaagaatatcaccaagaggggttcagtgcctgaaactactgtgaagaaggggaacgactatccagttggacctcttgtgcttggattcttcatatttgtggtcattggatcatgtatgccttccaaccttatctttatcctctgttgattttatttcactgacacttgtgctgtgttactttagaatgcgctgatgcatagcttattattgtctcttcttttgctttcaaaagataatgacaaatgaattccatcacattagctttaagtcttcatgacaaagcactcttaggttttgaattgatactagaggaattaaaatgctgagtgtcactctgctacaaattcatgataacctaatgaaatagagctggctatgtcactagaaatttaagactgctattgtgcgtgttttatgagtgatttggtgaattcttaattagttattacaactcaaattctaggttatttttatctctgttgtatactataccaacaaatctagctcttcagtgcatgcaagtaggtcatgttttgatcttctgttgtgtagccatgcaactttcttgcctatctatatggaacttacagttcggatgttctctaggccaccttgctatgtttcttctgctattattgcgcttttaacaccatacatttttgtgcatctgcagctttgtttcagataatcaggacagcaactagcggcgggatggcctaaaaacagagctgattcaagagatttgtgatacattgcatccaatgcaagtggcagcggcagctaaaatgtttggtgttgtcagtgttttgtatgcatttacatttctgaagcatcgagttgaagtacaatgtaacagaattacctgtcttacaatgttgaatggattagtataatattataccgttcatctccagttaacatctgctgttggaaaaggtccctgcttgtgcttgtgaattttgtcggtctggaattatgaattgctggacatgcagacctcatcttgttatcttcatgcgagcaaattgtatgcaaagaagtatgttgattcactgccattctcatcagcttaattgacagacaaacaaaagataaccataagcaagcaccgtcagcactaggcactattatatcaaagagagtgatttgatcgtttcaccttgaactctatgctatggttaatattatttagtttggataagaaccaaccaacagatctaacactgcagtttacttgctctaaacctttgtgagtatcatgttcagtttcttcagagtattcttgcttttaacactatacactttttacttctccgcagttctttttatttcacataatcaggcatggattagatatatcttattttcaagagattttcacataatatatgtattaactgtcatgaaatactgaatttcagctaatgtctgaagaactgtaaacagaattactagtcttacaatgtgatttgtgaatttgtcactccacatatttcagatcaacaaagaaacatttgacaagaggttgaaacttcatcagcatgaacaagtgaagcaacaaagtcacttgtggagtccttgtcaggaaggaccctcatgttaggtggtaataatcactgccattctcaccaggtagctaactgacaaaaagaaagctactaatcatgctaccctcactgataatcactgtcattctcatgactaatcaactccactaaggcactaactcaccactaatcttgcaaacttcgtatctcacttggctttgcatgcttgtcaccatcttcagagctgttcattctgatcacctgctgccacctgaagattggaacaagaacaacatctgcttcttagtagttgtttcgatcatattatacgctgttaatcttggtgatttttattttgtagagaatttcgtacgacagagatcgttctgtcctcatcggcggcggcgggcgacgcgccatggcgagcggtggcgacgacgcggcagcgccgctcctcgcctcgaagcacggcggcgagcctcgccggaacacgttcgcgttcgcctgcgccacgctcgcctccatgaccaccatcctcatgggctacagtacgtctccgagcttgctgcttcgagtgtcgcgtcgtggcacgcgatcatgccgtcgccgtcgttgatgtcgtcttgctgtttcttgtagatctcgcgctgatgagcggagccgagctgttcatccgggaggacctggggctcgccgacgagcaggtggaggtgctgtccgggtcgatgaacgtgttcatgctcgcgtccatcctcgccgccggcacggtggcggacgccgccggccgccgcggcacgctcgtgctggcgaacgcgctgctcatggccggcgcgctcgccatgtcgctgggcggcagctacgcggcgctcatggcggcgcgcttcgtcaccagcgtcggcgtcgggttcgccgtcgtcgtggcgccggtgtacgccgtcgagatctccccggcgtcctcgcgcggggtgctgtcctccctgccggagatattcatcaacgccgggatcctcctcagctacgtctccaactacgccctcgccggcctcccgctgcgcctcggctggcgcgtcatgttcgccgcgggcgtcgtgccgcccgtgttcctcgccgcgggcgtgctcgccatgccggagtcgccccggtggctcgccatgcgcgggcgcgacgccgaggcgcgcgccgtctcgcgcgcacctcggatacccccgcggaggcggacctccgcctcgaggagatcacgcgggccgtcgcggcgcaggccggcgtggccggcggcgtctggaggcagctgctcgtccggccaacgccgacggtgcggcggatcatgaccaacgtgctgtccctccacttcttccagcaagcgtccggcatcgacgtcatcgtgctctacagcccgctggtgttcaagcaggccggcatggcgtcgaacacctccgtgctggccgccaccgtcgccgtgggcgtcgtcaagacgtgctccatcctcgtcgccacgctcctctccgaccgcgtcggccgccgcccgctgctgctgtggagcgcggcggggatggccgtggcgctggcctcgctggcgctgacgctctgcgtcggcgccggcgcgccgtccccggcgcgcgcggcggcgggcgtggcgtcggcggcggcgtacgtggcggcgttctcggtggggctcgggccgctggcgccgtcgtacggcagcgagatcatgccgctgtggctgcgggcgcagggcgcgggcgtcggcgtggcggtgaaccgggtgacgtgcggcgtgctgagcatgacgttcatctcggtcgccggcggcatcaccatggccgggtgcttcttcgtgtacgctggcgcggcggtggcggcgtgggtgttcgtgtacgtgcggctgccggagacgaggggccggagcttggaggacatggacgtgctcttcaccaagtgaagatggctttatttgggcgatctcggccgtgtttctttcttggcctagcggccggtccggtgctagccttttcctagttctatgcgttggcgctgtcgatgtgtgggtaatgatatattttttttcctagttacgacctttcaattttttctccctctatcaatagaatttcgcactgtcttatgtgagtcattaaaaaaataaagatggctttatttgtggtattattggttgtgttgctacgattgtccgcagttctaacttgaaagagatgaagaaatcatttctaggcagtagaaggacaaaatggaaatgttaagcttggaaatattaatgtaataatctccatgatggtagactcagaagtactttcttgaatgtagactcaaaactcagaagtgcactcagttcaccatgaacaatgacaataccgaaagataatagaacgaaacataccgaaagatacttatttttttttaataatagaacgaaacatttcagcctttactcaagagttacagctaattagtaccgaaagatactagctagctacctgaaattaaccgtaatcaatatcaagatcattgtctttaccataattcaagagtacacaaattaacaatgttacgatgatgtattgacatggttaattatggttcaagagtcccatgtcctaactgaatattagaatatgtaaacaatgtctacatgtagcatttcttggggatcaggagcggtccacagattaaacttgaaagagtgaatgaggagaataaatcatttccatgcattgctacctatacgggcccctttgaatcgcagggtagaaaagaacagaggaatagaaaaaatacaagattctgacagaaattgaagtgtaaaacataggattgcaaaacacaggaaaaacaaatgaatggtcgtttgattggagcgcaggaaaaacataggaatcggatgagagagatagacaaaggaaattttctaagaggttggagctcttactaaattttctccaaaatccacatgcaatgtgccattccataggaatttcataggatttggaaagcttcaatcctttgaatcaaagggccaaataggaaaatttcctataggatttaaatcctatgaaatttctacgtaaatcttttgattcaaagtggcactacatatggtgcaattaaagggatattatcctacatgtcaagccatccatgcaacctgccgatcagttaaacagacaggccggccggcaaaaggacacagaaattacgcaggaagtaatggaatattcatccaatcgaccatcttcataaagcattcaggagtaccagaaagttcacaaatacatacattcagtttctcatatataggtgataccatcatacttaagataaaaacaaggatcaatgacgatatacacaaccagatatgtaccaaaagatacttcctccatttcatatcataagactttctagcattacccatattcatatatgaatctaaacatatatgtgcctagattcattagcatctatatgaatgtggacaatgctataaagtcttatagcctgaaattgaaatggaggtagtaatagctaagctacttcaaaccgcaatcaactaattaactgatcaccacattactcgcagtacactacagtagtaggaactgatcatcacattactagtagtagactgatagaagaaataagatatgattcaaccaaattaaggtgatcgactgtagttaccacgcatagttaatcagagtagtatagtcatcatctaacagatcgatcagcataacggccgtagacttggttaattataatagtagtagtaatcgtagtaatcatcctcttcactgggcggcagcttgagcgtcctgatcctcgcgcacttggcaagcagctgggcgtcgtcgtcgacacacaaatcccagcagctgcacacatcgagaagctccaggcgagggcagccatcgacgatggccgtgagctcgtcgttgctgacgccgatgccctggacagtgagccgccgcaggtggcgcagctccgccaccgcgagcgcgagccgcggcagcgggggacggcgatggccgccgctgctgaggacgatctcctctaggagagggcacttcctcgtcagctcggcgaatccttccgtggacatcctggtttcgtcggagcaccaaacggaaataaccttcagagaaggcgacctgtacttgcaaagttgcaagtttgtaaattagatgaataccgctgcgggaaattaagttgtataatatatacaaataagatgaagtatgaatattaaaactaaaaaaattgatacttatgaattttgaggcctaaaaatgattaaaattacttggtgttatgagagaagaaaaaaagagacaatttgaaccatagatctatcatccaatggctagaaataattggggtgacgtggcttcatgagagaagagataaatagcattaactacacttagtggggatgaactatataagtatattggattaaaagcatttttttattagcatcgatatatatctcgcctgttgtgagtggttcaattataagctgatcgattggcgcaggctcatgctttgaaatttcggcctccaccgactaacacaaatctccccgaaattttcgggttttttcaaatgtgtaaatttggtcaaaatttattcatattcagtcaaaatatgttaaaaattttaaataatcttaatccgaaaaacccaaaaatcacgaaaattttaaatttccggcaaccaccaaattttcggtggcaactgaaattgcaaaccctagcgcgcgcagaggccaaaactttttttttaaagaaaaaaacacttcacggtgctagtatattactcctatatacggctagtacgagtgattcgggatataaattaatttatcttcccacttaaatggtttataatttaaaactgtaaaattattatgtattagcatatagtgttcttttttttaacagtatatgctaccgatacattatactccatccgtcccaaaatatagcaacattatatcacatcaagtataaggttgtaatattttgggacgaagtgagtaatgtacttatatagttatataggcttctataaaattaaaaaaaatacttacctgtctccaatatactcgagcagctcatcgctaacaaaatcctcccccttgaacacctcgagccggccgccggagcggtcgacggcgaccttcgccatggcgcacatcaggtccctgtcctgcccgaggtggaggcaccggaccgcgccgcgcagcatgtccacggctcgccacagctcgggcaccctcgccgcgtcgagccacgagcggcacgcgaggcccgcgccggcgaggacctcgacggcgcccaccttggcgaacaccaccgacagcacgtccgccggcagctccgaccagtccctccccgccggcgccgtcgtctccggcgccggcaacggcggcaggaggaggacatccattgttgttattcgttggtggctgaaaacaaaaatggatagttagatatatgcatgtatgtgtttgccattgatttgatttgatttgatggtcagattgggatgagaagttggaaacttgtagtgttataatccatgcattacctttgctgatggtgaagaagaacacagtgcagttcttgcgctgatgtgaggacggccggcgagatttataggagagatatggggatggagattgatcgttttttttttttcatctcggtgcaaatgcaaacctcgcgttctacgccggtggcattgatgaggcgctggaattcaggcgcgagtgcgattggctaaagtgagcggcagctactagtagcaagcaagcaaccaacatgctgtgcgacgcgacagtgtgcgtatttactccctccttccattactcttcagattataagttatttaaactttaattaaagttaaattgctttaaatttaatttgtaaaaaaaaagtagtaatagggcctcatcagcaagctagtatatccttagggcacccacaatagttatctataagctctctacaagagatccatgtcagcatattttcctacttggaatatattaaatgaagagagagagcaaagctatctactaacttagagatagtctatagagaaaaacgaggcaatgtatgagagagctatagatacccatgtagacatactattgaggtggtttaatattaatctagtctattgttgagatgtacatgttttatagagaacaccttactttaccattgcgggtgctcttaggctgatcagccaaataagcctttttcaattcaggcaaatccattgcattgattggcttaattagttaattggctggacatacaagggatcttctatttgtgtgtttagttcacactaaaattagaagtttggttgaaattggaacgatgtgatggaaaagttagaagtttgttagtattgggatttttattttttgtgcatggccactagagagttcacataattagccttcactgatgatccaacttccttacgggtctcactctgtttggctgaaaagcttcggcccaagcctcagccaaacaagccagacacaaatatattataaaaatatatttaattatagatttaataaaattaatttggtattataaatattatattatatttgcctataatcttaatcaatcttatagtagtttgactttgatcaaaatgtttgtttctgtggttcgctcatataatattagactacttaggccccgttctaaagtggcgggttaatatgatgttaccatccaatgcactattcacacagctaccaactaaagtggcaagttaatgtgctgctatctactccatccattccaaaaaaaaattcaatcctaggtttaaatttggacgtacattatgtctagatcaacccaggattggttttttctgacagagggagtattatttagactgctaccaattcagctcaacgtagccaaatctgcgcattagaatggagcctaaaataaatgtttgcttccaagtccaacccaactagtcagcttcctcttctttcatgttaacaaacaaagcccgaatccctatcaaccaccttactttcttttccatgggatttttgttgagcccgcagcttccataattgaattgggcctcagctcatcccatcaactggtttttgctggtccaaccaatccagtttaattaaaaaccggttcaattgatttttattcctgttcgattgcacacacgtttattttagttaaccagataggccaaggccattttgtaggttttttaggtaggaccatcggtacgatcctaataagtactatgaaatttgtaagattcaaattatataagaaaattttcatatatgaccatttggaacaaaggattaattgtggcttttggagggggagagagagagtgtgtgagtgagaaaggttagtgagacatgtaaaaaaaaatgaatctattgaatctgacagtggctaactagaggatggcttatgggatgccattatatagggattcaaagtttagattttggttgaaattgaagatgatgtgagtgaaaagttgtatgtatatgataggttgatgtgatggaaaaggactgaagtttggatccaaattttggatctaaacacatccattgttggtctttaaaaaaccaggacttgtaccatccaacttctatgcttggatcgtcctacatgaacaacagatgaacatgcagcaggtagcatctttaatctgcagcactcgtgttaggtgataaccaattgtcattacacgagaaaaaaagcagaggacaaaaacaaaagctaaccactggtttagtacacatctgatgataatctcactaacaagtgatcgacaagacaaccaagtgattggccttcatggtcgtcgccttgcaaacagacatatctcacctcgacattgtccgtgtggatctgttagcatcatggaatcgatctacctgcatctctgatctgagatactttttgctcgtgtagagatcgccggttcaaacgttttcttccggtaagtttggatgggtgatttccttcaactttacataaaacatgagaattttggaataatttttttttggttgagtggaagataagaattatagatagtattgatgtacatgtggcctcagaaaataaaaggttctaatgtttttttttagaccttgaaaactgcttgggctttgcctatgtaatgaaataataccctctttagccaaaagaacaagttgttttatatcccaaaaaacaagttgttttaaattatgtgcaattacacgagttaactttgagcataaataggattttggtatatgaaaatggcaaaaagaaaaatcgccaacacgcaaaagtcttaggggaaggtgagagatatgacacgcaagaacttgctaaaccaggtgtgactcctaaggggaagatgagagatgtgaaactaagccaagctatgtgcctaataacaacccgataggattggccatggtctcaacccattgccttccttcttgcccaattcactccaccatactgttggcacctatgatagaacattgtcgaagacgcgggtgttcctttattttcataagtgctaggcaacatgagtgcaagggagtcgaaacctcttcctgtcttgcttgtgcaggcgacatcgcgaggtttgccaccaatcttggagcatcaataaacatagtttccatagcattacacttttgtaactattattgttttgaaaaaattataccaaagaactatatgcagccaaaactgtataatctgactttgaaaaatccaaaaacggttttactttttaccgaaggaagcatatacaattgaaatactttccttagaaacatatacttgagtaacctccattttaaataatcaataggtgatatttatattcaacatacctccaataattttaaccaccataaaacacctcaaaacaaactggttgttccccgggaaatttttagatttttttaaatatttgtgaatttggtaataatttattcaaattcaatataaatgtgttaaattttcaaaaaaaatcgttcgatatttcggtgccaccgaaattttcctgcttaccgaaatggaaaacactggttgtcccagcaatggaagcctttaaaagccagcaatttacactatagggctgtgtttgcatccccatgttcccaacacttctccctcgttttccgtgtgcacgtttttcaaactactaaacgatgcgtttttttgtaaaaagtttatatacgaaagttgctttaaaaaatcaaattaatccattttttgaaaaaaaaattagctaatacttaattaatcacgcgctaatagaccgctccgtttccgtgcgggagggattagttcccatcgctggaatccgaacacagcccaagtcacaactcgaccgtgttcgccgagaaaccaagccacggtcaccatggcgcacgccggcgatgccacggcgccgctcctctcctcgccggccaagcccggcgacgagccccgccgcaacatgtacgccttcggctgcgccaccctcgcctccatgaccaccatcctcatgggctacagtacgtgtgcaagttcttgagcacgacgcacgcatcaatggagcaagctcatcgtgttttgtgtgctttgcagatctcgcgctgatgagcggcgcgcagctgttcgtccgggaggacgtggggctgagcgacgcgcagatcgaggtgctcgccgggtcgatgaacgtgttcatgctcgtgtccatcctcgccgccggctgggcggccgacgtgctcggccgccgcggcacgctcgtgctggcgaacgcgtacctcatggccggcgcgctcgccatgtcgctcggcgccacctacgccgcgctcatggccgcgcgcttcgtcaccagcgtcggcgtcggcttctccctcgtcgtcgcgcccgtgtacaacgccgagatctcgccggcctccgcccgcggcgtcctctcctcgctgctcgatgtaacgctcgcatcatagctctagtagtgtttgatttgggtcgctctgatcgatgctccgcttgcgtgtgtcagatgttcgtcaacgtcgggatcttgctgagctacgtgtcgaactacgcgttggccggattgccggtgcacgtcgggtggcgcgtcatgtacggcatcggcgtgctcccgccggtgttcctcgccgcgggcgtgctcgccatgccggagtcgccgcgctggctcgccatgcgcggtcgccacgccgacgcgcgcgcggtgctcgtgcgcacctccgactccgtcgaggaggccgagctccgcctcgaggagatcaagcgagccgtcgaggcgccgcaggagtccgccggcgtcggcgtgtggcgggagctcctcctgcggccgtcggcgatggtccggcggatcgtcacctgcgttgtcggcctccacttcttccagcaagcgtccggcatcgacgccatcgtgctgtacagcccgctggtgttcaagaaggcaggcatggcgtcgaacacctccgtcctgggcgccacggtcgccgtcggcgtcgtcaagacgtgcttcatcctcgtcgccacgctcctctccgaccgcctcggccgccgcccgctcctgctcgccagcaccggcggcgtggccgtcaccctcacctcgctcgccctcgccctccgcgtcgcgtcgccgtccacggcgagcgccgcggcgtgcgtggcgtccgtgatggcgttcgtggcggcgttctccgtcgggttcgggccgatgacggcgacgtacaccgccgagatcatgccgctgcggctgcgcgcgcagggcgcgagcctcggcatggccgtgaaccggctgacgtgcggcgtggtgagcatgactttcatctcgctcgccggcgggatcaccatggccgggtgcttcttcctctacgccggcgtggcggcggtggcgtgcgtgttcgtgtacgtgcggctgccggagacgagggggcggagcttggaggacatggacgtgctcttcgccaagtgatcaacgtactatttcattactacattttttatggaagagtatgaagaatttatttattcttaactttgattttctccatccaagaagggacgatgtaacatttagcaaccaaaatgcattggaggtgttatcagttacttcgtatagatggacaaatgggccgcctgacacgacctggcctgggcacaactagagcatggcatggcccaacatacttttcgtgtcgtttcgggctagctcacaggttgtacctgcgacccaggcacgacccgtgtcttattgggctgtccattgtgctcaccttgaaataagtctattttgcctctctcatttctttgggccatgtcttatattcctagataagtccattttgagtcccttacttatttaggtcgtatctatatggttggaaaaagtctcttttccctctctgattgttcggccgaactgacccgttgtaccgaagaagaggcccaggcacaacctattggtcgggccgggccgacacgggaccgacaacagtcaggccttgctgtgccttggtcgggccaaatctccatgctgtgggccagaccgtcgagctatgggccttttggccaactatataggttagcattccgcatctataagagtctcaaacacaaccaacctatatgcatgcgtaaatacatgggcaaccttcgtagttcactataaaatgcccatctatttgttggtcacgtaataatttcacaaaatcttaacaattattcgatgtcgtgagtttgtcgatttgtctccttccctgagctaatgctggcccatggtcatcctcctcttttgtggccaaggggccacaacaagcctactcctccgtcctccctctaaaaccacttccttgacctaaccctctccaaccatcttcgccccaagcacctggatcttagggtaaagacaactccgggctaatctgacaatcatggagttgatgatagagatggagagaagtattctcaaatgcctaattttggagtgacatttagactgtgctagttgaagctcaccttttgcttgaacatggctagctggccaatttttttgcataaccagatgtaacaagagaagatatttatttgagtgtgttagggggcgtatttgcgggtgatgagtatggtgttgtgtgtatgagtgtgtgcatatgcgtgtgccgtgtaatcgaaaaaatgtttatttaagaatagttatgcaaatctaatatcgaacacggaagaattttccagttcatgtagaagtcatactttttaaaaaaattaaaagtttatgtgaaaatcatgtaaaattaatgcatgcctttcaaaagaatcataagtgtttagcactcatgtacttctagcttgaattattattaattagtatatatatcacaaattttttctttaagaaaattctttcattggtcttatcactattgaagtattgattgagtagatttgggattgtactgttgacctgccttcggtgcttttggatcctatattcctactcctacaagaacaaaagacacagcattagcagaacattaatctttgccggcacaagtacgaatagtactactgtttggtgataagattcacttgtcatgagctcatagacaaacaaaggttagccacccatcaggcattcaggccatcagttgacaccaaaattctcaaaataaaaacaattacttacgccaatatagaagggaaaacccaacaactgagttaacagcttttaactctacatgcctcactgatgggccaggctgctaatagtctcactttggacatccgttatgtggatcatttggagcatgagcatccatgcatccctaatgatattcattattgttgttattgtagataactttagaggcatgattaattattttatgattcagcgacatgtacctgtgatgattgattagacaggtactcacttaacaatgtaagtactatctgtccaaaaaaaacttaatctaagaggggtcacaacgaatccagttgatttttagaaaatatagaggaactagatttttcaagattatcagaaaatgtccttggaaaataagattactggaaaatggaagtgtcataaacatgtctgcgtttttctttttgtcgaacagattacatttttggattttattaaccaaataacttgttgctctcaagtggaagatatatttaaccatcaaagatggatgaactgattgaacgttgatgtttccgccattgctgcttttaatttggtaaatggagtaaaaatattttattttacacaacttcgtgatggttaattaagattgtttttggtcaaccattaagctggacacactaatggttctcatggattgaaattcctgattccatttaacaggaagagtttcccaccgcattgctagctgacagcatgtgatctgccttcctcacacctaagctcccccagtctccaactcaaatgtatcattaggaatttaggatttcccctttgtttttattttcttctgtgttggctgctagccttctacggattgttgtggaatcagggagccctatagctgtgtgtctgatgtgtactctattttgtaatcttattgacttcgagtgcgggttttggaatctgtaacaggtagcttctgatgtctaaatttgcagaatctcgcaactgatttgtaataggagttaagtagagttgaaattttgatttcattcttgctcccaaaggtagaaactgtgccatggaagatgtgtacctttgagcaagtggtcctttctcgcctttggtgagaagtgcctaattctaactattgtacttgtacaacaatacaacatatacaattcaataaagtgtaacaataaaagatcagttgataagttatagtgagattgggggatcataggagtatggtccttcacagtttgcttagctttctgtacatcctacctgttcatttgacaagttgcgctgtcattgttatgaactggtttcaaatcagtagatatattacatattttcatcattataacttataaatcaacctggcaacattttgcagtggtcttacatgtaaatccaatgattgaaaatagtgggtccgccgtatttaacgtaaaatcaatggttagatatatattttagtattattggaaattcatctaatttatttgagcaacttatgagcgtcatttggtgatttagaagcgtttgtagaaatcatacgtggtggtttgagagtgtttgtagaaagtttaatggactttactatacaatagatagatgatcatgtcaattaattactaatattgaccaacttaccagccaaattttcaccctattaattgtccggagtattagatgataaataattgaaaattgagttatatttgctacttcatatttactctctgattccattgcaaattatcaccatatcctttttgtcaatcatcatgtcctcccgttgatccttagatttctctcttgcaactacttcgtcagttcgtctcagttattgaatgatgtgctggaaatgagatacgacagttatagcttgatttggtcaaatatgagcaaagcttgctaaatcatgtttccgttaggactgtagttggattacggattcatcatggtcacgctaaacaatcacttatttcatccgttttatattgtagtaagtttttttattttttttaagtcaaacttcttaaaaatttgattaaatttatagaatagcaacatttatagcattattttagtcttattaaatctaatattaaatatattttaatagtttctttgtttatgttgaaaatattgttatatttttctataaacttaactaaagttaaagttgtttgacttttaaaaaatcaaagcgacctataaatctttgattttatatgtactagaaaaatgaccgtgccctgtaacaggcgaatgctattttaatcttattattgtcatatggtttagctagaatgaaatttactgtgttaaattcgcttagatgtatatctgttagaaaatcgtaagctgcaattaggaattcgatcgtcccaagttagaatgcgagtttttttaatgagatttcttatacgattctccttttgtatttaaaaaagtgaacgaacttaaaaactgactcaaatacagaattgtgtttctaaaagtgaacgaatttaaaaaccaacttatacacggataacgtaccaaaataccagtaaaaatatcttcaacttttataatagtagagatatacttctgcatcatatcataatgtgattcatatctctgccttccagtctacggcagtaaaagtgaatggaaattactttccaataatcggaggttgcccaccatgatgatgtaggtcactgttgtcagtatgtcgccctgcttttaatcccattcgcttcacaccacacacacagcttagctctcgcccaaaccaaacctcgccatggcgagcgacggcgacgccgccgcgccgctcctcacgccgtccggcgacaacgacgacgagccccggcgccgccgcaacatgttcgccttcggctgcgccacgctcgcctccatgaccaccatcctcatgggctacagtacgtgcactcatcgagttcttggcaacacatccatggaggtagttcgatcgtgttgtgtgtgcttgcagatctcgcgctgatgagcggcgcgcagctgttcgtccgggaggacatggggctgagcgacgccgagatcgaggtgctcgccgggtccatgaacgtgttcatgctggcgtccatcctcgccgccggctgggcggcggacacgctgggccgccgcggcacgatcgtgctggcgaacgcgttcctcatggccggcgcgctcgccatgtcgctcggcgccacctacgccgcgctcatggcggcgcggttcgtgaccagcgtcggcgtcgggttcgcccgcgtcgtcgcgcccgtgtacaacgccgagatctcgccggcgtcgactcgcggcgtcttgacctcgttgcttgacgtacgtatatatgcgtccgtcgatctggccatgtagaatctgtcgtcgtccttccagtgtcgaacaccttgttaggcctccattgatcgatctcgctctcgcctcgtgcagatgttcatcaacgtcggcatcctgctcagctacgtgtcgaactacgccttcgccggcctgccggtgcacctcggctggcgcgtcatgttcgccatcggagcggtcccgcccgtgttcctcgccgcggccgtgctcgccatgccggagtcgccgcgctggctcgccatgcgcggtcgccacgccgacgcgcgcgtcgtgctcgcacgcacctccgactccgccgaggaggccgacctccgcctcgaggagatcaagcacgccgtcgcggagccgcacgatgcgggcggcggcgtgtggcgggagctgctcttccggccgtcggccatggtccggcgcatcctcgccaccgtcatcgggttacagttcttccagcaagcgtccggcatcgacgccatcgtgctgtacagcccgctggtgttcaagaaggcaggcatggcgtcgaacacctccgtcctgggcgccaccatcgccatcggcgtcgtcaagacgtgcttcatcctcgtcgccacgctcctctccgaccgcctcggccgccgcccgctcctgctcgccagcacgggcggcatggccgtcaccctgacctcgctcgccctcacgctccgcgtcgcgtcgccgccgtccacggcgagctccgcggcgtgcgtggcgtccgtggtggcgttcgtggcggcgttctccgtcgggctcgggccgacgacggcgacgtacacggcggaggtgatgccgctgcggctgcgcgcgcagggcacggggctcggcgtggcggtgaaccggctggcatgcggcgcggtgaccatgacgttcatatcgctcgccgacgggatcaccatggccgggtgcttcttcctctacgccggcgtggcggcggcggcgtgcgtgttcgtctacgtgtggctgccggagacgagggggagaagcttggagaacatggacatggtcttctccaagtgattgagctcttgctttttgcaccaaaatttttttagacaaaactcaatttgtctccaaatgatttgaggtctcatatgaagcaaacattatttcagcaaataaaagaaaaatccaggtagcagaagactctgaagaatgatgtattagctttgcttttattatctaaaaaaaaattagctttgcttttaggtagcagaagactctgaagaatgactctcacagtcatatttgtttttttttaacttatagaagttaaatttaaacttgtatgtttatggagtggtatcacatactaatctatattgtcatttttttgaatttttttcataattatttggattacatgtaaagaacgagaggatgtcctctcgagggattaaaagagtttgcccatactgttctactccctccggttccataattctttacgttctagacagtgacacagttttcaaaatatatctttgactatgttttttattataatatataattaataaataaatattttttattatagtgctttaaagataaatctatatatggttgtcctcaaccttatttaaaactaacttgagggagtaacatttaggaaccaaaatatttttttgccccccaaacttttagatatgtggccattgccttgttatccaagcaagaatggcctcgagattcatgcaagaagcgaaaaaaaaaatcaaatcgaccatgtgcaagtaggagtcaagctccaaaccacttgtatggagattacgttgctagccaaccaaaaaacagagtagttttgactatagaatacaagttatatagtagtagttgtaatgtaattatactgttacatttatttttcacctaaaaactatcgaatattatatcgaatattatatagctacttcctatgggactagctgtatctatggcatattttccacgaaaaacagtcaattgttttctcataatatattagattcagttacactttaattacattacattataatttctgaaacttccacaacaatatccattacttacatccattacttacgttgtaatttttctagtacgcagttattgaaaaatgagatattaataaacctatttactctcttcctcttttaatatataatgttgttgacttgtttgacgttttatcttattaaaaaattatataattaccatttactttgttgtaatttgttctatcattaaaaaatactttaagtatatttttcatatttgcgtaatttttttgtcaaacatatgtaaaaaatcaattatgccatataaaagagaagtagcaatcacatttggaaataattaaccaaaatcaagttcacatttttagcataccactaaaatcatctaagagcgttggctggtgcagggccagagtaccctagccagccatttgatgttcttcaagccaccatagtccaatattcacacttttggttgttcagtttgtcaccacttttgactttattaaattttacattataaagttttagtaagataataaactaaacatttctcctctcattgacaccctataaaaattgtcatttctgacaattccctcttataaaaaataccaaatttgggtaagactacaaactaaacaaaccgcatgctatagatatttgtaacgctaaaatgtgacaaatttttgataagattgattttgacactaaactagataaacccgtgtttccttagctatcgcaacctccacgattttattagctagcgtgtgtgtgttctaggctataaaaaatttctggatctactgctgtatataataattgggctaaccattttactgagatgggtaaagtttgaggtttgacatggagcacggtggttaaatgaggcttcgtccagagtgtgggagaacgtccttttatgactcgtgtaactcgtgttaggtgatactaataacttgtgatgatctgattttcttattattttttgagatatggaagaatggaaaatgattaattgtgatcatgagctgatgaacgaacaaacaaagcctagtcactcatcaaatacaccaaatctttggaaacgaaaacaaaagttagggggtgtttagatccacgggtgtaaagttttggcgtgtcacatcggatatacggacacgcatttaaagtattaaacgtagtctaataacaaaacaaattacagaatccgcatgtaaactgcgagatgaatttattaagcctaattaatccatcattagcaaatatttattgtagcaccacattattagatcatgaagcaattaggattaaaagattcatctcgcaaattagtcgcaatctgtgtaattagttttgtttttagcctatatttaatatttcatgtatgtgttcaaacgttcgatttgataaggtaaaaatttttagggtaggatttaaacaggactcctagctaatattgctgggaaccaaccaccgatgtaactgcttagacccagtttagttctccaaaaacttttcgcaaaaacatcacatcgaatctttcacacatgtatggagcattaaatatagataaaaagataaactaattgcacagtttgcatgtaaatcgcgagacaaatcttttgagcctaattagttcatgattagccataagtgctacagtaacctacatgtgttaatgacggcttaattaggctcaaaagattcgtctcgcggtttccaggcgagttatgaaattagttttttcattcgtgtccgaaaaccccttccgacatctggtcaaacgtccgatgtgacacccaaaaattttcatttcaccaactaacatgcccttattaactcttatacgcctcaacctcagggatcggagatacaagagtctgacggctcatcaatcatgctcatcgtcttggttccacatagatacaatagttacctaaaaatatatactgcattattgatacttggttccacatatcatacgcacattgtatcttgtagttcgtgctagctgcagctgactataaatctgtagcccactgttcatatatctagtcttttatcttctcgatatatgtttacagctgttttatattctgctattttacatgcttgcaatatgcgaatagccaaatacaatgtggacgatctgttgcagcatatgtatgcatctctgttcatctactactatatttaatatttattgttgtttgctgttgtaggcaactttggagacatgattaattctctgactcatatatagacatgtacgtatgacacagttagtacagccactgttactaaacaatactccctccgtcccaaaaaaaggacaaacggtttccgtacccaatttttgaccgtccgtcttatttgaaaaaattaagaaaaaaaaaagacaagtcacgcacaaagtattaatcatgttttatcatctaaccacaataaaaatacgaattataaaaaaatttcatataagacggacagacaaagttggacacgtaaatctagggtttgcctttttttttaggacggagggagtactattaattatctatgtctgtagtttttcttcttcttttttattcgtgtgtccaccggagtttatgtgtgcaaaaacaacacacacaataaacattctcaaatttaatgtggtaccaaagatgtagtagtaagatacacatcttattattgtttctaaaaatggtccgcccatgtcgatgcgcctaattaatacactatctaattttgaggttatactagaccatcttcagtcataggatccccattttaaagcctgtaaaactaagggtatctatgtttatgatcacgggtagcattgaggtgacctcttcttatgcaatgtggcgaattctaacccttgactgtggatatgcatgacacttctattttaccactacatgttagataaggggcaaaatttgctaaattaaaccacacatatgattttatatgacatgattatttatgtacggttagatgcacctttgcacatgtcatgttacatatgcacctttgtacttgctccatcttataaaaaataaatctagaataggatgtgaaacatactttaatactataaatctggataaagaatttatcgatattcgttgtagtaaaatatatcgtatctggtcttagttttgtttttttagggacggagggagtatatatcacgaattttttttagtcttttttatttttattaatagatcattcaaaaagtattttcgaaatctaaatcttttggccacgcaagaggctggcgtggccaaataacgctaccacgctaactgcgcgtggcgtgacagagttatttggccaggtttacatctgtaaatactttttagaatggtctattaataaaattaaaaataaaaagtctaaaaaataaaaaaaaatcatatatcacctgcattcgacacagttgcaacatgacctatgggaagtaaatgtgaaatcaatttaatccgacacacctacaacttgctctgagtggttagtccaagacttaaaccccatgctagctaggctccagtatgaaaccttaagcaagccatggcgcacgacggcgccgccgccgccgctacgctcctcgcatcgtccggcgacaacgacgacaagccccgacgccgccgcaacatgtacgccttcggctgcgccaccctcgcctccatgaccaccatcctcatgggctacagtacgtgcactcatcgatgttcttggcaatggttagagcttcttggcaacacatccatggaggtagttcgtgttgtgtgcttgcagatctcgcgctgatgagcggcgggcagctgttcgtccgggaggacatggcgctgagagacgccgagatcgaggtgctgacgggttcgatgaacgtgttcatgctcgtgtctatcctcgccgccggctgggcggctgatgttctcggccgccgcggcacgctcgtgctggcgaacgcgttcctcatggccggcgcactcgccatgtcgctcggcgccacctacgccgcactcatggcggcgcgcttcgtcaccagcgtcggcgtcgggttctccctcgtcgtcgcgcccgtttacaacgccgagatttcgccggcgtccgcccgcggcgtcgtgtccacgctgttcgagatgttcgtcaacgttgggatcctgctcggctacgtgtcgaactacgccctgtccggcctgcccgcgtgcacctcggctggcgcgtcatgttcggcgtcggcgcggtccctccagtgctcctcgccgcgggcgtgctcgccatgccggagtcgccgcgctggctcgccatgcgcggtcgccacgccgacgcgcgcgcggtgctcgtgcgcacctccgactccgtcgaggaggccgagctccgcctcgaggagatcaagcacgccgccgaggcgccaccgcaggaggatggcggcggcgtgtggcgggagctgctcttgcggccgacggcgatggtccgccggatcctcacgtgcgtggtcggcctacagttcttccagcaagcgtcgggcgtcaacgtggtcgtgctctacagcccggtggtgttcaagaaggccggcatggcgtcgaacacctccgtcctgggcgccaccgtcgccgtcggggtcgccaagacgtgctccatcctcgtcgccacgctcttctccgaccgcctcggctgccgcccgctcctgctggccagcacgggcggcatggccgtcaccctgacctcgctcgccctcacgctccgcgtcgcgccgccgtccgcggcgagcgccgcggcgtgcgtggcgtcagtggtggcgttcgtcgcggcgttctcggcggggctcgggccgatgacggcggcgtacaccgcggaggtgttgccgctgcggctgcgcgcgcagggcgcgagcctcggcatcgtcgtgaaccggctgacgtgcggcgtgatgagcatgacgttcatctcggtcgccggcgggatcaccatggtcgggttcttcttcctctacgccggcgtggcggcggcggcgtgcgtgttcgtgcacgcgcggctgccggagacgcgagggcgaagcttggaggacatggacgcgctgttccacaagtgatcgtgtcggacgactcgttgtgaacaccatttgatctcggtttgaaatctcgttcgaatatttaacatcaattcgtttggaaacaacaacactcgcatgaccgatttgaacataatcgtgaatattgttatgtatatgggccgtatgagtcaggcctttaccgggccgcgttgcagccgagtggcctaaattgtggccttgtgtgggattcgaacccaaatacgcatcgaattctggacttctattggatactctgatgcggaaacgcaaaaatcaaaacgaaacccgatgttttttttttctcttgaacaaagcacgaattcaaccgacttaaactcaaaacacgacttcgcgacggttgcagacgccgccaccgccaccgcctccaaaaaccgacgtggctctcacccgagtcccgggccccacacgtcagtgtcctttctctatataaaccgacccgttcccctcgcgtgctctcccacctcgcgcccgccgcctccaccgctcgagccaccgaaccctagaaatcccgccgccgccgcccgcccactccgtcgcgccgatggcggagcacgaggagcagccctacgagggcaacgggaacggcggcgacccggcccccgcctccgcgtacgctgagtaccctgcgcccgaggggtccccgcccgccgccgccgccaagcccaccggcttctccgatggcgccaccgacggcggccgttctcaggtgcgcgcgtcgcggatctgtagggggggaatttggcccatgttttgggatggggggcggtttggttttgggattgtttcatgggttgggtgcaaggggatttcatctggttgcctgagatttagggatttaggtggtttactttgcttgcaatgttatgctctccaaatcgatggaactattaggttgttaggttgattgtaattgctttgtgctgttttaatttcctctggagaccacgattcaaataaaacatagaactaggaaatttttaggcgattttcggattagatctgtttgaatttaattgttgtgcaaatttcaacattcaccttatgctgattgtatcaccttggactcttagagagtagtttctggtcgttgacagcttattggggctaaacaataattgaatcttctcttttgaagataagaggactgactgataactcttgttcttttattcagcacgagacacagccacatgatggcaggtcctcaaagtctagagagagggaaagagaacgggacaaggacaaggaacgcgacagagaccgtgatagagaccgaagggaccgcgaccgtggtgacaaggacagggaccgtgatcgccacagggagcaccgcgatagaagcgaaagaagggaacaccacgatcgtgaacgttctgatgaccgtgatcgacgccggggccatgattctgaaaggtacaggttatttttccgtatgttaatggatatgctatgattcctctgccatttgtttgcttcatgccacgttttattgtgggaatctgatttacactttattaatgcaggagaagagaccgtgacagagatggtcaccgcaggcatcgatctcgctcccgctccccttcaaagggtcgtgatcgcagatctagatctcgctcacgctctcgatctaggtatgtgattgaatgcccttgtatgcttattatatgcattggttcctgatgttgatgatgggccaagtttgcctgttcttattagcttacaaaagtcacatgttcttttgatacctcttaagtcttaacagtgatgcaattttcagaatgttagtaacttagtatttcttcttatcttcaaaagattgacactcttaaaacatgcagtgaactgtgtttcttttcaattttttttcaatggtacattcatatgtctttactagtttacttaatgtaatccatttatgcgcttgattttgttctttgtcatgtaccttcttaggtggctttaattctatttgcttatgtaattcttttggtctagttattaatttggcttttgttaaaacagcaagcgcgtgagtggatttgaccagggaccacaagcagccattcctgcgcttgctgctggagcagccccaggtatgttagcacccaatataatttgagagtttattttgctctgctgaatttatctatttatacttgaaactaccacaaattgctgtagctttatcattaacttgtctacatcacaaaacataaggctcaagtaacattaatgcaaagaccaagaaagagttattagcacctccttgtttggatcgccccaataaatacaatacatgcacccaatgagatgagagatcttgaagatggatgattttaaaaaaatggttttagggtagggagaggtgctagttaattgcatgcatacgtgccctgaattatgaagcctcggaaaaaaaattagttgctccaatattttgggatggagggagtgacaaccaagttttttcaactagttgaccttgtaactcctttggtcctttttttattttcagcaatgctagcacttataaattacgaacatctctagttcccaatgaagtacatattcaaaatttctatatttgttttgcctgagggtcgagaaaagactatttactggtctctttctgacactgctgtcttaccactggatgccttgaaggcatggtaatcattattttgtacttatatagttgatatttcatgtagaaaattaattttattttatcataactggtttggaactaagtgattttctctttttttgttggtgtttgtttgttttgtgtgcatatcggtaggaaagcaatcttgggccactttgtccaactgctgcaatgggagacactgtagcttaattgtacgaggaggaaacaatctggtttgatatcctgttcgtcttccaatagcagctagtattacattatgttagtttaataattgttaacttcagtcctcactgggcaggcagatgccatccattcatctatgttgaattttgaaaaacaggacctatattagattatcagtagtagttgggttgttctaaatggttttgttaatgatagatcacaagtaaaaacattgattatttttctgatgaattctttgctggtatttgcaggtcaggtacctgttgtggcccctgctatttctgggatgcttccgaacatgttcaatttgactcaaaccccggtgagtattatgttgttttgaactttaggaatgaaccccctgtgagctatgatacttcagttatttgttataaagacacagtcctaattttctcttgtttttgtatcagttcactccgcttgttattcagccacaagctatgacacaacaggctactcgacatgctaggcgtgtttatgttggtggacttcctccaactgctaatgagcatgtaagaaatcatcctcttttctccacatttctcactttctgtggcttgtacttttgtgtgttttatactgatgtctggtcttcttttacagactgttgctgtatacttcaatcaagttatggctgctgttggtggaaatacagctggtccaggtgatgctgttcttaatgtctacataaaccatgataagaaatttgcatttgtggagatgaggtctgtggaggaagcaagcaatgcaatggccttggatggtataatgtttgagggagcacctgtgaaggttagaaggccaacagactataatccttccctagcagctgcattgggtccaagccagccaaaccccaacctcaatcttgctgctgttggcttaacacctggctcagctggaggtttagaaggtcctgaccgcatttttgtgggtgggctgccctattacttcacagaagctcaagtcagggagttgctcgaatcctttggacctctgcgtggttttgatcttgtgaaggacagagaaactggaaactcgaagggctatgctttctgtgtataccaggatcttaatgtcacggacattgcctgtgctgctcttaatggtatcaagatgggagacaagaccctcactgttaggcgagctaaccaaggagcttctcaacctaggccagagcaagaaagcatgctcctgcatgtacaacaacaggcgcaaatgcaggtatgtgctgtgttcttaaacacattattttacggagcacaaatcagtttaaacactagccttccaatttctgactgttgtttcttggacagaaactcatgttccaagttggagggggagcactgcctacaaaggtggtatgcctgacccaagtggtttcaccagatgaactgagggatgatgaggagtatgaggacatcgtgcaagacatgagggaagaagggtgcagatacggtaagcaacaatgaactcgcacattctcgcttcctgtgcaccaatcactctgattcagtttcataattgatttttgcctttgctcagttactgaactagtttccttttgtgtgtttgtctttttgtgtgtcttttttgtagtcccacatagtgccattgcagagtcttttatagtccgaccttatgcaatattggcagtcgggcatagcctacagaagacacacaattccaattttactttgctttatcagctttatgattatgatataatatgatgccatgcttttttctatttgtctatgttctcactgacgcttgttcaggtaacctggtgaaagttgtgatcccgcgacctgatcccagcggtgctcctgttgctggagttgggagggtgagtgctcctcttgctcttttgccaatttaatacaaataataacatcatgggttatgaattttgaaactgttctgaagcatgagagtgcattgcaggtgtttttggaatttgcagatgtagagagctcgaccaaggcgaagaatgggatgcacgggaggaagtttgccaacaaccaggtggtggctgtcttctaccctgaggacaagttcgctgaagggcaatacgacggttgaacatcgaagtcgccctcttattgtttctaacgcctataaggcggaatctatttacgtttaccttagttttgcaatttttacatctagttttttttttctgtgttagttgaaattttattagtagtccagagattggtgcagaatcatgtgtactttgggtatgttcttatggttctgacttgaaaagcaatagtggctggttgtgcctacgttctgtatttctggtcatgaagcaggccatggcaacattcgatcgtgcgtgttgtcagccgtgtctaattcattcggtcgcgacccgggcgccttgccaacgtgaaaagacaaaaaaaaaaaatccaaattggagaacatttatgacatattagcccagggcttccatgcgggctttgtctgttttcttttctcaggctttgggccgaacaaacaaagccttacccgaacccaacaaaaaatatttacatacataaaaagtttgtacatagaaactttatgtataaaacttaattttagatacattgaaatttctattgaaattcttgctaaaatttaatattttccattgtgttttctttttccacgtgtggagctcaagccaagctatgtcccgcatgcagggtttcccttaccggcggtaaccgcggttaccgggcttaccgcgggggtacggtaatataaataccgcggtaacctccttaaattcaaataaatttaaaaaataatttaaatttttgataaattttgcacagtttctcgcagtttttcacggttaccgcggtaaccgcgcggtaaccgtgcttaccgccggggcgtggtaaccccggccccggcggtttgggaaaccctgcccgcatgtggctccagggttcatggttataatcggtacattaaaaccaacagatacttagcaacatacctttaatttgttcttaggctaaatattgaagcacatttctaatgctgctcaataacgatgtattcctaatgccgctcaatcctactgtgacatggcttacaattcttgcgatatgctgatagttttatggtaaactaggagatgagaaggaaaatatgcaagcgggctagtaggaagaaaaatatggacacagaaatagcattgacaatcctggttaactaagagcaattcgatactaggaacacttaaatgcttgcttgtaggacaccacggacacatattgatggcctggtgcaatttcaccggatcatctgactatatgagaaccaggaatcagatgctcccaggattaatgagcatttgctttacctccagtgaagtgttctattcctcatgccacacattcctattgcgatgttcatgctttgaggttgaacttgcaaagaaagatagataaatacacaactgtgtatacaagaaccaccatgttaacaaatgtattatatatagtccagagaagagtaataattggtacagtctagtagctgtgtgatgttctcttacaacttaatagctaagtacatgggtgtgtacaagttcagcaggttcacgttctgcaaaagaaaaaaaaaagggactgtctactcatcatttggtagaaaaccctcctaatatcttgcaaatttttgaccattggattgatttgagattcgtgcaaaccccaacaaaccctaaccacttttccttcccctcctcccagccgccgcaaaaattgctcgatcctcctctcgacaccgcacgcattctgcgccgccgccgccgccgccccaccatgccgccaccccggctggccaaaaggtgtcaacggcg

SEQ ID NO: 73795 - DNA, 9246 bp, Oryza sativa
ggggttaggccacgtgggtgatcgtgtctgcctcaagtctctaagtcatgatactcccggtcccatgtcaccgacagaatatatatcaaatcagtaattaaatatattttcataataaatttgtcttgggttgaaaatattattacttttttttataaatttggtcaaataaacttaaaacagtttgactttaacctaagtcaaaacatcctataacttgaaacggagggagtactcctactccactaatatactccttacgtcctaaaatataagcattaagatctcggcatgatcttcaagatgcttatgcttctttgaccaacaatatctacaaaagtaaaatgttttaaataaagagagttcatattatgatagttcgtttaatgataaatatgataacatcaaatttacatgattaatctttttaattttttttattaatagttaaaattttaaaagtttgatttataccatactaaaaatacttatattttggaacgaggacgggggagtacgcacttgatggagctgtacgtgcttcgagcggctatgaagacgtaatattatttgctccgatcttaaataacaaatattaaataagatatcattaaactcttgaaacattaactactacttttcatataatgaaaggttaatatagtgatactacttacgttttaaggtaaaatatacgtatgtaattatttttgtcaactatgaatttgagaagttactgccgatcaacgttttaaattttgaacaaattttgtcctaaacttaaatatttataaacaaagggagtatatttaattaaaagataagtccatttgatcctaattactacacttgtctaaaatacacctttcaactttaaaaccgataccccttctcgtcaaatttcaaaaccatttattttattccctcaattaaatcctgatgtttcttttgagaggcactcaagtcgggttccactgagcgatttattttttcttaaaaagaatgtgtgcctcacatggacagaaaccggctagcgcctagcctctctttctctccgacctgtatgtaccattgaaaaagttcactttgactctcttttaacttgatcaaatctgattcatatccattaaccataaaactggatatgacgacttctctaactattgaaaccgtcaaaaacgatgggaggccacttcgctgttggcgctggtgcggaaagggctgggatgggagagagagagaggagaaccacttcaccgctccccgtcatcatcctgacaccctgttgcgcttacgccgagaagaagaaagagggagagagggggagagagagaagagggagagaggttactagagagaagggatgacaggtacaagaaaacaccatatttatatggacttagtgcttctttaatcatttgtatttagaattttttgttagttagtgtttattattatgtttatatatggtaaaatggtaaatttgaaattataaaggtgaaataaacatgttaaggagtcagctcgtgagccaagcctagttaggcttttagctcattaaggttaatgaggtgaggttgttactgttatagataagacatacctaatatttttatgttagacttagcaggacccaccgtatattaagtcttgtacagaatcaagcctcacacatgtaagatgttttaaataaggaaagagaagcagagtcctacttaggcatgacaaggactactcggatcgtacttggcaccctagttatgattggacaaggggacacctaatgatataaatacaaaacgccacaggtgaagaggagagatgtgaagacatgccaatacagatttagacaattcaaggaaagcctagacaaacctaatatggagtcatagaggtcaacgagagggatctaggcgacctccaatctcaccaagttcatattcgaggaagcgtactatactagctgtcgaccacatgtgagagctctatgccgctaagctgaccaagactagattagattatcccaaatttagtactcgtgtgatactgatatatataaaggcaacactgacttcagccaataggaatagggctattaggggacccgaacctatataaaaacttgtccatatcggacacgacttaaactttacaaaaataaacacaccagcccattacgaactctaacatagatttctaaaactcataaaagaaaactgactcttatcctaattaatagatacgattgtctaaaacaaactccttgtttggcaatatctttaaatccttgatccgagctcgacttatagtcggaaactgtctgtatctgctatcttttccatatcggctaaccgagtctaattttgtatcgatcgatacggctctcagccgatgcgctgcattggccttggaaaccaaattaactccttcaaatccgctgttaacaggaggctgcgcgaggagatgggaggtgcgcagagaggagcggcggcggtcggtagggatatgtgccggcgaccacgccccacctgccaggatcatccaccgcgctggcgtcgcgccctccatgctgccaccactcctccactccatcgagcagcagtggaggcacgagaggaatacaagtgtcgaaacatgatttcggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcagtttgtctcatatgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattccatagatataagttatcccctatgactagtcggataaccatgccgtatgggtatggggtacccataatatccacagtagcccctgagaccttcgtagtcgaaaagataatcttctctcgaatcagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaaccctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaagaccacaatatatagtcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctataagaacgtgacaggccacacctgaaaatatgggctgcagacatattaggcctaggccaaaaaatatgccttcgacaccctttaaaggatgacgcatgtaacatgcttccgagtaataaatttggaacgggtgatatagaccaagtatagctcatatcaatcgcttctgatctgagtgattatcccttatgggatactccaaaatagatgtaacaattgaatcccgactggcgcaagtattcagttgataacccttacggggaataataaatagtccagtctttgagcatagaaaatagacccataatcacgaattcatattgcatatatccagagcaagtccaaattgaaggtatgatacttgtgtctgagctagtaagcccctgagcacgtagtcacaattgttcattgatggtagctgacgcaattggcatagagacaagacgacaaatacagagataatattgaccagcagaggtggcaaaaatattggtggtagtgaagatagtggtaccaatcaaaagtgatgaagttgcacagccgtggaggcgaagaaaccagtcggcagcagtcagatcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaagtgctggtgatgatgtcagtgacaatagtccatcaaattaatgttatagctattgtagatgcttcacttggaggagagttgatgttgttgtccaactcgtccaaaccaaaatatttcaagttgttgaagtagaatgtctgctctgaatcaaagatgaagataatgactcctggagttgactcgttggttgatgaattaatttcttcagcttgacataaaatttgtcaaattttgagccttgtatttgtgtagcccccgactctttgattagttgggaaacaactgaacatagagtcgagaactgtagcatcttgtcgtcgaatagttattgcttgatttaagatatgtgttgaagatgtccaagtagaaatcatgaatgttggagagccacttgttgtagtaaaataacacggcatcgcctgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagcgaagacgcgcagttgtgaagataaaagcaccagtcggcggcggcataatcagtcggcgacggaagatgatgatgtccatcagtagtggtagctgtataaaccagatgtagaggcgaggacactagtcagcagcagacgagacgaccagcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttagaacaggccagccgtgcaggcggtgataccagtcagcggcggatgcggcggccggtcggtgaagacgtagacgcccaacaacggcagcataataggctagccgtgcaggcggaaacaccagtcgacggcgggcgaggcggccggtcggtgaagacgtagacgcccaacaacggcagcataataggccagccgtgcaggcggaaacaccagtcggcggcgggcgaggcggccggtcggtgaagacgtagacgcccaacaacggcggcataataggccagccgtgcaggcggaaacaccagtcggcggcgggcgaggcggccggtcggtgaagacgtagacgcccaacaacggcggcataataggccagccgtgcaggcggagacaccagtcggcggcgggcgaggcggccggtcggtgaagacgtagacgcccaacaacggcggcataataggccagccgtgcaggcggaaacaccagtcggcggcgggcgaggcaagccggtcggtgaagacgtagacgcccaacaacggcagcataataggccagccgtgcaggcggagacaccagtcggcggcgggcgaggcggccggtcggtgaagacgtagacgcccaacaacggcggcataataggccagccgtgcaggcggaagcaccagtcggcggcggcgaaggcaagccggtcggtgaagacgtagacgcccaacaacggcggcataaaggccagccgtgcaggcggaaacaccagtcggcggcggcaaaggcaagccggtcggtgaagacgtagacgcccaacaacggcggcataaaggccagccatgcaggcggaaacaccattcggcggcggcgaaggcaagccggtcggtgaagacgtagacgcccaacaacggcggcataaaggccagccgtgcaggcggaagcaccagtcggcggcgggcgaggcggccggtcggtgatgttctgactgatccattcctggagcgtaagagataagcttaaagccatgaatcccttttatgcatatctggatctggatcctgcagaacaaacatataggatgagtagtatctgatataaatataatacttgagaaaaaatcaagtattttaaaatatttataaatatgtatttctcctcttgtcaattttgatttccccgagcagatgactctgtacatttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatcgaacgagcccccgggtgctaggaatcggcccaaaggcaaccatccaatggcaaaccaaacggaaagcataggaagatagaactccataactcgataggtacttttgtactcagattatgtcgcaagcaatcaagataaatattataaaaaatatgatataacatctatagccctcgactcactactcaatggaagaccaattggtgtagtgaggcagaggaaaaggaaaaatatcatataaagaataaaataaatgatgacttagctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccagtcggcggcgacggaggcaggccggcggtgaagtcgtagacgcccaacaacggtggtgtgaccaaccaaccatataggcaaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcggggattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatggtggttggatcgtgcatgtatgttgatcagttgaatcaactcatgcagtgttttctc

SEQ ID NO: 73796 - DNA, 38887 bp, Oryza sativa
tacctgcttccctacagcttaacaagtgcagcaagaggagtcgacggagtcccgggattaggtcctgatctggatggagatgaggcaaggattgactgcagcttcagctctggacttggagcaaatccacaggcgctgcagccacagatcgacgcggcaacatcttcgagtccaccattggagcaaaccctagccacaggagagcagcaatatgaaggggattcgaggggagaaacctacatgggtggatttgaatgatttggagtggggaagaggaagaggctggatggatttgaaggatttggagtggggaagaggaagaggctggatggatttgaaagatttggagtaagaggaagaggaggctggaggggatgagaagaggagaaggattagatagaagtgaagaggcttctggacagggtggtgaatgaagtggttttttctctctctcttttttatgtgtgcccgcaaaacaccaatatttttggcgctctatccatccatctggcgccaaagcgaaaatagctacccacctaactcccaccaaaacctattattttcacttactgctccattcacgtcagaaaaatcgcattattgtgacaggttgtgaatcctcgtcaagaaaattctatttttctgacgttagtacaggctcgtcaggaaaattagatttttcgcgataggagccattgtacacgtcagttaaataattggccgtcaggcctagtccggtttctggtagtgatatactttcataataggattcaagttctcatattaggtgacattaaagaatcatacatacattgtgtgttggcttggacaacacatatgtagtcacgttaaaccattaattagagtaggtacaataatatggactccgatcaatgatgatataaaaaaaaaacccacgtaggctcgaacattaatgacttgacagagtggagggatgattattttacatattgactctaaggttagttgtggatgacgtaaaaacatttagagccaacagtgaatttatctttgcatgcatgcattattgttactaccaatatataaacattaatcagtcttggagagttatatcaactattggcctgctcctaatatgacatgtcctattgacatttattattaccacaattattcacatatactaggctgcacaaccattaacatggttatatcttatatgctttttgtttgttggtctaactcatatccctccatgtttctctatatatataactagaagtacatctaatttttgtcggccacatagagataaaaaagaatatagggaggcgcgagaagagatgcaatcttttgagtgaactactcatgggtccatatccttgttcacatccttaattagttttttcttcaaaaaaaaaaactttcctatttgagggggagggggggactatctggcttgctaatttcgtaagaaagaggcaaattaaccacaccgcttacttccaatataggaatgaggggaatctgtgaaagagcacatagagattattcgactgccaattacgagttcgacaaaagaaggtgatccaatcttgtattgactttcttgttaggcaaattttgctatacaataacgtgactttgtggttttatctctaggacacgtcaaaagtcaatcttcaggggaaatgcactctcaaaaaaatgtggttatttgctaatggacaccgcaaatattaatttccgactgaataggagagataaacagtgtgaaaggtcaaaaatacccttgaacccacttataaaattcttccccaacatctcactctcgaccctcctcgcttgatcctatgactccgccactcgtttctgttcttcagaaacaagtaaaaaagagcatttgactaattctatcatctatagtatgctttcatccatatgtacaagatatattgagcatgccgacaaattttagttcatgtgttaagagtgctctggtctaatatttgatatgcagcagtagaagttagttagggcgttaggctagagcttcaaagaattcgagcatgccaatgatggtatacggccttccttttaagagtttcgacaattaattaatactccctccatccacagaagttacttttgacaccaagaccacggagaaattaaatcaccttggatgttacaaaatcaaggaatgaatgtaagcatgcaaccaatgagtattttagatgactctttgggttctaataaaacatttaatttatctcttcatttaagtcttgaatgtacaaagactataaatatgaataacttatttgaaaaaactcgaatgtgaaataggtgcaacttttgtggatggagggagtatgtcttgtagatgatcgacctggcctgtaaatgctcagacaatattttttttaatttaaaagaaggcaaaatttgctacaggacaccaaaagattgtggcatttgctgtgagacacctgaagattgtgtatttgctcatggacactgaaaaaagtggtaattagctgctggacactcctcccattattttattatttccggtcaaaatggagagagaaactttggttaaagacaagtttgcccatgggcccacttgtcaatctctctttatctgttcttcttcctttctttgtctgttcatctctttctcattgcgccgccgccgagctccgctctggccgagccatcgtgcgtcgtcaccgtcggcagtgaactccggctctagtgtcgaccaaaccgagcatcgtgctcctgctgcaccacctcctcgccgtcgacgatgggagcagatcatcacgtgctctagcctgagaagcttcaacgagctgctcacgggagagctgaacacacggctgcaattgagccccgacgcgtccgtgctgtcgtcattgtcacttcactccccagcagcagtaatggcggcgcacccggcatcgacgtcgacgctcaactactatgcgacgttgttcgacggcctgcagcagagcacgacggcgccggcggagcgcgtgctgctcgggatggagatccgcagcgtggtggcatgcgagggggcggagcgggtggagcggcacgagtgggcgtgacagtggtcagcgcggatggaggcagccgggctggagcgggtggggctgtgctacagtggcaccatggaggcgaggaagctttgccgaccaaacattgcagacctcatccgtgctccaggatgccgccgtgcgtcattgccgtcagcggccccagcgatgcgctgccgccgccgccaccaccccgccgtggccgagccctcctggctcaggccggccgccgacgcgaggagaaatggggaaaagaaaagaagagagagaggaagaacagtacgtgtccaggggcattttggtacttacacagctctttctctctccattttgaccggaaataataaaataataggaggagtgtccaacagctaattaccacttttttacagtgtccacgagtaaatacatgattttcgggtgtctcacagcaaaggccgcaatctttcagtgtcctgtagcaaattttgtcttaaaagaatgacaggaactcaggaattaatggtcgacttatattggttgcctgaccacatatatacaccatttcgctcgctaaagataaattttctatcaattaactgccacagcccacacttcattcgatcttgcaccagcaaattgaggtgtaactaactccaaatttaagaaaggctcatatatatacatgttctagtttcccctgggtactacatttagtagatgcatgtttgctcgatacagactttttaattagtttctaaaagttttttattggtgcaaatttcgtgttacatgttcagcctgttgtaccaaattttattttatttttcaaacagaagggtggcactgggaatgagaggcagatggaaaaatgttggctgatgctgtgacatttagaggagcagcatggcagaaagagtaagtggagtgtgtcgaccaccggccttcagagcagatcagcttgcagaatttgccgcagtagcagctacacgactgcagttcctcgtgcgctctcacatcatatgatgtatcaactgtgatggatgtactttgagtgatggactctccataccacaaggtgacaactagctagctgcatgctggttcgattatgagccctagcaaactgttgatgatcacctctctaattaatctgccgcattagacaggagagaacgtccaatatgatattacatatgtcccaatataagtgcagtcgtggttttcgtgttaaacatttgaccgtttgttatgaaaaaatttaatgaaaaaataaaaaaaatcagtctcacataaagtattattcatgttttatcatgtattaataaaaaaatactaatcataaatttcaaataagataaaaggtcaaacgttggaaacgaaaacccacatctttacttatattggaacggaggcagtaagaataattgtgttgttccgcattaaatatctcaaggaataagttaacaaaattaagaagaatattagttttgttatgttggccgaccatgtttatcctgtgaaccaaagtaatttttgttagcttatttcttcagatattcaatgcggagcaacacaatcaaggactataaaattcctcaaggaatataaaattgctctataaattaagttctattgggtgagcaaagtcaattcactagctcttgaattatacactggcaaagtcagtagtccttccacaaattatatatatatatatatatatatatatatgcaatcattatttcactctaaaatattaactagaaatgattatatatccatatgggtgcaagagagaaaacagtgtaggagctgttgggggaatggctccagatttacggagctagcctccggttcagagccacccctaccctggagaagcaaccaagtcatttgagtctctcggggctgttaaacatccagaggctaatgggcttccagaggcatgatgagcctccggaggacagccagccgccgtagggtcacggagcccctccggaggccacatggtctccagggccccacggagtctctggaggccatcgatccgctggaggccaacaaggactccgaggatatcaagccattaagggccaatcgactttcggcaaacaacggaactccggaggccatcccggactccggagttggttaggatcatggatggccgggaaggccatgtgccagaagccattgtagatccttgaagtgtaatgaggagtaataaatacgcactacatatccaccaaccacctctggcgccatggcagggacgggcttgcataggccactacctgggaaacgcggctttacccgtgcggtggtcagagtttttgggggcgccgctgtaacgctccacttttcgtgagacgttaaaaactaattcggcaaaatcctaattgcgaaaatttttgttctttgtgtgcgagtctaagtcgtgccaagatctcatttcaaatcccgttgttccctctcatcgacatcaaatcctcctcctcaaaatttctcttccagttcaagtctccaaatcaaattccgaaaattcaatccctctctttgaatccttgccaaatatttgccctgactccaaaaataaccaaattcctattttgaactccttcccccaaattcaaattctctccaaatctatctccttaaaaaagtctacttgacctccctatttttggatagaccggttttcctcccctggcccatctcccctcccagcccatcatcttcccccctcgcacgtgcgttgcacgcatgcgagccgagagagagccgtcgctcgctctctctgtttctctcgctctctcgtcttcttcctctctctctctgtttctctctctctctctcgttcgatctctctctctcccatgccagcgctgccgccatcgccgatttttcccgctgccgccattcgattttcggccgtgccgctcgttcccgcgcgcgcgctcgctcgaggccagccgctcggtcgccgccgcgtcagcctgacgccgcccgtgactacgcgtcgcccagccccgcctgtgcgcatgcgtccaagggagggaggcagagccctcggcctcgctccctctccctttcctttatcccgaaacaggaaggagcagagctccctttcttctccacctttttccttttgcccgaccaccatcggcgtcaccgcctgccaccaccttgaccacgccagctcgtcgtccttgcatccttgaccgcctatgtcggttccccctcccaaaccgcctcttctccatctataaagcccaggccgagcctccccatctcattctctctcggcatctctcttccaccgccgccgcgcctttgttgccaccttgcagctgtcgacctcgcctcccttcgccgtcgcgcgtgctggtgaagccggcgtgtgcgcgaggagccgaagaggactccggccacccttcttcttccccttccccagcccaaggccggagaactcgccccgcgccttcgaccgcccatcactgcccgcccggctctatagtgcctcctcccgttccccttcctcgctctccgtcgccccctctagtctgcgtgatagctcagtggcactcccgaacacgcgtagacgccgcccctagacccgccgccgcccagcatggcctcgccgccgttgccgcccgctcccggaggccgccgctcgtcgccagccctccttggtgctcttctgccccatcggacgccggaaacggactccttgaaccccggagatgcttccaccgcctctaattgaatcctcgtcgcccctccgccgtttgccccttttctcaccgccggcgagcgccgccgcgattcgtcgtcgccggtctcccttcggtgaatccgagccggtggcgcactttatctcctccgtctcattattccggtgtgctccctccctctcgaatcgtcgcgacaagctcgggtgaactcgaacgccgtccgccgtccattcgaccgcgccccctttcttcctcctctcgccggcccgcgtggccgctgcgtaggcgccacgtcggtgccaactcggctagaccgagtcaaaccggccagcctcgcttccccctacgtgcgtgcgcagaccacggtgagccatgcggctacacgtgggcccatcgcgcctcgctccacccggcgcacgcgcccaaaccgcgtccaccaaaccctatcgccgcccctcccgtgagcccttccctcagtgaacctagtcaccgacaagcgggccccacccgggaccccgcgaggtgcacccggtccaccggtcggcctccccctcccgcgcgcccctaatgggccgaccacccgcgcccgcgccggcccaatggcctgaccgcgctgcgcatgaccccttgggccgcgcctaagccgcccgagtaagtctaaatgacatccctccttccttttcttttccaaaggatttgataaatccttttcctttagacagaaaatccaaataatcttaggaaatccatatctcctcaaccgctcgtccgattgactccattcctcttccagtaattccgtaaattgagatctatttaatggcactattatttagtctaaatagggtctttttcttggtcttttgtctaggttttcgattgtttgcgtatagttgcggttaccggattttcgtcgatcgtggatttctcgaagattcgagaagctcagtgaagactttgagcaaggcaagtcaccctttgtccaattgctcctataattggaaaatcattattattttgtttgcaacttgcattattagaatcacacacttaatttgcttggcctcggtttgtgtgccaaaccgacggacctacccagtagtcgcactaattcttgtaggctgtactatcctgattccttgtcgctccacccttgtggtacttcggtatccgtgctctctgagcgcgtatacctaatatcccacatacaccgttgattatcgaaaacttgggaaatgggtttgtgaagccttcaaaatctgacatgtggtgtcggtgtgtttgaaaataaaatgaattgtgaaaactcgcgatgcgggggttgtgcctatgtggcactgtcctgtattcgcatataaggaccgattcctgtgggaaactcatcgaacataatcaaagtgcaaccacaagatggaatgggacaccctggctaagtaactagtcggttcagggaaacctcgcatgccaatagttgggaacgccggggcggggtcaggacaaaccgagttcctggtaaggcaaggacgagaagcttgctctcttaccgatcaaggtggttggagttgatttgtgaatgcctaaaatggtctatatttatctgaggatttgatccttctatgtggcatgaggtaaccctgggtcggcttgggaaaggctttgtcacgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaagagttgttgtggattgggaatcgtaaccagaattagcctatgtggcagatggatgacctgagtggtcagaaacgaatctgtgtgattcgggatgtctgcgggcatcatagactaggctgaccgagtggaagcggattgctttgctgctgggcagctggactctgggagtctgcaaaaatgaaaaaggctctggcagccgcctaatcagatgaaaaaggatctgggagccgcttaatcaagtgaaatggctctgggagccgataagtaatgatctgacccgggaggtcggtacattaccatttgagttgttgaaaagcatctcttaagtcgaatcgagacgcaagtctccttttcgacccaaacttaaaaagaaataaatcacttagtgatttcaaaaatgatttcaaacaaaggatttgcaaaacaaccttgtctctcttccaagcttgcattaaacacctaagttcccgtgacttgctgagtacgaaagtactcacccttgctctatataaatatatatagttcctccgtcctgaagctaaagatgaagtgaattgaagaatagggtttcgtcctggttcccagccgtcgcctgtagtgttgggtgttagaccgttggttccgctgttgttgctgttgctggtgtttcctcgtctgtgtcttcgtttgtattctcaggctgtcctgagctgcaacctaagttaaggtaaataagtcctctatttattttaaggatttgcaatgattcatatttgtcaccgtgggtaccagcactatgtcctgggactggtactgtgatcgcggtttcgtaggaagcggttcacgccgtttttcctacgacacgctcctgtcaggtgccgttgtacgagcacagccgtccctgtcacggaggatattactaggagcccgagggctggcccaccgggcagccaccttagattagtccaagagataggggcaaaaatataatttcctcttgtatacctagtataaatgcataacactgctcacgattaagggcagaattcgcgttgaatgcactagttggaatttgtcccaacaggagcagagaattgactagtaaacttggcaagtgagttgctaataatttcacatatatatgaactaatacttagatggctatagctaggagcaatttctaattaacaggttagtacgaagctagtaggtaagggcaaatggaaatgggaggcatctcggagaaatgaaggactatggcacggtcgatgcctcggtggcaaccaactcatagactcttgatgtgtgttgagttatcaggatgcagttgagttggggaaaatgtgcaacttatatctactccctccgtttcgaaatgtttgacaccgttaactttttagcacatgtttgaccgttcgtcttatttaaaaacttttgtgaaatatgtaaaattatatacctacataaaaatatatttaacaatgaatcaaatgataggaaaataattagtaattacttaaattttttgaataaaacgaacggtcaaacatatttaaaaaagtcaacggcgtcaaacatttcgaaatggagggagtagtagagaacctagatccatcaaattttactcccggctaggatgggactctatctgggttggctgaagagaacaaaattagagttagtttagtcttaccaatccaacaggctgatcagcacagtgtttgcactttcgtttttgaataaaatttcacaatttcggggtcccgaaaattcaggatgttcaaaacttttttggacaaaattatttgaaaatttaacattgttataatatccaatattgaacactcaaatgtgctagagtatagtacaattaatacatattgcgttaatcaggcacaactaattaatttgcacggtatgtggcacagggtatttttttacagtgtgctgaagtaccgggtgaattgcaatacacagcatgtaaaatacaagacactcatttttgcaccagagcctctgtaattttttatttattattttttctttggttttcacactgttatactacatcttcctcgaaaaaaagtacactccatctaattgaaatctcgtggaacacgatcgaaatttatgatgtagctttcatgattcaaacctgaagaaagaaaaaggaatgttttttcacataacctattgcaacgtgcgtgatgcatgtcagagcaaaaaaagaagctgatctgcccggttagcagcgctgacatctttcaattatcagtgacaccagatacacctactgatatgcaaaagttgttattgcctctactacaccttctcctttaaatacattttatttattttcgtgcaatgttccattgcattctgagaaattaatatcagaactgtttttgtcatacatacttcctcctttccccctcgtttctcaaattgagcagtgtcatgaatcatgataggaatgggtggcatcaggaacacaacatttacaggatactcgatgtactcgatcgatgcagtccagcaacggtgcgtaaggtagcatgcgaccttgctaattccacccactgtatctctttcgtacggttgaatacactacactcattcaaaatttacaaatttgcagtttttcatgttttgatcatgaaaattaaatctagcataccatccctcgatgctcgagaagtttttgatgcaaactgttcagataaaaaatggttgcgtgggtagattgggccaatttgatccctttgtaactacatctgtacatgtacatgcatggacagaacatcactatgtgattctccttagttataaagttatcagtcccatttttccattaatttgcattaaacaagcttcaagaaaacacctgctctgattagctatagcttctttcaattatgagtgacaccagacacacctactggtattcaaaaaatgttattgcctccactagctaccttctcctttaactattttatatattttcccccaacgttccatttcattctggtcttccatatcttctatctttttaggcagtgagaaataacctcatgttcctatcttacttcaaccctttgtcacttagttcctctgatgttgatcagtgtcaggataagaatgagaggcatcagcaacacatcatttacaacatcattcacagactctgtcgacgcagtagtctagctaccaacaattcatgcactgctggggaactcatcttttagtcatgtttgtaaccccctttagtcctgggttgtaaactgggaccccgataccgggatgtctcagttgaaataaccgggactaaagattcatttttagtcccgattggtgttaccaactaggttttttctttttttttatttttattttactgcttgcatattgatttccccaaatcaagtgctcgctacataacaaatcacagattcatagatcaaatacatcacaaattctaaaaaaaaatacatcacatatcaaatacattgcaaattctcaaaaaaaatcatcacaaattctcaaaaaataaattcttcccccgcatgttgcatggccgcatcgtcaccatcaagctcccgtcgctccaccgctgccgcccgaccgcggccatcaccgctgcttctcccggccggctgctgtgggagagagagatatgcgagagaggcgagaagaccagagcgagcgagagaggaatttcatttattcgacgtgtgtggagatcaatagaggacaaggacgtgggagagagatatttagtcccgaaatatatgatctttagtcccggttggtgataccaaccaggactaaagattgttggggggcttgacacgggctgacagctattgaatcgggactaacaatgatctttagtcttggttggtaacagcaaccgggattaaagattataaagtgccattgagcttttgaactggcgctatagatattcgaaccgggactaatgtgatatcccttctccagtagtgttggtattaggtattccaattttgttttgggccaaaatgattttgaggcactgaaatttctgaaatttactctttttttgcacgaaattatttgaaaatttgactatatttaaataaactttgatcaaatccacaaaaagttgggaaaaaaaaccctgaaagtttcagccagtatattttgccagaatggggcgaaattaccaaaccgaaaatgtaaaccatcctcgatcctcagtatagaatgcttacatccctgtcccacccagtctaaggcatgaactcgaatgacccttaacgcggcaccatcatcatatttcctatggcagcatgccccaacactgccaaattcatatgggaattaaactagcagggagtaggcaactcgattttttgatggcattggtacagcgcagtgccagtgttggtaactatcgcggtggatatctactacactgcgtatgtttgcaaccaccttgctgcgagtatgctaatccacggagatggctcaattggactgcggaagcgcactggagacagcatcggcgcctgccgatgaagagatagtactatatatgatacttacacacctttctcgagttcgctggttcgattaataataactacagatcaaaaatctctaggcaatgggaattaattatgtaaggaacttacaagtttgcaatggtacataccgcaatcttcttcaatgatcacaaatcttgcaaagatctaagcattgaaattccacgtacatgtgagagaggcatcaaaagtgcagctagctaggttaattattagtgaaagggtatgtagtctaatagttacagtaacttgagtagtatccaaggtgttgagttcaaatctctataggagcgaatttcagattgggttatttgaggagctaagttcccaacttaaaaatgagttcaaatctccatagaagcgactttcagattggattgtttgagaggctaagctccccaacttaaaaatgctgcatgtatccagttagatgcagagaccagattaattaggttgcctacaaactgtcaaggttaatgcttcagcttcactttgtcataatggtcattatggttttgaacatgcaaatactgccaactagtacttccacatgcaaaaatcaatgtgtgatatcactaatttaccccttgtactcccaacatttccatttgcctccagtcaaaaaaaaaaacatttccatttgcccaacatggtcctgtgtatcaatgataagcccctatatccatttggtgcaatagaagaaaatattttttttctatgtgaaatagcacgagaggcttctattacaccatattataaaaaaaaataggaacagggctagagcagaagattggctagtgaactttgccaagtgactttctaataattttgctagctatatatatgctgaagtaatgtagattgctagctaggagcatccatgtttaattatgtacgaatttctaatggacatgagaggtatataggaaaaatgaagtaattcgattggtctcttcattgcacactggaggattctggtgaaaccgatggacatgccaaggctgcagtgcttgatctcgtcgttcttgatgagattggaagttttcaccctccaagtccccacgtaggcgatggctgatgctggtcaagctggtgatctgaaggagctagaggaggctggagtggaccgtagtgtttgttccagcccactgtctttgccttggaatacgtatattttgcttctcttatatctttgggctgtgctatatatgactggaataaatctattttatcttcctccactctttgggtcggcgaccgatgggctatggcctataggggcgggggatcgatgttggcctgtggttgtgctgatcgttgggccgtgtcgtgctgggccagcacgtcgtgccgaggaagaggcccaaacacggcttaacagttaggacgggccggcacgagcctgataacagttgggccgtcctgtgcctgggccaggcaagatctccatgccgtggaccgggccatcagactacgggctttttggccaactatactcaggacaatggctcaccatctcaaagaaaaaaaaaagctcatatttgtactgccctgggtactacatatatagtagatgcttgttgcttgacacagaccttttaagttctacaggttctctattggagcaaattaggtcttacatgtccagccctttgtatatcaattttgttcagaaagggaatgacactgagaatgagaggcatctggaaaactataggttgttgccctggagatcatagcagcagcatgtcttacctagtacatgaggtgagtcgatcacagccgttgagagcagatcagtttgcagtgatgggcagtgtggcacccatgacttccattgatcgtgagctctacacatcatatggtgtaacagctgccagcagcgtctccatggacacacagccgagttgagtcatgaaatctcaatgcccggataggaggtgtcagctagcgatctggatcatgatcagccacaacatattgttgttgttgagcactaattaagctgcacaattacacaagagaggatgattggtatgcataactgtgtatactaattgttgataattagcccatgcatgcattcatatggatgcaagagagaaacaggggaggaactgagaatagggtagcgaattttgcaagtgacttgctaaaaatttgctatatcctgaagtaatagtgcttagatgactatgagcatccaggtttaagttggatttactagttaacaagctagtactacctccgtcccaaaataattgcaattctatgttgtttagcatatattaaggtttgagaagaaagactatggtgccactcattaaatggtgtttatgtgagagtgagaagacggttgagggtaaaatagggagaaatttgaatgagatatgattgatggggcaattagtactctagaattataattattttgggacgaattttaaatcctagaaatgcaattattttgggacggaggtaatagttgaaaatgagaggcctataggaaaaatgaagtgccggacaaggtaatatgtccttcaatttcaagacatcttgtaagcaaattaattgtaacaaggttagctgctacaaattaaagcttgacgagtgtacaacttgtttctaccagagcatgcatttagatccatcaaattttattcccggctaggattgtggatcaaattatgtcatcatcagacacactggaaactcaaatgaaaatacacgtgctagactgctagtgtatggtacaattaatacgtattgcagtctatctaggaacataaatatcgcacaactattgcttgctatttaatttgcacggtatatggcacgggatatttttgttgcagtgtgctgaattactgggtgaattgcatgacaggtaaaattcaagaccctcatttgtactagactgcctctgtaaattttttttttttggttttgaccctgttatatagtccttctaaagaaatacagagtataataaagctgtaccaatgctgtatttgtgttttttttacactacatataaagagcaattttatgatccttaaggaggtaccatgaaatactattttttctagagcaattctacagtccttgaggaggtaccatgaggtaagaaccgtagaattgctcacatataaaagcatcagagtagtgcgaagaggagtgctttccttccctcgttcctctctagactctagtgtcgagcagtgtcacgataagaatgagtggcatcagtaacacaacatttacaacatattcccagcagctgatgcagtctagcgacggtgatcactgtagcacgcttgcttacatgatccacccaccatctctctttcctatggctgaaccagaaccggcaactagcaggcggcacgcaggtcgcctttccaccgttgttactgaggcgctatgttaacctgcttcactgatgcaagaaacttgacaaattggcgatgatgcatattgtatttggatgtaggtgggcaaacccgctaccaccccacataaaaattcacttaaaagattttagaattattatataggtggggcaaaaaactcgctttcccgcctccacttggaacctaacactgcactcttctttagtctcgcaaatctttcaatatttaagcatgtgaattaaatccactctatcatctttcaagatatttttaaggggagctttcggtggttgtaattttcaatgatcaatgtttgatccacatgaataaattaaaagccaaaaattaaaggccggaatttcacctccgggaccatccaatcagcccatgaataagataatcgaataatacctactaacaagagatattttataattcttaaaaggcaccaagagatattaaaaacttttagtgtaaatttatgcaccttctagtgctggaggtatcgagggatgccaaattttacactataaaatatggtatgtacctgtcagtacctcctccacaactgtaaaatcactcatataacaaaccatatgtggccaaaaacaacttctcggttgatctacactagctaaattggttgcaacttgcaaaaaaagcaaatacacatgcacgagagctacctaagctagcatgctagtgaacagcccagcaatgaaattttagcttcaattatgcagttagctagctcgatcgtgagaaatagttaagtgactcaccatctcaaaatctagctctatagaaccaattttttttaaaaaaaaagagtaaagtgtacgggcactccttaaacttgtaggggtatgccatctagatccctaaactctcaaaatgcatatttaagtcctaaaatttgtcatagtgtgtcatctagatcccaaatcgccacaaccccttcaggatcctacgtggcgctgatgtgacatgccacacggacatgatgtggcatcattttgactgacaaatgtgacccatttaatatttttccttcttttttttcttctctttgttccctttcttctcttttctctgtgacccgagcagaagaaaggaaaaaaaagaagaatgagaagaaaacgaaaaagaaaaagaaaagaagaagaaaaaagaaaatgacatgtcacgtccatgtggcatgccacatcaacgccacgtaggatcctagaggggatgtgtcgatttgggatctagatggtatactttgacaagttctgtaatttggatatgcattttgagagtttatggacttaaatgacacaatactacaagtttactaaaagaaaatggtacgattggctcagctttttagtaccctgagtacaatatgtcaatatatagtagacacatgtttcagcccgtttgtttacaattttggttatacaacttcttttgaaacaaatttagttctacatattcagcccgtttgtttacattttatttgtaagaaaagaatgacagtactggggaatgagaggcatctggaagaatgcaagccgtgacattggagactagaggagcaccttggaataaagaggccgtgtagggagtcgatcgtcgccgtttaagtccaatcggcttgcggcgctgaatacagcagcagctacgtctccggttcttcctgtgatcccatgtgatgtgtcagctgcctctgacgtctcgttgcgtggatggcttcagctcaggaattttctacacatacatggtggtgaaaactaactgaatgatcagtcgtaactgagaggggagatgctgccagtggcctcttgcagatgcatctattctccaaaactgattcgatcgagcaatccatggatagctagagagaattcaatcccctttagttacagaagcacatacacatggacacaacatagcacattgagatgctttccagcaagaagggacgacggtaccaaatcaggagcgttcattggatcgaatgacagagcttggttaccatcatactttgttggttactttatataagatagatccaaaggttataactaatagttcatcgatttaaaatgcataggagtattcaaaatatgtagcttaaattatggttgtttaaatatctaacgttattgcgaagtgagcgcaactcaactggttagatttcttgtggtgaaacttgcccacatgggttcaagtcatagacttgacataggtgctcgtatttacagctaattattctttcagtggtatgtggcgtacccgtcgacaacaggacgctcacggtgacttcatcaatctcaaaatgtgccatctcaatcttttgaaggtactctaagggctagggtgtacgcgtgttgagtttctaaaaaaatatccaatattattgattgtttctattttagtttaacaactaaaaaatagcgaggggatagcaaaatatatttgaattttttcttaaaaatgtattgattagtgaataatagctagtccgtagaatatatatgatccaaagtaatatttttttaataatatagttaacttggttctttaattttaaattttgtaataaataatttaatttatcccctacttaggctacatttgatctcattggttgagcttatgtagggcacgcaaaatgatgtaggtcatcaattcaatattaattaagtattatattacaaacatgaaaatagattttttttaaaaaaatgtatagaaagtatttgcaaattgaacacgacagtttagttgttcggagaacatggtcaagataaataagggagagccaatctgataagcattttagaacacaatattaaatttattacttatgtacttatatattgattaacttcattatatatatatacatatatatatatatatatatatatatatatatatatatatatatatttatatattcaacatcgccatcaccatggttcattgaacaataattccttggtctagtactactatatagcccaagagagaacggccatctactatatagctagctcatatgagaatttgcctctcttgttgaagtagtgggtactatatagaagatgcatatgttgcttgatagatacagatggtactatgaatgagaggcatcagaaagcatacgaggtgtctttgtgtagactagaggacaaccattagagggaaatggctatggagcaagtccatgtcgcctttagacctgatcagctcagcttgccgtctccacatgatgatcccagtcaattgccactggcatcttcttaagtcgacggcatcagatcagggtttcgtcacaccctattgtgccacaacatatatatatatatgtatgttgatgagctcttgaggccacccaagtggatatgacaatcagtgaatgcatggctgtattattccagtcttccaaatagaaaatgaagaaagtaaaatgccaaaatgaaaatgaatgttgttatattggagactatgcccaagtagttgtcgcaatagtgacattggagattagaggagcaccttggactaagagcacctttaccatccttgaaaagaaagaagggataaatcagggccgtccatctaattagatccaacggtggttcagactttggtaccttctagtatcgtctctccatctgcaccaggtacaaacctctaccccaatctccggcgagcccgtgccatctgtgcctcctttgcatgctcgtaacctccctttcagtgtcgaactccactgcatgccttgcccctcctccatttcccccatccgaaggcccccaaagcaacacctttatcttaatcaggacaaggcagcttaggggcgctcgacgtagaaaggatggtgcaaggaaaaaggataatgggtagggaagaacatgcgagcaaggtttacacaaattcgatgttaccaatcttaccccatgtcaatggatggcaaggtcttcctagctctattttttgcgagttccattacaatttgaacgtttgcctttgcgacgctccaactatgggggtattagagatatagagttatagacatgttttgtatcttgtcctagtcggtttccctaattctctcctgattctgattcatgtagagattaggaaccgcctctatatttactcgtggtccgtaattaatcaaattatcacattgactcaattgcgctttcactttgagccagagcctttgaagagagagaccctcttacaaaccaaggatgaccgaccctaaagacaattgaagatggaagcagagatgctacaatggggaaaatttattctccccgaatgctgtagacaactggaattcagcaagaaatttacatgtttgcaatgatacacgagttcacaaaggaaaaaaaaaagaaagatctataattacagttatatagatgcaggaaataaagggtactgtttccttaattagtattttatttgcttcacaccataagaaattttggattttgaatatatccacgcatgtgcttaatgaatctaaacgagggattgagaggctaaaatatcttataatgtaaaatatagggagtacaaatattacaaatcaggatttttttttatcctcccagcctgccttcacacattattttcagcttggacttcctactgcatctatataactactagtttgcatccaacattgcattagaatcaatgctttgtctttcagacatttccttgaaacgcatatcttcattctttgcatcctgaccagttcatcgaaaattggaatgagtggcaatggaatacaacctattatacctctgctttcaacggttcttatcctgcaatacattgagttcactcgttggagggctcttgcaacttgggaggcatttgcacctgcaaagcatgattaagttttgttctgaggagtaaactctccagcaaaaattcttgaagacgggagtatgtctgtctaggaaggattcacttgaacatctgaacttcgaagcttctcaaaccaaggttcaagttcctcgtgaagagaacactatcctcttactatgtgacatcatgtctctgagcaagaatatctaattatgtaccaatcgggaattggagaaagaagtactaaataaaattttgccgtctccacggagagcagggaaaacaacaatgctttcaaaatatctttgttgggtgcaattgtgcatagcccaggtttagcatctttgttgggttctatttatttccagcataattctgaccatgggatcacatttcagcatcacaaattggtccacacaagagttggataaatactttgcaccggaacattttttctagaaaaacattatgaatttaactaaaaaaatcacagaaatcttgatcgggttggggaaattgtataaatagaacaaccctatcgtacgtggaaatagacaccacttggatgagaagttagtatagctcaattggttagactcctggtcgtggaacctgcacaccttcatttatgtcctagactttagacgggcgctcgtatttacgtttaactattcttttatggcaggcaacatatctatccacagcgaaaccacggtggtgacttcataaatctgaaaatgtgctggcccatttttcggacgtgctcataagggtgcgtgtgtatgttcctaggggtgagggtgcatgtgtatgtgtgtaaaaaaaagcacacccagttggcctgcaggatcgttaattgttctgtcgctttcacctttatatactaacatctaattttacaattttccatttaaacttccgtattttccagtatcttttttagctaaagagaaatggtcacctgttcttgtcttacaccttcccttgccccttgccaaaaaaaaacaataatcacaatgttgagaattcgagataggaatgggtgacatggggaacacaacctttactggatactgctgatgaaacatgcctttatctattcatctacaagattcctggaaacaatgccttctttgtctcaatcccctgctcctacttgagaccaagagagaactcacaaaatcggaatgagtgacgtcacgaatgccatacatagtctgcgagtaaaaacaagtcaaaattatatatgttcctaagggcctgccataccagacacagttatagttagtctacatgctgatcatcgaatgagcttttgttacaggcaccgacaattccattttctcactgaacgatgagaattgaattacaatattatgtgattattcttcctatatatagttcccacttagacacatcatcaccatcattattgctagttggtgagctttctttggtattgctctagttgttgttggtcatatgaaattcgtgcttttttttggacccgcctaattttttggatgcgctcactactacatgtggcccatgttgccgaagtgaatggggatgagtttggacagtgctacgatccaattgaaacaaagtagacaaagctaccgataaagtgtcttactgaaatagaagaaaatgataaattatgtgcacggtgtcaagtggcaaatagccatgaagctatagttcttgcgagcaatcgcattcttctagtgtccatgcgtaaattttgctgaaagtaatgatgggtgggcagcgaaattagtactatgaaattaacttcttataattgtggacgtaacttaaagcctatgatccattatatttgtggatggaggactagaacgttatctgaatactagataaatatttaagactataccaaggtttttttctacatagaaatttttttaaaaaaaaggaggacttttttagcattctttaagaaattagacagccttcaactaaaacaaaaaaaaacaaaactataaaagtgttaagaccatttaccaggcatactttcatgtcaaaataagacacaattatcgatatatatatatatatatatatatctttgtttgtatttgtggtaatgctacaatgtgtattagggtattagctgtctgtttggtcatggagatggatgaatttgaactatactttactttcttctggctaatatgtggttgtccatatttatcttttctgttttgacattcaatttgcaagaaacaagttacaaaaaaaaacacctatgccaataattagcagtacaataactgttattgcgtccccccagcttctcctctataaattttgctatccattcaattgaatccccaccttttcacatttcaattcccctatgaaatgaaaaggaaactaactcgaacctgatgtcaagcattgtggcgataagaatgagtggcttcaggaagaagatgcgtactacccaaaagaagcagacaatctgtggacaagttccagtaggcatgttcagtacagaaggtgtttgacatcgttctgaagagttctgttcatgaacacacgaacccatcatattgcatctacgtcgttgtgatggctttctcgccacagttggcatggcgcgttgccagcatcgccaccgtgctcaacggccttcaaggtggaggcgggacagtgaccatggacaacaagagatgagagcatcgctccaagaggcattgcgcgattatgcgtatgtgcgtgctccttcgtgacagtttgctacgagaagagcgatagcaccttacagtacagtaatgtcgttgtcgtggctgtagactgatgattaacataataatcgagcagtccactatagtttacatgttagtgggagggcatgatggacaatgtttgaccgtcggatggcatttcgatgtccgagatgctggagtatgtgtccgaatatgtatttaaagttaggtgtaaattaggacttggagttataatatatgttaggatagaagtaaagttaggcttttatcataggctctcgcttaaattcctcccacatctatataactagttgcatgcaagtagaagagatgctttttcttttattcttttccttgccatgaatatcttcatgctttgcttcctgacccatgcatggaaattggaatgagtggcactaggaatataacccattataattgtgcttgcaacagttcttcttgaagtgaattgagatcacgcgctagatggctcttgcaatacaagaaacctgcaagacatgattttggttttttccatggaggaaactctcccacaacaatccctgaagactagagtacatttgtggcctggcaagatttggatgtatttctttactaaacatttactaatttgcaatctatttgagtttctgacattcaaacatagaagtctgtctgtctgtccctttatcgatcatcacatgtaacaatttaagtcaataacatttttttacccctcagctaaggctggcatgagttgtgtacacattacagcgtcgatcctcatatgtgagttgtgtattctttcatctacaaggttcctctaaattaatacctagtgccatcttcgtagtttagttcatgggaggcaacacgatcacaaattggaatgagagacatcaggaatcccacacttagcaagagctgaataattaatcagttaaccccttacgttatagttttttcagttcgcccgtactgatcatgtgcaacgaaaaaacacggatgatcatgttgttttcttaatatgacatcctgtactgataattttgtttgtttctgggaggctagtaataggagactggcgagaggattcagacattttcatcgttgctcttattcctttcagttcagtgactctagattcagaactactagattgttaatggacatagtagttgcatcatattttgcctagctcagttaacagaagatgtgctaattgatttttgttttgttttgtgaaatcacgctgtccggtctctctttctatcttgtgttgactctgttagtttgcaacttttcatagtggcacatactagcagatcatctaacccggcttaaactgtaataaaccatgctccttataatttgttactgctttctggcttgtccacaagaaaacaacatgtcatgaatccaacacgcactttggacctgattcagaggttgccatggacaggggcgggcccagtgtatattcaagggtattcagatgtatacccaagatttttggacaaaaaataggtatatatactctatatttcgtatatgtatttaaaaaattaaaaaagaaaccttaaactgctcatattggaccttatttcaccatttcttctctattgggcctaaacttcccactcccctccccctttcctctcagcccgcggtctaattgggccgttgtcaaccttgcatctcagcccatttcgacatatccccaattcccctcccatctaaccctaattcgcctccccatccatcccgacagttgcgcaggcgtgcggctggcggcgcgccgccgagcaggcggggcttgtggcgccggcccggccgcgcgactcgtgtcctcgtgctcgtggtcgtgggatgtggggcgccgcgccgggcgcagggcggtaggcggctgcgccactgagggctgccggcacctggcctggccggctgaccggctcagccgcgcagggcaggaccgcagaagcaggagcaggacagcaacagcaagccgcgcaggacaggagcagcacaacagtgacaacacagtgagtgactaaatctgtacatgcacaaaatttgaataaatgtagtgaagattttaggattgggagctgcaattcactgatttagtgagtacacaaatttgaataaatgtagtgaaaattttaggattgggagctgcaattcactgatttagtgagagtgtacttgcttgcttagtttgtagtggtctagtggacactggacggtagttcatagttcataccatattatcaaatttgtttaattttcagaactgaaacatgaagacgaagaagggccagctgttgatttaaactcttttttggagaaacaagatggggcttcattaaaaaaaattcaatttgcaagctaaggacaaggacatcatcgattattttcaaaatatcaagcgtcgaaaagttaatctctaaattgtaagatttcttcctaatttatcattttctttcatttttgtatttcatatgttattatgttggcactttgatatgtttaggcttttaggtgtatgaacaattttttttaccccttctcatttcgaatacacaagttcaaaaacctgggcccgccactgcccatggactcctacgcatactattgagcaatttggccttcaaaggaaagggtcatgctgacgaagccgatgtaaatctttgagcattgatccgttttttctcagtcttagctgcattttagttagtctagccttgcatatgtaggcaatactgaaaatagtccaggagtactagaattcagttgagcaatttccatttctttctttatgttgttgaccgatctaggagctatatcgtgggatggcgcggtttttgcgatcctgtacgctcggccattagatgcatgtaacaaactcccaggagaggagaataaaaggagaagatgaacccagaaaagctgtgcaagtttcaagcagcgcatactctatctcagctagctgctctgttttctgaatttcttcagtctactgtagcgaaacctacaaccgtcagataacacagcaccggtgagattgagagtgaaattgaatgtggtggagcatatttcctgacaggtcattgatccaaaatgtatattgcttacatctgcttgcaatccttcttcacgagcttaccatttgcttcagaggtttacatctatttatttgaagggtgagggagggtttttgcttccctccccatgtttttctcctctcttaatgaaatgtttcagcaatcctcttatgtattcaacaaaaaaaatgtttgatgtaattttacacttttatgacacgttgtgaaaatcttcaaggaaggaaatagagctagctagccatgcatgctaggataatgcactgcatcattttctaagtcaaatcaatatacttaactaacaatccaacaattttgtagggaggggtatatcctcaattcccatataagaagatgttatatgaccaattgtctcatcaaataattcttcatcctcagatatagcagaacttctgtatgatgaatggatatatccttaatacccagctgactggtttaatattatccactggatatattaatttctcacacgtgttttgaaatttattacgccaatatatggtgaagtgccaaaaggcgcaattggtcaggccacatgactgtttatgtacccatacagctgctttttgccaagctcacctaatgtgctcataatttcctccataaattatattttaggcagtaataataatgatatattgcttcttcttgatgctatccataccaagctcatcttgataatatcctaccttctttcacactatatatatagcagaacatcttgcagtagagaacttgcacacattttgctcctgcatgccttcttgctagcaagttcccattgtggccaggcttccgccgctggcctcaatggccagggcataattcttgacgaactccgcggggttggagtctccccggtacttagagagcttaggtggtcggaagcctggtgggtacagctcctcttgtagctgccacatcagtggggactcgaggtttacggcgatggggggtcccttcggaggctagcttccctcgatccggagatactcccccaacacccgcaattttgaagcatctgacaagaccaaggaatggtactgctccataatttgcatttacaggctggtctgtactctgcacacgttattttccagcttcaacttcctactagatctatataactagttgcactgcaaagtttcattagaatcgacgatttgtctttcattcttttccttgccattcataccttcatgctttacatcctgacctgtgcatcgaaatcggaatgagtggcgctaggaatacaacgcagtataactctgcttgccactattatgaaactacagtatattgagatcactcgctggatgtctcctgcaccagggaaaaattttgcacctggaaagcatgattttgttctgttccaaggaggaaactctcccacaaggccacaacgattgccaaataatggagtgcatctgttcatgcaggattgacttggacatcagcctcaaagagtggtacatgttccctgcagtgaaccttgtcactttactatcttagaatgtcaatgtattggaacaaacatgtaactatgaatggggaattggatactaaagaaaattttgccttctctgcatagagcagagaaaaaaaaaagcaaatttccgaaaaatcaacttgctatctgcaatcatgtatagagtaagattgcatcttattgtatgccggtgttctctcataattagccattgaatcatatttcagcatcacagaatggtccaagcaaagagttcgatggatcttttgcagagaaactccgcaaatgtacagataacatttaggaattaggatccttgtgatgttgtttgagtgaatgaacagtgcaatcatctttcagtagtaatacccctccattatttatatggttcgttgaagcaaaggaaaccacctatacttgtgtaattaaagcggtgatatcttcattttttaaaaaaaaaataagcattaacatcaaacaggggcggagctagaacgaaatggaggggtgcttaatttactttattttatatagagtttaagttgatacggtgatctaaatttgtgttgagagtggtgcatacatggtgaaaacagtgagttataactacaaaattttcttaactgagttcctaggcccccccccccccataccgtcgctccatccctgacatcaaacacacctcatctacaaaagttattattacttctgctaccctcgtctttatatactaacatatctttctctttccacaatgttcgatttcaacttccacaatttctatctttgtagctaaagagaaacaacaaccacacattcctatcttacagcttccctagcttgcagtatcgagataactaggaatgagtgacatcaggaacgcaacatttaccatttcccccacgctatgtcgacgcagtctagcagcagtattcagtatggcatgtgattactccatcccatctcgtgcaaggatgcaactggccatcggctacaccatctttcttccagaaggctgcaagaacaccgacaaccagcaggcagcaggctcatctatatgctcagtattctgcttctgttaatgctttagtgtcatgccagtgtcatcgccatgggtcacagtagattccatttgaatctctgaggttgaacttgcgaagaagtaagataatggtagtgaaaagtctaaacgaatcagtgctgcatcgacagatatatggacttaataaacagtggtaaagccagaaaagagagaagtaataatgtgtgcatgctagtatgacgttctattacatcaaagtatacatgctcagctattcagagttaacattaagatgcttaattgttatcatagtgaggctagaggatttaatttggtggcctcttgaatcaattttttgttcctagtttgcaaactaaataaattttttgtgcagtaattttggcacttcaaatacttttgcagtaccttcgctgaattcatagacaagtatatgctgaattcattatatttcttggcgacgaacgccggcgacgacgcatatcttttttctttcagtattgcggcacacgcacacgtatttggaatggacacacaagaacagaagcctttcagcaacaaatgccttcttttttttctccgttattcgcactgaatcagctaattatcacaagcgcacatactgcagagcaactaatttggctttataagtctcacgccagcacgcatgattacttgacccggactctactacatgcacttctccactaatccctgcaacacatgcatgtacgtacttatccactaagtaactaactagcccactaattaaggcatgcaacatatgcacgttgtaactagctagcaacttgacccatttatgaattggccggcctcaaactgaacacatcaagtttccagccatatgcaaacacgtctaacacatgatgtgatcacagtaaacaaaactaattaaccataaaagaatgatatgcaacaagaattagtgctaacaaagtattgatttgacttagaaaatgctgcaatgcacatcatcctaacatgtctagctgcatttcttccttttaaaatcttcttgcatgatccttccctttgatggccaaatttcccaacatgtcaacctactagtcgcaaggccaaagaatgcaacaacagctagtatggacaggccaaagttcctgctgcctctcatgtcaaatgcaagcaacatcaggaagctatatagcaacaccagtataggtgaagagaacgacaggacagagagagccagctcttaatttgttgtcacattctgctatatatgtaactgcccttccaacattggagagaacaaatttgacatttacagcttccaccagcatagacttgtattatttatgatgaatctcattgcttcaggttaattaaggaaaaagtgctatattcttgatatactacgtacatatcagtgcaggccacaggtttggattcatggcacattgttttcttaaggacaagcggcaggcttttattaaactaacgcagtcaacacaaagacagatagagaaattatcgcagctaataccttgatttcacaaaatgaaaaaataaagtcgaccaccgcatatatgctgttaatgagacattgtttattttttgttgaaatgtatgaaatctggcctctacatccaaagcgaatgtacagagctaagttaattgagacaacacatatgatgcagttaatgagttatgacaagttagtttttttaatgaaaaagtactatcaggtcttgcctagaagttatatattaaaaatataatatttggagacaggagtaccagtttatccaaatattacaaatgttgtaaccaatcaaaaactgctaaactaatacactcgttcaccctacactgaactgaagtgaattgaacaagagcctacaatctctaaaatcctctggctggccatcagtgttctactatcagaagtaaatagcatgccgggccagccatttactcttggaacttaagactgggctgcagatcattcaaatggactatgattatctttgatttctattgtggatgatcaataaggaccaactaaaactatgtttgctgcagtaccaggccttcgtaaacatactgtccagtgaagtcgacaggttattggattctcaaagagtgtggcatccctgatgtcgctcattccaatttgtgaccgtgttttctctattgatttaacaagaaagaaagtattgtttcagaggaatcttgtagatgaaggatacatgcagaggagatgaaggtgtatatatataggcctttatagttgactgtctattgatttattacatgtgaatatggccatgtttagttccaaagtttttcttcaaacttccaactttttccatcacatcaaaactttcctacacacacaaacttccaatttttctgtcacaccgttccaatttcaaccaaacttccaattttggtgtgaactaaacacagccataaagcttccaaacaaccgaatttaataactgaaactcaaatagctttgtagctagctagtaaattttatacagacttctcctccggcctatctgtaccaggatgatcttcaatgtgctataatggagaatcatgatcaggagtacaacagtgccttcttggaactggaagatacgcacgaggagagatgataacctcataaaatgactagaattcccaatagcgagcgtactcgcttgttcgtcgtctccagcatgctctgaccctcccattttacttacagtgagaggataacttcatggctagggttgctgccgcgaccggtagttcggaaattcaagtggtcaccagctcgctgcaagaattacacaagtataagctggttcatttcctttaattgagaaacacaatactagaggggcctaataagcaaaatatcactctctacggctacccaaggaccaatcttgtttgtgaccattcaaagtgacctgaagtcttggagatcctgaccgttttttcgtacaaatagggggtttccatacaaaagatccatcccactcttggcatggacatatctctttgttcaccataagagctgttatttggttcatatggggcgtttccacgaaaaaaaaacgcacggaccaatctaagacacgtgcggtgatccgacaagcaaatatgagaaattttatggtccttgaaaaagtatctcaaggtacctaaattttacactaaaatttttggtaccttgagatacttggtagctgcaggtatgaaattttacactagaaaatatggtaccttccagtactttttcaagaagagcaattctacggtctttgatgagataccatgaggtatcaaaaatttagtataaattttggtacctcatagtatctaggtaccaagaggtaccaaatttacaatagaaaaagtggtacctcctcaaggattgtaaaattgctcatactggaaggaaaaagatatgcgtcgtcgccggcgttcgtcgccaagaaatataatgaattcagcatatacttgtctatgaattcagcgaaggtactgcaaaagtatttgaagtgccaaaattactgcacaaaaaatttatttagtttgcaaactaggaacaaaaaatttgattcaagaggccaccaaattaaatcctctagcctcactgtgataacaattaagcatcttaatgttagctctgaatagctgagcatgtatactttgatgtaatagaacgtcatactagcatgcacacattattacttctctcttttctggctttaccactgttttttaagtccatatatctgtcgatgcagcactgatttgtgtagacttttcactaccattctcttaattattcgcaagttcaacctcagggattcaaatggaaatgcatggcggtatgagcatcacaatcggaatgagtggcatcagcaatataacactttacttgactcaaagaaaacgcccaacaattctacaataatatgcatcaatgttggctcttggatatggcagaactgcatcaagccatcagcgtgttaccaatatccaatcgctcttaacaagaactgtgcacgctaattatgttcatgtaaggcgtgagtgcctaggaaacctcagtgtgatccctcagcctcaccctcacatgactgacatagcgtgaaaataggagttggattaatacaacttagtgcttctcattcctcaagtatcaataaaattgttgtaaacaaactctctaaaaacaatttacaccaacgatataataagcagttgtcatctggcaaaatttagtccaaatttaaactacacaaggagaaaagaaataaccaaattcagtaatgaatattacttgcgtgcatttttttttgtgagactagtgccgtgcttgtgtgttgcaatgggattggaagaaatatggacgaatggttttatggggttcacttttttctggtcggtcaatttcctgaccagttagatccaacaatcggaaacgatttggtaccgtggggtactggtacctcgagatactttttattggaccagagcaaatctcttttctagctgcttttcctctcttctacatatttgtcaataagatagcagttcatcttgattatttcagcctctcttctccattcctaacaatttttcgattatgctgatattgcctaacctgatgctagtggggatgagtggcactaggaattgtgatatgtcgtttctgatgtgtgtaggttgtctctgacggcctgctactgaagtcctcatagctacttgaaccttagttctctagcagagcttggttgtactgtatgattgtgtcgtgtgtccctcatgtgcttaggagcaatgtctatagatcaagaacaataagtgatttaggctgaggagaattaagtgtaattatgtcttccttaaaatatggagaaagagaagtagctaggtactggcctgtttacttacaaagaatatggaacattggcatgcatatatgagcatgcacaacaccatttttattactcaaagatgatgacaacaatttgatgcggtatatctgttgcatttcatgctaatagagaactaagaacatatatttcaattagtagtacatcatgatactttccaacaacggtaaaaaaaatagctgtttagaattattgaaaataggtaatgtctgcagattgtagtctgagaggtgctaaaaattattacctctcttttctttctggcttcttttgctcctctcccctagtctatatagttatcaacaagattgtttatctaggctattgcagctagctaagtagcctctcgttttctccattcctcacaatttcattccgattatagactgatattggttaatctgatgttattattgaggatgagcggcatgaggaattgtgatatgtcctttggtctaagtcctgctggtgcatatgtactctcaagtcgccacgatttcacagtgtaattgttcgatccacacgtagaacatgtttatgatggcaattaactagagtattgcacatgtttatgatgtcctattaacatgacattttaggtgttccaggtatcgaattgctgctcataattaactaggacatcgttttagtattttctaccattgtcctcacatgtccatatattcttcctagatggtaattctctacttcccatttaccttgcttctttattttccttctcatttcctagtctaccataaagcaatcagtatcacatgaatgtaagccatccacaatagaattgagcggcaccaggaatacaatgctccaactcaactgatctgaatgtccttcactttcatcccctcagttgtttggctgaataaaacattaaaggcttgttgctaactcccaagcccagtgtaaccaggcgagattatttgatctattgcataacaacggctatctatgcagcttctcaaaacagatggaagcttgtgttcctgatgatagtgcattggcatgttcttactggccagaatggaacatggcctgcaagtgagtagtgactatagttcagaaaagtaactcgacttctctgtttgggaatgtcttttccaatatttattacatcgaaaagaattacaatttcctcacaaaaaagaaagtacaattagaactacatcttgagaatttccaatgaattaaaatataactctttagaattattggagattaaagtctgatgcattttacaacagtgtagagaacactatgcctattgtcctgttgacaattattagttcttttttctggcttcttttcctcctctctccaagtttatatatttgtcgacaagagacagacatgatctaagaaaagtgcttaccaactaatgaggcacattgcattgtagcttacacaagccatttgagttgtaatttttttccccttattactttcaacaagaccgtcctagtaacttgttgccatgatcaatggagaagaatgttaatgtgtgcatatatatattattagtctagtccctgttgagattgaacaccattgaaactcttgaggctaaaaaaaaaacaggaaatcatttcaaatgctgaaggctggtaggcgatatccctttgtctaggctccaccaatgaaacattgttaatgtgtgaccatgaaaacatctcaggctaccagtagccttaacatgttctatatatttcttcctacattgttttagggaaatatttcttcctacatatggttctatgttttccttcatctcccagtttaccataaaacaagtaggccatatgtttcagtaggattgcatggcatcaggaatacagtgcttcaacataactgatccaaatgtccttcttatcatcaacgatccctctactgtttagcctaagttaaaaatcaaaggtttgctgctaagtgccatctggctcctgagcccactgtaacctggaacctcatgaacgcttcaccagagcagaagggacagatcagaggagatggttcatctgttttccgggcaacactagcagctctgtcgtgtcaatgagtcaatgactgaaatcttttccattattaatttggtacctccaaaagagaagaatgtattatctcctcatagaaaatgtcttttacaatattgggtaactctcttcatgacaaaaaacttaaaaagaaagaaagtagtacatctttctaagagatgtaaaacagcaactcaatagaattattgaaatgtactcagggtttttattacaggtgacaaaaaagaatatgagagtagtggtaatcgggatttatcagaattatatcgccatagacaaaataagcaaaatttgaaaaaaaaaattggacaaaattatgtattacacctacccctgttgcatttctcactagtagaattaaaacactacacctacctcctgattgctggctcttttctctaacttctctcctagcaccaatacaacacaccgcgcatctaccatccttcttacttgctctaccaagtctatattttgatgacaagaaagttcatctagatttctttgtaatatcttgtcttctcgatccattgttcataatttccccgattctacgattatattgatgtttgccaatgttagtgggcatgaggggcacaaaggaaatatgatctgctatatgctaagcctctcaaaaggcctgctactcatgtctcaccatgatatgatgatggatcaagtgttgtcatcagactcgcagcggaatccaaggttatcgtagcgagttgcatggctgtgtgagtgtgtctgactcgatggcaaattcagaaattttctaccagaaataacatgtttggacaatttgctggaacaatttcttttcgagtcaaatcaaaagcataaggacacatatgagtatccgacacatagttctgcatcaatctctggcctactaaagaaagctccaactaacatggaaaactcgatgtaaactgcaaacttgtaggaaatagaattagcattgcaactttcatgtttatccgtcatattgctcttcagcaaatgcgttcggttgtgttttgtgactacttgttgagcatatgaaaactaatggtcaacaactggacggctgcaacaaagggaagaagctactaagtctaggatcttagctttcaaatacatagaaatggagagatagcagtgaacttgatcgtccttcaattcataatgtgcaggttgaaccaaatcaattttgtgcaatatgaccgaaagatgtgttgtaccaaaagtagaacgcacgatcaatcaacttattggctcctatgattacttacacatcatatctgcaatgtcaatgttttcccttcctttccatggagtagcaaagtatatagattattgtcaatttgtcatgcatgatcatttgaggaacatcgatgtgtgttcatataatcattggagatgattttttttttggaattgctaaacttctgtcagcagaaaatacaacctcaaatcttgtaaatttcggatcattggatgtgcttcacgattcgttctcttcttcttcaactccggcgaccacctcttcttctctggcattggcgaacccaaactccggcagagggccaacgaattagggtcccagggtggggtgggggtaggaggggggaggggagggggaagaggggggagttcgccggctttagagggatggccatgggaggtggcagcctggcggtgggcggcgaggcggcgcagcgtcgccgaagccgcgggatcgggagcgggtggcgggccggtgtagccggcaggggcaaagcggaaagagtggtaggaggagacggccggtggtggcgccccgccgctagcgacggggaagacgatggcacgggacaggtcgccgccaccggcttgaggcaaaggaaaggagagggagggggagagggaaggggagggggagggggctggtcggggggggggggtctcgatggcgcc

SEQ ID NO: 73797 - DNA, 13916 bp, Oryza sativa
  unsure (1)..(13916): unsure at all n locations
acgcccaacagcggggggataataggccacccgtgtaggcggaggcaccaatcggcgttgatggaggcagtccggcggtgaagtcgcacacgcccaacagcggcggcataataggccagccgtgtaggcggaggcaccactcggcggcgacggaggcaggccggcggtgaagttgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggtggtgaagtcgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggcggcaccaatcggcggcgacggaggcaggccggcggtgaagtcgtagacgcccaacagcggcggcataataggccagccgtgtaggcggaggcaccaatcggcggcgacggaggcaggccggcggtgaagtcgcagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcgacgacggaggcaagccggcggtgaagtcgtagacgcccaacagcggcggcataataggccagccgtgtaggcggaggcaccaatcggcggcgacggaggcaggccggcggtgaagatgacgatgcccatcaacggtggtgtgaccaaccgaccgtataggcggggacaccagtcggcggcgacggaggcaggtcggtggtgaagtcgtagacgcccaacagcggcggcttaataggccagccatgtagacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgagctgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagtttattccatcgcactcgtcgtcaggaaactcggcgtttacccctacctggcgcgccaactgtcgaaacatgatttcggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatatgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattccatagatataagttatcccctatgactagtcggataaccatgccgtatgggtatggggtacccataatatccacaacaagggaggacggcctcacctggcacgtccagcacggcctcgacgcggcggcggtggtggctaggtcacctcctccacactgtccaggtcgaagaacctagactcagcgttgtccacagggccggcgttgttgtcgtcatcctccgccgccttatcccttgcccgtgccgctgttgacgcaaaaaacacacactggcctgggagatctgcttagttccagtgcatatccaaaggacgatgagatgcgggtctgccagtcagtttgactctgcaactgacaaaatatacaaatagcatatcaatgagccgatcggctgacaagccgatggagtaattctagcccatgcctatgtcagccgatagcgatagggttttgagctatcgactatatatccaatgtagaatctgacacttgatgtaaacaacaatataaaggcaatcggttgatgataatataatatagcaataatatagtccagtagaaaccattcggctaataatgatatggtaaataagcatcgatccgaaggttaaagcatacatcggctggaggtccgatagcattaaatccacaagattagataatcagtaaaatctttgttgccatcggctaaatccaatatgtatgcaatccttgtaagctgatgcaacgtctagataactcattggctgaaaccccgatgaaacacttattggcagtcaaaaagcaggctagggattatggttttaaacacgacttagtagatcaaacttaacttatgcagcactaagtatgaatagaaacataatatctagacaatcaagcctttgactaatttttgggtggtagatgtcttagctaatctaatctagtaaaacaatttagccggtaccgacaggaaccctaaagcgagaaacaactgatagagctaaattgagatactaagactagattaactaagacatatgataaataggcagacaaatatatcatccaaaccggagcaatccaagaggtcgaacgtactgatgcagtcttgaacgacgccgacgtagactagacaattgcctgggccggcgaaacattggacttgccccttcgccggagatcgaaaaccgatgcagccctgtgtcaggtgccaagttccgccagatggtaaataaagtagaaaagtataaatgtgtggcgatgcgccgaattgtattgattgtgagatattttacaatgaccccgggtgtacatatttatacccatggggagatactagtcattgtaggacaagaaagaaactttcttaaagataaaaggaaaatataaagtccttataggacactaaacacactttcctaaagataaaaggaaactaacaaattattcctaattaatagataacttgctatgccgcatcattcttgaactcggtcacttttagataaatagatcaatttccttaaccgaatatagcaggaatccgactattggcgatgcgataattctcctaggggcttaccaaatttcaccgttaatagccgcaaccgccgcatgctggagctatgcgtggagcgccaccacggtggactggtcggcaagcgccttcgcctgccacgccaccgcctccgcccttagctgcacgacacactccaactcggtgccgtgccgcgtgacattcaaggcctccgcctccttctccctcattcggcgtgcctccgctcctctcctgcgcgccacccatctccttgccggcctctccaccccgcctctttcgagaaccctcccccacctttgactcctacgacgaggatgcgcggtatggagtaggaggtggaggggacgaggagctcgctcgccgctgcccctttgctccgcccatcgcccaccccgctcgtcgcttgctctggccttctccttgcaaggaaaagagaggatagagagaagcagagagtagcgaggatgacatgtgaggccacatgggcctcaccattgtttttattgttttgtgtgtgtaactaatatgtgggcccatgatttttttatttttctggatcaaattgtcacgtaagtgtcacgtcaatgctatataggatgaaaaccttgttaaaagatctatgtaggttccatattagccaagcccgggtcaatactactgagggatctcatttgcatggctttgtaagttaaggatgtgttgtatctggttttctggattgtttgcatgattttgtaattgtgttgtatccggttttccggattgaggacgaaaatgcgataaatggagggacctattgtgaacttattcggcctccaaaactagaaagccgtaacgtgccaaacgggcccaggaaaggaaggagggtatgcctttagagaatctggcctgtccgagagagacggaatagcccatctgacatctttgccaaaccctaaccgcctctggctcggcggcggcggcggcggctcgtccccgaagagcagccggagttggagaggatcggtgttcccgctacggtatgtacgctctctcacgccaatcaatcctctatattcggatgcaattcccaatgcaattgtgaacgttcagaatttttagattaccctcagtcttatatcatctcatctggcagcggcggcaaagatcgatggtggacacggatgagcggtggcgcgctgcggtgattggcggtggtggagatgctgctactgcgacggagcctagtctgcccgccgcgataacgcggcgtctgcgggagctcgcatgggaggacaaggacaaggagaaggctcgcacggtcgttgatctagtcgactccgaaacccctatcgaatgcgatcacgaagagggtcatctttgccctagtccctgctccgacattccttctagtaagtatttacctcaggaaatatccctctccgtttgttcattgttttgccggatacatgatttttttttttcaaaattccctagtggttgcagctagcggtggtggtggtggcaatgaagagatgggcaaggtgaattgtaatgagaagcacacatatggtgaggagaaggagaaggagaaggagaaggtggtggagactaagtcggagctgaagcctaaaccgaggaggaagaattgggaggaggaggagctcacatgggaggagaaggtgttgaaggttcttcacatggttcgtatatgggaggtgactgaattcgaccccaagatggagtggtttgagcctacccgcctttgcctcttcaacaccgccttcttcgacctcgacaaagagtgtgagtacatgcattcaccatgcatcaatcccttaacctcaattccttgtatatgatctaattcaacttaacattcgtatgcggcctctctatccattcatcacatttgttgatggatttattttagtgtgtaaaaaccatacatattcttttgtctgattgaagtctcatgtctctgattttacagctaaggctgggcttgggccaccgattcactcgctcacttcctctgattatcgccatttggagacctccatgaatatcatttcaatcaaggttgtcgaatctgacgtgggttaccctatcagcatcttcggcaccgtgttagcgagagatcagtatgactataggtgtgtgtatttgttcaggcgtagcagggacgatccccagatcatcacctcaccggtttgtattcgattcgtcctccctcttactacactgccattcactactcaatagcatatttccttatttttatgagattagactgtttctgtcaatatgttctggttttaagttttaccgggatggaataatggaaaccatctacgtggtcaaaacaaccgtataaaagttcagggaggtgatgttatagaaccatgtaaaatttaggatcaaactcaatccgttttgtgagatatgaaattgagaaaccaggaaaaaataagtccttttcttgctgtttgcctgtttcatatctcacaaactagattgggtttttttcttgaacttttacatagttgcataatatcacctcacccacacatgagataattttcagtattattggaaatatcaaatgtttatcaagtggtttgcacgtctgcacatattttctcttgctttaacctgttataaacactgtaagaacaaatcggcttggctacataccaccaaaagattcatcaattcatctcagaaaatgcatttcactctgttatattctttttttcttgcacattaaatcgtgtaaatgaacagttggtcctcaatgtactagtgagcaagtttgattcacacatacacttaatgttttatctcattttgtgaaaatagaaatgaggcatataatgtgattaacagggcatgatggaagttgacagtgctaaattatcaagtcttggatcttctaatgacattaactgaattctcataagttgcttatgattaaattgcatgatctagagaagtatatctttgtcatttaatcggtccatactgcccataaaatgcatgagttggctttcatttttgtttgatcttttagttagactatgtcttattttagtctaacaagcacacatacatgagagaccgaccaatttatagaaattgggttggtgtcagactcaccaccaccgaaggttttggtgagcaactgttttggttgtaaacacttaaatatcaaattgttggtatcttctcaagtttctgttgaacctggtcttgacatcatctgaattatgcttgattactgagcttggttccttttatgtaattttgttatgttatttccctaaatccctttgcaggaggacatgctaactttgacaggcccaaagcgaggtcttggtgcaaaagattatatgtttttcgagttcaatttaaagatgaagggcgatgatggagttgacaaagattttagcaaaggtttgctgccatacaatgtcgtctgtcgaacagggagactcgagactttacatctcaggagctggctaagtgtagtggaatttgcattcgtgactgttcaatatgccgttgaagctacccttgcggtgaaaatgttagggggggcatctgttttcactggtagagtgactgcttggactactggaaatgatgaagatgaaatagttctctatgacagtgaagttgcagacactcggacagagattacagctgatggatctgttcagctaaatcgtggtttagtagttgtcccattggataaggagctggtgctcaatatttgtgtgtttgagggtgaagatgaagctcaaagctttgagttcattctagggcactatgatgaagaatttacctgcaagcaaggctgttatgagtttcaagttaatattatttggacggcagtaaagactcggcgacggcccaatatgtggaagcgcattggttgcattgtactgttactttgaaggctgtaaaaagggtgcacttatcagagtcatatatgatcggtgcactcaaaacatatctatctatccataaaatttcctaagaatattctcttagatatgtattgctagtctcagtctgtaaatgatgatcacgcttatcttaattagacacatgcatgcgtggtattccctccgtttcaggttataagacgttttaactttggtcgaagtcaaactgctttaaatttggtcaagcttgtagaaaaaaaatagtgacattttcaactcaagataaatttattataaaaatgtattcaattattgattcgatgaaactaatttagtattataaatattattatatttatttataaacctagttaaacttgaaataatttgactttgaccatagtcaaaacgtcttatgacctaaaacagagagattaatatctgagatgcagtgacagttgccaccctcctgccctgaacctaatccagcggccatacaattgctacgtcgtctctcgagtcaagaagttcaccataggaactggatggcattgcgcacgctctctatctaagcctgtttttttttaactacttcactgcagagtatatatttttgttataaaaagaaatcttatattagattgcttaaactaattgttttcagcatggcagacaggtcaaagcctgctgccctctgaagttttcgtttgccatcccaacacaaaaagcgaactcatgcaatttgaatcagatttgataaggaagttaaagtgaactttttatttttaaattttacaaataaactctctcaaaaacttatttccacgaacttttggtcacgccagacagactatcttaacccaacgtggcaatattgtttcaccacgccatcttaactggggtgccaaaacaaaatgctgttttaccacgttagacggggtttggcgtagtgaaaaagatttattttttggaaacaaattttacgagagtttattttaaaaattaaaaaaatcaaaaaatcaaaaaatgataacaaattgtctcacgagtgatccgatccaaccaagtagtttagtccgttatgttcttccgccacatcacaataattatattaccctagttttcctttccctctctctgcgggcggcggccacatctccctggtacgcgcgcgcacatcgatcccctctttttttttttttttgacgctgcatcgatcccctcttcttccgaattcgatgcaatcgcctcttcttctttttttgttcatttatctccatcatatcgcgcatcagcagcaacgctcgcagatggcggagggcggcaacgacggttcggttgcgggggatcggctcatggttgcaacaatcaagcgcaagcgggagcttgccgaagaagatggagattcttcttccccttgtagcgctaatcgatccctcgacatggaggtagtggaggagaaattgtattgctcttatggtgagtactagtgtacattattattattccataattaattcgtcaatatatctatcattcagataactcagacattacaattagtatatgtgtattgattatgtgagcagcctgatatatatgtatagtttaccctgtttgattcctgattacttgcttggttgctgctggatggatgtaacatatataagataataagaattacaaattataagataaacacatcaccttgagcgcgcggcacatgtcgttctaacctgagctgcagcgacgacgacgacagagagacaattgaaacaatgttcaaggaacttccaattggaaaccccaccataagcatggatgaggatgtggtttacttgctctctataactagccccatgaaaacggataggttagaagttgtgtttgctgtcccccgcaaaaaaaaaaaaaaagaagaagttgtgtttgctgttgatgtgaggaagggtatgcttcaaggattagctaagcttgatgttcgcccgaagaacttggctatcatggtcactttatggaccagtgagatttgtaggtatctagtctgaggaatattattacaggtaacttaattctctacgctggtaattaactttattgtgtgtttttatgcgtgatcaatatgtgtgagtatgaatgccatgcttgccatttttaagatctagggaattgttgtgttggtaattttctggtttcagtagggtctagagcttaattcagaagccatggcttgatgacagtgttatgccacaaaaagattgaatccatctcaaaatacaccaatccgttacaaaaagattgaatcttgttggctacattgttcttgattagtgagacagtctgatgtgcagatgcacaataatgttctctcatttgaagaaaagaacaaatcatgtactttactcgcttggaaccattagttgagttgtattttctatttatgcaaacccaactttgatggtaaaatacttaaaattattatatgtacgtagtatgtgctccctttataaatatttaatgcagttgattttgatcataaagtttgatcatttatcatatttaaaagtttagtgtaaaaatatgcaaaaatatcatgtttaaagtacctttaacaataaaacaagtcaaaaaaaataattgtatttttttaataagataaattatcaaattttgttgtcaaagtcaactgcgttatgaccagaggaaagtacccgaatctcttaacatacaggtggcattgtcttaattgtattggacttgtcgagcttggtgttttttgcgggcatttctgacatgatttttcctaatctatttacaggaggaaccattaactttgacaggacctaataatcgagtacttggtacactatacagaattgagttacatttaaagattagagacgatggtggtgttgaccaagatttctgcgagaagccgagaacacaatgcatcagctataattttttaggttcataatataaatttagtgaaagtggcaacaaaatgtccggaccagtatgtgaacaagtagaatcgaatggcaaattaatcttctgtagctgccataaaattaggaacaaaattatgtagctctgtgatggaaagcttgaaggagctcagaattccagtcaatttctagtatacaaaagaaaaactaaaaaaaagtttaaactcaaagcccactagtaaatactactaatacaactaaggcccatattgggcccacacggcccacgaacagcaacctaatcctcgcgctggaagagacgagacagtacgccacgcgccgcctgagccctcgcgtcgcgacaccgctcgccgcggcggcgctgctcctctccagcgaccacgcgaggagggagaagaggaggaagaaggcgagaagggagcaagctagaagagtgggagagggggacatctaggtcgtcgacggcctcaatggggtggggcataccgacgcggccgccggcgacgtcgacgccgtcgcgggtgcaggcgctgtacgagctctgcaagcgcaccttcccgtcgccgtcctccgtcgccgcgtcctcctcgccgtcgtctccacctcccgaccacgccatccgcgccatctcctctctcatgggtaggtcacctgacctccaccaactcctcttcctcccgacctcggcccaatttttgttttgttcttgtgttcagagttcggacagccaattgattgctctttcctctgcaaaatcgttcgtatgctgatgtattgaggaattggatgtgagttttgtgttcagatacaatcactcctgtggatgttggactcagagatgataatcttgaggatggaagaggatttgggttctttgaatcaaacttcttgaagaattcagcaagggttgctagatgggcgcaacccataacctacctgcatgtctacgagtgttacgccttctctgtatgaggatgctcaacttggtcatcttcttgtattgtaacacttctgtgaaagagtagaatttaatgaatacttgtatatcttctctgctaacctgcaattgtttcctgtatgttccatagattggaatattctgcttaccaacgtcggcggtcattcctctccatgatcatccgggaatgactgtattgagcaaattactctatggttcgatgcatgtcaaatcgtatgattgggtagagcctgctgttctagcaagtggcaagccaggttatttttcataccctgtttcaaatatttgtttttatttatctactagtatatattgcattgcagagttatgacttaatgagcttgttgtctctgagaatagaagtgtaaaacatttatgcttcagatggtttctagaatagcaagttaatgaataatagcggttgtggcatagtatcgatactacccagccctattggtcactagtgttgcactgttgctcaggcatcattttagattgctcatttctatgccttgatgatttttcgggttctggtatattaaggattttttttttctttctcctgatgtgcagtgaaacttggaaagttacatacggatgatgttctgaatgccccttgtccaactgctgttttcagtggcggagacagcgtgggggcgccaattttaatcccaagagggtctgaaatagactttgttctgagattttagaaggcccaacaggctgagaaggcccaaaatatcccacaactctacccaaccggccaaccctaatctctttccccaaccgaagagaggcggagactcgtggcggcggcggcacacgagcgcactcgcgcgcgacggcttccagttcaaagcgccggtgaggcggccggcggtcggcaaggggacgcgacgcgcggcggcggcgcgccggcactgcagcagccagcagcagctagggcacgcggctcaccggccgctggctgctggggcctgggggcgccgggcggcagcaaggcagccaggcagggctcggcgcgcgggcggcctggcgggggnactcggcggcgcgccggcacagcagcagccaggcaactgaggcaaggcaacaaggcaagtagcgccgggcagcaacaagccaggcggcaagccggacggcaccaaccaccaaagcagcaaggcaagcagcagcaagcgtcaaggggcaaggcaacaactcaacaattgaggatttgaccagtgaggtatataaaatttctgatttgtcatttaaaatcaatttcaattgtcatggctagttgttattgatagttcaagtcttcaaaaaatcatagattttgattcctagtttgctactttgttatattgctagattgcgaagatgtcaaaaagaacactgctcacatgttatttgacatttcttttgtataggttaccctgatgaagaataattggtgatagggtgtactagtgtcgcacatcatgtcattatctattggatatttcaatattgttttggtatggataatgcttatttcttgttaattctatatatttacactttgtattagacatatagtcaatttacataagacatgtctcaacttttctcggccacttttagttcagcccccactataatgtaatcctggctctgccactggctgttttgtatccccaaagtggtgggaacatgcactgcttcacttcagtaaaatcttgtgctgttcttgatgtcattgccccaccatactctgaatcatctggccgtgtttgcccctattttcatgattatccattttctagcttctgtaagtgaaatccctcactgtcgtcatattacatatttctgtcaggttcatgtttaactaaatcttttggcggaagcagaataccagccatctctggtattggctggtagttgttcaaaacatatattattagtcacaatgctgttcagatcttttctgtcaagaacagcaattaccttatacattatgttcattttatatgagaagaaaacttaatttgttgatatattgtcaaaacacaaaagtgatcattttcactatgctatatcatgtttgatttttctcacggatcactccaactgcagcagctggacaagcaaaagtagtccatgggccagataattatgcttggcttgaggccttaaacgtaccggtgaatattaatatgcgccctggcatgtatactggcccaactatacaggtatagcctaaatttctgcattttgttgatagtcttctgtagcaaccaaaacatgcttgagagttgagactgtttttctgatggaatatttgtctttttgctaggaacatctgccataatcaataaaaatgggcaggacagagcgtcaaactgtgttcaagtgccatctcacaaatacag

SEQ ID NO: 73798 - DNA, 23859 bp, Oryza sativa
cacctatcatacacactgcgtcttggagtccgtgctacagctggctacaaatctgtagcccgctacccttctctctcctcatttatcttcttaaaatatgtttgcagctggtttatagcctgctattgtacctgccctaagaaaaaacacagagatcaaaaacaactaaatcattatgtaattaattcacatcggttaagatactacactagtaatgtatcccatggattgcattaaatttttaatattgcatgtagttgtaccaccaatagtaattaatcttggttagttgtatgcagcgcattcaatgatgctaatttactctttatataaataaataaagatatatttgttaaatgatgatcattttggaaagatctcaaaaatcttagctgatgatcaaactggaataggaggagtataagttacagacaatatatatatatttatatggaaaagagataacaaaaattgagaagtgttggttctcatgtactacctccgttccatattgatcatcatatataagggtgtgttcggatggaggtatttgggtggataggacatggcggcccattttttgtggttgtttagttggtgggcgggagtgggataggacggcacggaggggaattttcctcccagatgccagatggagggatccggccgatttgcccagatgcagccacccaagtacccaggcgagcggggcgagtgagtatcgtaggtcgtgtcacccctctcaccatgcgagctcggcggtcagcgtggaaagaaggaagctgcggcgagcccaaaggcaagaggcggcagcgagcccgagagccagaggcggcggcagctagaagagggtgcgtcgttgccgctgccgatgacgacgatgaccaggacgatgacaactggatctggaggagatggggtgtgccgacgaccggttgggtaggagacaatgatgatgacgacgaggatgaccaaatctagaggagacaggacagcagccggcgagagaggaggcagggcggcggcggtgagagaggaggcgaggggcggccgacgaagaggacatttttttttatttttttttccgtttttctcctttcctccttttatttcattctaatttttagtttctatttagatttttttagtagattggtattattttgggttcattgaatttcaagggggtatacttaccactactaatgaaagggtgattgcaaccactcatccatcctactcccccaactaaaaaaaatggatcaccaaatccacattcatccttacaaccaattggatcgccatattcactccaccaaacaaaaaaaccggattgccatatccaataaagtatggaccgccatattccatccaaccttgaccgggaaccaaacacacagtaagctttcttaccaaggcagaaaaaaaacttaaactgccatgtattttatttaatacatgagtatgtggtggggaagaattaagaaacatgcatacttttaactccccatttgcacaagaaacaagggtttaactacttctaaatgtctatatgcatacatgcgcgcatactaaatttgcatgcatagatacaataatgttgcacgtcaaatgagtagaccatggtcatatgatgatcaatttagaatatccaatttttggttatataatgatcaatgaaatggaggaactagctgtacacattctttacgaaaatgcatagtgagggaaagagagagcagagaaaaaatagagttaatcttataggtagcatatcatatatgttagctctacaataaatttataacttatagtgagctctactattaaatttgctctaaataaataaatccatctagattcataatgatagaatatgctaaattcagtactatggctgtatttagtgcacaccaaaatttgaagtttagttgaaatttgaacgatgtgatggaaaagttgaaagtttgtatgtgtaggaaagttttgatgtaatggaaaagttagaaatttgaaggaaaaacttttgaactaaacacggtgtatgtttatttatcttaggacggagcaagttctgtcgactaacctttaattattttttttttaaaaaaagaaaccactggccaacttgctttgccagctaatcgttgtctcattgccactggccaacttgctttgccagctaatcgttgtctcattgccgggctccagtagtgcggctggccgcacgactatagtatgtcgtagatctgggttggtgtgcgtttctctcctaaaataggacgtggtcctcgcagtcctgcagatatactatagcgacatcccgtgaaatgtacgatctatgcgtttaaaaaaaattagaattatatccgtgaaacgtacgatctatgcgtttaaaaaaacaaatttaggattatatgttatttaaattagtataacaaatctagaaaaccattatatatttgtttattaaagaatggaaggagtattccatggtgcaacgcaaatagcattgccgattctcaacttcttagaactcataagagaccagcgtttgagtctactcaagattaagattaagagcagacacacaaaacaagaaaggtaatagcacatagttaattcagttttaattatttgaaacataaaagatggatttatttaatattctaaagcaactcctgcatagaaagtttttgaaaaaaaaaactatttagcagtttgaaatgtgtgctaatgaaaactgaagcaaattttgtatcttaattaggccgagtttagttacaaatttttcttcaaacttccaacttttccatcacatcaaaactttcctacacacacaaacttccaacttttccgttatatcgttctaatttcaacaaaactttcaattttgacgtgaactaaacacacccttagaaaaaaatggaacctagatctctaaagaatggaacctagatctctagggtacgagtaccactagtctacattaaatgctctctctgtttgttatttgacgccatactatcttttccatctctactagttcacattaaggctccgttcttttttatttgacaccttaggccgagtttggttctaaactttttcttcgaacttctaacttttccatcacatcaaaactttcctacacacacaaacttccaacttttccatcatatcgttccaatttcaatcaaactttcaattttagcgtgaactaaacacacccttactgtcttttccatctctactagtctacattaaggctctgttcgtaagaggggagttcacaactctcctctctcgttttccgtgcgcacgcttttcaaactgctaaacagtgtattttttgtaaaaagtttctatacgaaaggttcttaaaaaaatcatagtgatccatttttggaaaaaaaatagctaaaacttacttaatcacgtgataatggaccgttctattttccgtgcgtagacaatgagttcccaaccgccacttacattaagtaccacactccaggcctcatcttctactcccaccgtcccataaaaaccaacctaatcaagattagatatacctagaacaacaaatgccaaatccccacctaggttaaaagatacggaaactgcatgagaacatatgtaagcttgtgcaattacataagctagaccttgaaggatgtcactatcttgtcacgttgcctacaaagaagagtaaaatgaaggagcttcagtacctaaatgttctcaattgctactcactcacagcaatgcctcatgctatgggccaacttacacatcttcacacattgcttggttactttgtccccaacattggtagtagtgcaatgtcagagcttcaatcactgctagacctcaatagactatggctgtatttagatccaaagtttggatctaaacttccgtccttttccatcacatcaacgtgtcatacacacacaacttttcagtcacatcatctctaattttagtcatttttcaaactttgcgctgaactaaacacagcctatcactagtgaaccttgaaaaggtttcagacactgaagatgcaagaatggcaaaacttcaagagaaagaaaagctcgagacattgatgttgaggtggaatatggatgctggaaatgccagtagaatagatcatgaagtacttgaaaccctccaacctaaccagtgcctgaaaactttggagattgttgcgtatgaaggacatgcatttccatcttggataacaagcactgagccatatctcacatctctggttgagataaggttggttaatctgagatcatgtgaaaatgctttacctccacttgggctactgccatgtctgaagattgtggagataagccgagtttttttttttttgcgaggaagtggagataagccgagttgagaatatcagttgtattgacgataatttctatggtcagaacggtacatttccttcattggagaagctgattctctcattcatgactagccttgaagtctgggaacagtcatctaggatgaatctgtttcctcgtcttgcagaacttgtcatcattcagtgcccaaaattgagagcactgcatatggagtttccatcgattgaaaaattgattttgtggatgaataataagatgttgtacagctcgaaggaaggtctgagaggtgtagagaagagcctcgaaaatctttcaatttctttctgtgaagagttgcatgcttcttcaggctgtgagggtctacaggctcttgatcgcctcaagaagttggagatatgtggttgtcatgaattgtcatgcctcccacagggtttgcagcatctttcctctctcgccagcttgaaaattgataactgcaacaaattggagattttgccagaatggttggagaacctaccttttctacagataatgtgtttgtctggctgtccaattctgcactccattcctgaaggcctaacatgtagcgacattattgttgaatattgccccaattttaaagaaccatcaggtatgtcatcagtgctctgttcatggaaagccatgtttctgattttcattgagctattcttaaagcaattgaactagctttgatagattaaataaacaattagttatccttgctatttctttttgatgttcaagtgaatgaactcatgttcagttattaatacatatcctcttgagttgaattggcacgatatgaagttgtttctttcaacacttgtgacttattattgtgtgaaaaacagctgcacgagggcaaacgaatagtcgtcatggaagattagttttacattagttcagcgatttaagggaaggccaattttccaccgctgatcttaaaacattggtcaagacaaaaacagtggtgaactggtgatcagaagcagagatttcatgatcaacctgttgatctgtttctgcaactggagattatttttaaaattgaactagatttctcattgtggatgtggttagaagagaggaatagtaaatgggaactcatgaatttaatgcttgtgaagtgtaacttgtgaaattctcaagctactgtatcttcagaaatgcatgagaataagaatgatttaggtagcaatttagaaactatcaatttgctcctctgaaattcccagctatattgtgaggcatcagcaacattattaacctgaacacaataggttggtcacctgtgtaacaaaatgcctctgacattatttggttaagccaggattatcttacaaaggggcggtaccatgcataagaaaaaaaaactagttaatactctgatatttgcatatttataacacacaatatccacatataaataacattcaaggtgcttcaagctatcacagattaagagcaggtggtgacaaattcattagttagacaacacctggcagttctcacatctcagaactcacaagagacctagaggctagaaatggaacaactagcagtaatacaccatcatatacaaagttacaattaatcacgttcagtattaacatgtcatggaagattaaacaggtgccgcttccccttctgatgatgattttgacataaaggccagatcaagggaacatgccttcaaggaactcctcgaagccttcatcattgttgctcgattttcttgatgatcgtttgcgatctgcaggattttgcatagaataatttttcttgttaataatatacaaaagttttgacagtttaaattccgacgaaaataaagtaaactactacatactggtagtgtttgacttcataaacacgaaaaaagatccactgttccaggtaataatgcaatcatttttacctttttttcttctactatatttctcagttgattcatcctccgatgtatcttcagtttcttcacttccctcacgttctctacagtttcaacagaaatgtaaaagaaagtcaggtaacaaaaatcctggggtaaaaggtttgaacagaaatgtccaagaaagttaggaaaaagaactattggggaaaagaggtaccttttcctcttgtccctttcttttaactccatttccttttcacgagaaatctctttttccttctctctttccttctccttttgcctcttataagcaagcttttctgcacatctttcataatgtacaacaatcaataatcaattgaatatttggttgaacaaaaatggcaagagaagactagagagaggatgggccagagcaaaatagttgggatgcaaaatgtatgaataccaagatcagcaagataaatacaagaaaagaaatagtggatcaactgggttacataatcccaaaatgaagtagtggattaactaacctctggcaagctaccagtttcactagtgcttgtttctgctcccctgcttcaatataagaaaagttcacctgaaaacaagggggagagttatctatagcagaaaaggagttctttaatgaacaaaaggatctatgcattgtagcatcagtgacaagatagaaaggaccaagagcatacctcataactaccaagtccatttttctcatcacaaatcctgttgccacagagaaactgccctgcaaaagacaacatgtaatgaatatcacatctaccaataagaaaattagtaaaacagagcacacatttgaaaaaaaaaatgtatagactacatttagcattttgcgacagtttagtgcacctgaaaacacatggaattataaagggaaataccttttccagatatcacctccttttcagttctccatctcaatccaatctgaaataaatgagatccttagaatgtgcactcaacttccaagaataaaaccgatggttttatcaattaaaaaaaacctctaatatctatgagcagcatatccttgttagtgctgttctaaattctaaaggatacttagatattattcagtaacgaaccaagtaaataggatttcttagcgtccccactatcaagtgtgtgcctgtcagacattaacatatataaaagtatggttgtgctagtgattttgctgctctgtgcaacaataattgatactataatgcaactccatgaccaaaaacaagaatgatcactttgtcgatgctgctcacgcaaacttaatattacggatacgaaatcaacaattcgtattattcttttctttcttttaattgaaatcctcaatgttacagatataaatcatactaggagcatttttcgtcttttctattgcattaatagcaatgaggagaaaaaacagcaagaatatcattcaagagatcattgtatccagtaaatgacacaaataaatactgtaacaactattggcttattgctatagaattgtatcaccataccttgcctcttttgtactgggacatatcagcaatgcagtatctgtatcaaattaaggatcctaggcacaataaatttaagtttcaagaacattacaagaacagtaaaacagccagcaaaacaagttcaaggtgcaaggactacatctcttggttaatatagatagattataaagataggagcagaacttaagtgcttcaaatcaaacatagcaatcctggttctctctcatccttcatgttcccatcttctaaaataggtactacagaacttcaaaacatgctgtttctataggagactgactgacagataatattggcccaactatttaaggcataaatacaagaaactttatgcatatcatgtaaatagtttctcttaggaaataacccgttaagcactatatttgtttggaacgaacttgcaatattctctcaaagacatatactgatgcagcggacaacagtaaatacgagttatgcctatgagaataaccatatacatatgcgttatgtctacctctttgatgagaaaatttcactcatagtatcttacaatttatactgcaactcttatcttttcagacacgctaatgagtttgtgagataatatctacagttcatacccaattagtctattatatcaagctcttcagtcttcaatacatttgcagtattgctcagaataaaatgggatgaacttgccaaatcacctcagctccacaaatcagaacatgttacagaaaatttctgaagaaatatacactgtacccttaatgaaaagaatgtaaggaacacaccaccaaaaaggatactctttaaaaagcttgtcatagtaacgtttgaccagcctcttctcccaagtagaatccacatcgtcttcctcagaaagtatgaacctttatatggataaataattaaagaaaaggatttaggagtatttcataaagcatggacacacattccaccataaataaataacaaagggtattggacttgtttcttacctatatccttctcgcagtgtatctttatcagtcttgatgggtgcacgattatccacattcttgtcatggccataaaactgaactgttcacagcacattgttttttcagtgggaacttataatatcaagaaaagagggagataccaataaaatgccagagccaatcaatgaaacaataattttgtaaacatgaacatgatctccaatccacaattatttatacatccacgataaaggatgctgtggtgaggctacattctggttcttcatttatcatagtagtttccacttacatatctaaaacaaaagcttccttgtactttactaacacaagcaatagaatccaagtcacttgacttttataatgattttaaactgatctataatattcatagtatagttggaagatgaactgctagtcaatgacagcattgttcaacagattgggtcactggtatggcatatcagaccatcaactcccatatggaaaagatgcatacccagaataagtttcatccaaagctaggtgggaagttatatatcaataagcatagcccatgtatggatgaaggtagcccccaattctttctacagtagaggggactgttcgtcatccagttgcttttggaaactgagacagagcaaataattaactcgttatatgccagcgtctcaatttcctttacactgtgaaaggacaactttctgatccatccgttccatgcattggcatcaggaatcaaaaatcaaattgaactgggataacgggagttgtgccagaatatcggagtgcaagctaaccaccatttgtctgactattgtgaagaaaggcagaagcaaaactttaaaatgtgccattttcctaaaacagtgctattaactgtaatatattatcatgacattaccattccactatcattatattttgttccaatgaaatctgaactgaaagtagccctagatctcccaataaaattttaaaacaatcaagaaatgcttaagaggtggaaaagaagccagcaaagaatcataccataatccttcatgaacttcttgtgtcgatcatacgcattaagcccccgaatgtgcgattggtattgcctgcatccacaaccaatccatatccatcagatgaaaaataaagcgagcgaactaacaaaaagcagtgcatctatctaatattccattgcccttgagtggcaaatcagcctaacttaactcctatctcgaagcaaagattgcaaccaacaaagttagggttcatcgacatcatcacttcccctattcgcactgacccccaacacataacggagcacagaaataccccttcaaaatcacactttgacagcatcagcgtcaagaaatgtgaagctagaaaaaacaaaggtttctaatcgattcgtgccacacacaaatccgaaagaaagggggaaactttggtgcaggaacagaatgagatgggacggggattgggcagaaaagcaaatacatcttcctctcctccttgtcaaagatggaggatttgagcctccccagcgacgacgccatcgagctctcgcctcctctacctctcctcccctctctctcctctcctctcctctctctccccagccgccgccaccgtcgtctcctctggttcttgttgcttcaggtgtggatcgtataggccaaattgggccttcgtttgtagcccatgggcagttttgggcttgggcccatacagttgttgaagagagcaacagaaggcccatagatgaatgggttttcatgtaattttgcagaattcattcatatcgaaccgaatttcacagtttacaatctggttcgagtaatgaatctactgagatagtagggtttttttttcgcgaacgcgcaaaaaaattgcacgttaatatattagaagaaaaagagttttagttacaccacgcaatcaaccagactggcttatgctaggggaaggaagaaaaagcaaaataagaaaaaaaaacttaagcatagagaaactacggcggctaaaaacagactccaagcagcgagaaggggctaaaaacagagttttttttttctccgtccatacattcagaggtataaaatccttcgaatatttttgtttatcccatgttagtccctacatttctctaatatattatggacacaaaagtataatcatataaaagtacttttgaaaattaatccaatcacatcaattttgcttcacaaaaaatatgttataatagaataattgttggtcaaagttttgtcgtaatgaaatttaatggtgtcccaatgattgcataaaatttcacaattggacataagctaacatatggcatatggaatttctgaaccgaatatgttttacagacgaatgctgccatctttcatgcaaggactatcagtccatgatttccttttcacgttaggtaacacatgaatgctgacctatcaaaaacaacatggatgctgaaattttagacattatgtacttcattgtaggaaaaaaaagagcaatcactaatttcttttgaggcaaaaggagtaatcactaataaattttggctgtcatttgtcaagcagacacaaacaaaatgagaaatcctacagatcagcaaacctgcaggtgaacattatatgatgcagaaagccccaaaagcgacaacgctttcattcagatgggagaaaaagaagatgacaaagcttactagaaagaatttgtcctggtcagcagctcaacatgctccgagataagcatatccagttaatatgacacgtgtccggaccctactggctagcaaataaatcattgtcagtgatggaaccagaaaaaaattacagagaagtctgagtaagttaaaaaaaacatataatagcatgttccaaatgattgatttcaacagactttaatcataaatcatgtcctctctccgtactcgtaaagaaaatcgtttatgacaatgtttaagtcaaaccttgaaaatataaatcatgaataactctcgagttattgagtttgaaaatgtaaaaattatatgaatagatttgtcttgaaaaatactttcataaaagtatatatatatcacttttcaataaatatatttatagaaacaagaagtcaaaattgtgttttggagaccgtgtcgctgtccaaaacgacttcatttatgagtacagagggagtatacaattagtatgctacatggagcactcagccactaaattaattgggacatatccttcattcttttgcatcattggcagtttgacatcgtgtggtttaggtagctacaattcgtgtgatgtgttcatcagccttttccccatgaaagcgaaagaacgattagaaccagaagctgtattatgcacatgtctacaacaacattgaatcccatgatttaatggttatctaccagacagctttacattgaatccatattattctggatttttgggcatcctgtctctcaagcaaaggctggtgaggctcttgattgcttccataaagaggcattttttgtagagcttttttagtataagctcatactatgattgatgtaccatggaatgtgtgaattttgatccatatgtttggtcatatgtacagtcatatagctgaagggctcaataaattaataattttatgattattattcaagagtagaaataaatgaattttaactattataaagttgaaaaatggatttaaaacattttttaagaaattcatatgtagaaagtttttgcgaaaattcaagagtagaaattcattctttttcattcatttaaaaagtacacgccctgagaaaaattgcacattttaagagcaactgaaattggggagaaaatccaaaagaagctgaagaatgatatggcaaatgttgatcaatccaatgcacctggactagtttcttcgtgaccatcttttggtgaatgattgcgtacattgagatatgatatatttctgtataatttaaaggtactttttagatcagaggccttcaggcctggcttttatagaaagccaaacacataatttaaaggttgaaaggtaaaaggtgagctaagctaaagtaaatacgcattgcttgttctgttatgaaacactgtcatatatttccctctgttgttattgttcttccaatgattttctgcatcctgcagagattactttgtcgagtctcgactatggagatggtgaattggtgacagatgattcttgttaaacttgcttcttacattaaggatgtgtttagttctcgttaaaattggaagtttaattgaaattggaacgatgtgatggaaaagttagaagtttatgtgtgtagaaaagtttcgatgtgatgaaagagttggaagtttgaataaaaagttgggaactaaaccagacctaactttgttgcccgcataagttcagccttttcagaaatatgttctttgttgtttgttcaattgcaacctgcacgcaaaaataatttgtccgtcttttttccgaggacactgggccttaatgtgaactcagttaacaaaaatgtgatgaattggagttagtgtgacccaagaagccattatgaatgatattaccgctgtacttgcagacttgcacctgaattttggatttgagataggcagagctcctgccattttcctttaaaaaagataaaaggatttgagttgatcgagctgtcagcttcaggcatagttcaaggggaagtaacttttataagttgcttgttcagttctcactaggatttattttttttgttttgaaaataaaaaccgttcttactggtttaccgaaaaccaataaaactagtaaaaaaacgacgactttctatcaacacattatgaaaaccaactaacggtttccatgaaaacggatcggttttctaaagccatcttttcagataatgggaatagttttcgatccctatttaatagcagtagtttcttttgccttatgaccaaggtttactgatacctagttaatagttaattgaccgtactaaccttttatccgtctgtgattcccttcgctataaatcagggcagtaagatattttggccttttttttcaactgtcattttcttcagaccagtaatcaggatcaaatgatcattgtttactagaaacagtccagcatgtcacacacatggttgcctggatttcttgcaagatctttccatgaaaaaaaatgttgatattgcaaggctaatatagaaaaaggcacatagtagaataggctttcagcgtcagtgcatctccatgtgggaccctttctctgccgacatcttgcttttggcaaaatggatagataggaggctcatggttgtcatcaaacctgaagctgtaccttgaaatcaagaatttggattacttacgccgtgtttagttccaaaataattttttaaacttttatcttttccatcacatcaaaactttcgtatacacacaaacttctaacttttttatcacatcgttccaattttagtttgaactaaacatagccttacatgaatacaagtttttttttttactgaattcttactaactctgacgaggcatgtgtgagttcatctagatttggtataacttccatctaaataaatcaaacgactgatatcgttgtttgtagaaattttgtaaagaaaatttacatgtagcttaaaaaaacccatgtgtatttgaagtattcccttctctgcagtcactatcaagtgcaatctgtcatgtaggattatttattcacaaataaaatgggttgtgctataatttttctaggttagtttgtttttgcttgggtcaggatgacagtgactgcagatacagacaatgggagcatgaagattaagagtttaaaaccacatgtgagactcatcatccaatcatgcatatagctgtcaatactgagaaaaatactgtagaaaaatacataaaaattcgcatacgtcaacacctctcaatttgtttctcaaaaaaggagtacaaattgcagccgcctttggagaaaaattctaacaaacaaaacactttaaaaagaaaactctgcaataaggtctagtttgattttctaattttctgatgacatctgagggctacaaaacgatgaatgaactacttcaaacttaaaaagctgttttaaaaatactctaatcacttttaaatctttttcataaaaaaaacatcccgtttacaagtttcgaaagcgtgcccacaataatttataatctataagaggaaaatatttggccctaaatctgcccaaattatttaaccacctgtaacaacttcacatacacactagctcacactaatgctaatttgttaatcattaccagccaaagtttttaaaacgttaattattccttgtaaagagatactccctccgtttcaggttatacgacgttctgactttggtcaaattcaaactactctaagtttgattaattttgtagaaaaaaatagtaatatttacaacactagcagagtttcattaaatatataattgaataaatttttataatatatttatcttaggttaaaaatactattacatttagagtaatttgattttgtccaaagtcaaaacgtcgtaaaccgtaaaatggagggagtacaaaataatgaaatatttactccacgtggcgttatcccattggcttagggcttccaacccaagccaatttctttctcaatctctccctctataaaaataccaaccaaagaggaaaaaatcgctcgaaaaatacaaaaaaaaaagaggagaaataaatcaaacacctctcgcccaccctcccccaccagatgccggccacggcgagcggcggtgcgcggccggaggaggcggcggcctcggcctcgccgccgtcgccgaccgcgtcctactgcatgggcacgaggccggaggagctgacggcgaggctggccgccgccgccggggggcgacccgtcggtggcggcggccgcggccgcggcggaggcggcggaggaggggaggaggagggggagcacgagcgggtgcgcacgctgcgggagatcaagaaccagatcatcgggaaccggaccaagaagctccagtacctccgcctcggcgccgtgcccgccgtcgtggcggcgctcgcggggcccggggcctcccccgccgcgctcgtgcaggccgccgccgccgttgggagcttcgcgtgcggcgtcgacgacggcgtgcgggccgtgctcgccgccggggccgtggcccacctgacgcggctcctcgcccaccccgacgagaaggtagccggtctcttgcttcgcttgcttgctcacttctatggatttccgatttgtatcgggcgtgaaatcttttgttctcgcctagcagaaatttgttttccttttttgtggattaattattcgtctgggagaagatctgttgcgtagaggagacttgctcggaactaagcagacagcaagcaactggttcttgcttgatttcttgggaatcatatggtgtagaatttgggttatgtttgcaatttgggaacaggaaaagttggatggcaactgaattgatactatgaagaattagtgattagattggttaacgatttttctttactgctgatattgtaatttagggtgagaaaaatttactggtgcgatgtgaagagtatttgcttactagtccaatttgccatgaatgcatttttttttactgtgtcatcaatgtgtttggtaaataaggtttagaggtgagtaagaatatgaaaataaatgtggtaattcgatagttgctttgtgaattggttggaaagaaatttgtactagggggatcatgattggtggtttgggttttgcttggaatgaggggaattatttgatctgaactataggctaatctgtcggtttagctaagatgagaggtactggtggttgtcatttctttttccttttcttttttaatgtccttttctctctattttattttaatttttttgattaaagtactgaaggtattgttcaatttatgcttgaaatgtgcagagtttggtagtgggtcaatggttaggtgtagtggtggggatgaatgtgctggaaagttgtctgtttcgtgttagtttcatgatgaatttgtctgaactgataactgaattggctttacagatgtaagcatgaaataagatgtttaaatagcttcctctgggtcatggtaaaactgtagctcatactatatgcttgaactaagagtttggcagtagtgtgatgttttgtgcaatggtttcttggtagggaaattttgtgctgaaatccttattggtttgctgtgtaactggaagttcttgattgccaggtaggatgtgggtgccctttttatttgagatttgaaattgacagttgaaggaaactttaaggaagaaatcttaacactaaacaaagtcatgaggcaattcaaacttgtgattcttccataacaccgaatatcctgaatcactaaagccttctttgtatgagctagaaaagatagttgtatcatcctaacacaatccacatggacttaactcgtaacttgcataggttgtagctcaaaatttggttacccaggtatatctcctagcaactttactggtatagaagtacatggtatagaagtacatattgcataaggatatggtgacaagtcaatgtacaacttcggggaggtatacttacattgttgtcagctactcccagatcagctccagtattttgaagatacagccatgcatacctcaaaccatatgctcattgtgcctttatgccccaattactagttatagctctacctcttccatccctccctattcaattcttactgaccaaacaaggtagccactattaccaccacatcccacatcccactgcctccttccccatgttgcttgtcgcctcccttcagtctctccctttgttgcatcttcaaggtggaggaagtgatgatgaggcatagggcagctgtttgtgttacagaagtgacaattagaaagggggcaaaacatggtagatgggttgaaacaagaaaaagagatgaaacaagtcaagctactttggtagctctctattgtcccatctctaacatccttccctaaccactcttgtcgagttgtcaggcattaattctttcaagatttgctatagcactgttctaaaaggcgttaggcatatacatgcagcagggtggtgtctagttcctacactgactagtcaggctaaacaaatattaggtgctaaccagtatggtgatgcctggggccttttagaacagtgatagtgggatgccaatttatctgaaaaaatgatttgccagttgttattttgctccttatcttgtctagtattgatatttgaaaaaagattgcacattcatattaaggacataaataaccaggaaaggccacaatatacagttattcaaagcagggatactcgctgctttggattaaccagctagcttctgggcttcgctttaacattctgttttggaaacatttataataactaaatgctatcttaagcatctagtttgtacagttgaacttgtaacaatacatgaatgcataagagttcatatccaagcaccctcttcattgaaacatggtgttttggtgctatctgatattctgattattttcatgttatattgaattgtttataaccattaatgcatactatgaataataataataataatatgatctgacccgaggttatattctgattacaggttgttgatgctagtgcacgtgctctgagaatgatttatcaatcgaaactagctccaaagtttgatgtcaacaataatgagaaaaacatggaatttcttcttacccttttgaacagcgagaatgaaaatgtcacagagcttgctgccaatattatatctcactcttgtgatagcactacagaacaattagcactatgtgctgctggagttccgcagagacttgttaaccattttggaggctccatgaatctacgggatgcttgcttagattctttgactgcaatcataagaaataactgggaagttgcttcaagatttgcactgctggaccatggaaaagctttgcgctcaatagttgcattaatacatgatcggagcccacgcacaagactacttgcttgtttgtgcttgattgcgcttagccatgcttctccctgtcactttcaagacagacaaattaaaaccaagttgatcctggtcttacttgagctcatcgaggaacctggtcatgtaggagatgatgctccattggcattgacaaccttgatcaaagacagtgtggaactgcagaagcaagcactctcaacaaacgcagttcagaagttaagcaaccatcttatagcaaattcgttggagtcaaggcgtgcagtgaccatattgcttgctttagctgaactttgctcaaaattggaagaatcaagatctcaacttatgtcagttcaggtacgtgcaggactttgaatggtatattgatcattgctgctctttgccctttgagtaaaattttgtagagttcatctactgttattgttaagcaacttgtgacaagaaaatatactgactccatgggctcctggcgtgtagtagcatgaaaaaggtggattttatgattgtcagttgatcaaacatttgtgactaacaaattaattatgtaacaggcatctaccttaatccttgatgcactgaagcatgcttctgttgatatccgtgttgcagcatgttcatgtcttaagaatatctctaggtcatccaaggtaagacacatactccttatgtatattcagcgttatgtgttcatcttacatgatttgagttgatatgtttaatttcaggtacttagtgctgggaaattatcctgtgatacatttattgccccactagtccagcttttgtatgactcgtctatgtcagttcaggtaatgtaaaattgtgaagcaaccttcagtatcatttttaaggggcaatgaatctgtaattgaaagcatggtttcagaaaccacaaggaactggccagctcctgctggacagcgcatgattctaatagattagggcttctttttttacatgatctggcaagtacttggtggtatatgttgtttggaataaaaaggtcttgagcaattcaatcaagtcgagttatagttctaacttggtcagatttgaccagtaagcgactatctgtccatgtccaagaaattttcaaaaaacaaattttgaaacactgcttggaattgccttccttctttgtagagggttggtcaatgggtttttgaaaggaaaatcttggaagcatggcagcttcctcctttcctgatttctctgcaattttaccttctttctgcccatcatgggctctactgtaattcttctaaagcatcatgttgtactaactgttttcgtgttagattgtaaacctacatatcactaagtaatcaactgtattagtgacttaaaaagtaagatgttaacttaggagaaactcttttggtcgttcatacctaccatggactcattttatttgagcaacctttccacttaagggacactacattagctatattatgattgtgaaacgtcattattttaggtctttaatcccttgggactttgtagaatatctactaaatgtctgtgttcacaaaatggtattacaggttgctgcccttggtgctatttgcaatattgctgtgaatttaacacccaggaaatcgattcttcttcaatctggggctgtctcccagcttgttcatttgtccaagtctatggatccaacattgagattaaaagctgtgtgggctcttaggaatattatgttccttttgaatccaaaggataaagactttattctcaaggaactaactttatctactctttcaagcctcatatgtggtaagtctaaatgtgcagctatgatattaggtcattgctgaatcagccacactgctaatgcaacatttcttgcagattctgaacattttgtccaggaacaaactttggcactggtgcacaatcttgttgatggatatgtgaactcttttaattatgtcattggtgaagatggcatgattttaaatgctatttcaagacaactgaataatgcacctgccccaggagtatgcatacaggtcagtatttcctaaactacattatactgagttaccttatttaaaattgggcaaaaggaacatcttgtctgacaaaaccgtgtaattttagtttcacattctttatcgggatactatttattatcatagttaatcattggcatttctgttacctctcttcagggtatgtttgtgcttgcaaatgttgcagctgggggcgaattaaacaaggaggctgtgatgaatattcttgtacctcgtcgagcagatcgtgtcaaacaatcttttatagttaactttctgctgagcaaggacaaacaattgagagttgcaaccttgtggtgtgttctgaacttgatttatccaaaatgtgaggcctcttctgttcgagttgtcagactccaaaatgctggggtaatttcacaagtaaaaggcatgataaatgatccctgcttggattgcaaggtacctctttgttcttttatttattgagcttgaaaaaacacacgattgtcaatcagcgtcatgattacttcattgctgctgttagatatttatggtccacccatccttgctgctcctgtcacattagcatgcatgagtacttttgttgtcggttcgtagctttatctagcctagcctgatgttgcccactaaattgtatattcttgattgggcaaagaaaatgtcattttacctttgctatgaacaagcatttgacattagcaaatttacacatattgaaatactctataggaaaacaaatagttaaaatctactcctgcaaaattctaagcacacaagcactcgatggcctcaaatgggtttatatataaggatgttgattaaaaccaataaaacaaaaataatgcaagatgacaaacatgtctggtagttggttagcatttgtcggcatatgttcttgaaccttacaaaccttggtttgtgcttaaactaacatcccaaggtgtcccttgtgcagcttagagtacgcatggtgcttgaacactgcttggacaatgccgacgatggtttcatgtgagcagccgccattgcacctcgggccattgaagcttgcagaatcaaacactgcttgagcaaagagaagatggaagattgatctcttcgcatcagcaatccgcgccatgaactgtgaacaatgatcatccagtaaaaaaaagccttcaccgacatcttctcgtcgcctccaagcctgtcattgtaaatttggtgaactccatgaggaccatgactggtttctcttgcagaaacaagcaagaaaccttgttgtaaccatgccacgtcagaaaacctgagctgatttcctccgaaacggaaaaaggttttaggtgctagctctggagaaatttcattccttagcatgaccaaaaacctagtgcttgtgctgtgacgatgagtggtgagtgtataattgagggagatatgctactgctgctgtaaattgtactactctcttgggctatgtttttcacgttcggccatgggacggtgcccagcaagcagtgtgtaatggttttgccgcttgcttttgcttctcaataaagatactactcttgacatgcttctgggtattcctgatcacaatcttgctctcgtcgtgtggccttataagtaaccaaaatttagtttctgaaagttgatagtagtacctatatttttcagccttagcctaattatacatactcctattttactccctccatccacaaaagtttcacctatttcacatttgagtttttccaaataagttgttcctatttatagtttttatgcatttaagacttaaatgaagagataaattaaatgttttattagaactcaagaagtcatctaaatactcattggttgcatgcttttatttacttcttgattttgtagcatccaaggtaatttaatttctccttggtcttggtgtcaaaagtaatatgtgtaatttttgtggatgaagggagtatgttataagtcgctttgactttttctgattaacaaagagattaaactttgttaagtttgactaagtttaatgaaaaataagtaacattttaagaatatattttattattctagcaatcagcattgaatatatttcgatgatatgtttgttttgtgttaaaaatactactatattttttataaacttagttaaatgtaaagaagtttgattaggaaaataattaaaaagacttataatataacacgaagaagtatgtatgtgtatatatatatatatacatatatatatatatatatatgtatgtatatatatatgtatgtatatatatatgtatgtatatatatatgtatatatatatatatatatatatatatatatatatatatatatatatatatatatatatatatatatatatatgtatgtatatatatatatatatatgtatgtatgtatgtatgtatgcgtatgcgcgcgcgcttttttggtaaattattttatgcacgtcgacgaaaaaaaatcttattgctcacgacatgcatgcttgacccaaagattctaaagccacaacgtgccatgtcaagccaaattttgtcaagtcaaatttggtcagagatctagtggcattacccaaagatttaatttatggcattgtcaaaatttaattttcttacacaaaaaataatttagtaaataccaggggtttcttttttttttttgcgtatgctagttatatgatcctgtacgttccgattgccattggttagagcaagtttaatagtatagccaactgcgggctccaaatcatctatagtcaacttaatagccaactcatataacagttacctataaacatatagttcctccgtttcatattataagactttctagcattgcacacattcatatatatgttaat

SEQ ID NO: 73799 - DNA, 2967 bp, Oryza sativa
  unsure (1)..(2967): unsure at all n locations
caaggtatataatttgcacagaattctccatctgcaatccacagtgtcgcgccgccaagcctaccttaacggcgcggttagtcgacgcgcttgacaccgacatcgtctatgctatccaccctaacgtcctatgtgccatctctatactaaccacctcgttgaaaacccgttgtggaccctcagatattcgacgtttcgccgaataaaccgctgcttcctggcctatggtaagtaatttctagaaaaatctctgggggtccaactctccaaatccagtctctctagggtgaggcccgtgggtctgaagccatcaaaaaaaacctagctcgattccatgaccggaaggcacagttatcaacgttttaatttgcaaagaattctccatctgcattccacagtgtcgcgcccgccagcctaacttaacggcgcggttagtcgacgcgcttgacaccgacatcgtctaagctatccaccctaacgtcctatgtgccatccctatactaaccacctcgttgaaaacaagttgtagaccctcagatattcgacgtttcgccgaaacaaccgctgcttcgtggcctatggtaagtaatttcaagaaaaatctctgggggtccaactctcgaaatccagtctctcttgggtgaggcccgtgattctgaagccgtcagaaaaaacctagctcgattccatgaccggaaggcaaagttatcaaggttttaatttgcacagaattctccatctgcattccacagtgtcgcacccgccagcctaacttaacggcgcggttagtcgacgtgcttgacaccgacatcgtctaagctatccaccctaacgtcctatgtgccatctctatactaaccaccgcgttgaaaaccagtcgtggaccctcagatattcgacgtttcgccgaataaacagctgcttcctggcctatggtaagtaatttttagaaaaatctctgggggtccaactctcaaaatctagtctctcttgggtgaggcccgtgattctgcggccatcaaaaaaaacctagctcgattcaatgaccggaaggcaaagttatcaaggttttaatttgcacagaattctccatctgcattccacagtgtcgcgcccgccagcataccttaacggcgcggttagtcgacgcgcttgacaccgacatcgtctaacctatacaccctaacgtcctatgtgccatccctatactaaccacctcgttgaaaaccagttgtggaccgtcagatattcaatgtttcgtcgtaccgaccgctgcttcgtggcctatggtaagtcatttctagaaaaatctctgggggtccacctctccaaatacagtctctcaagggtgaagcccgtgattctgcagccgtaaaaaaaaacctagctcgattcaatgaccggaaggcaaagttatcaaggttttaatttgcacagaattctccatctgcattccacagtgtcgcgcccgccagcctaccttaacggcgcggttagtcgacgcgcttgacaacgacatcgtctatgctatccaccctaacgtcctatgtgccatctctatactaaccacctcgttgaaaacccgttgtggaccctcagatattcgacgtttcgccgaataagtcgctgcttcctggcctatggtaagtaatttctagaaaaaactctgggggtccaactctcaaaatctagtctctctagggtgaggcccattattaagcagccgtcaaaaaaaacctagctcgattccatgaccggaaggcaaagttatcaaggttttaatttgcacagaattctccatctgcattccagtgtcgcgcccgccagcctaccataacggcgcggttagtcgacgcgcttgacaccgacatcgtctaagctatccaccttaacgtcctatgtgccttccctatactaaccacctcgttgaaaaccagttgtggaccctcagatattcgacgtttcgccgaaacaaccgctgcttcgtggcctatggtaagtaatttctagaaaaatctctaggggtccaactctccaaatccagtctctctatggtgaggcccgtgattctgcagccgtcaaaaaaaacctagctcgattcaatgaccggaaggcaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatccctatactaaccacctcgttgaaaaccagttgtggaccctcagatattcgacgtttcgccgaaacaaccgctgcttcgtggcctatggtaagtaatttctagaaaaatctctgggggtccaactctccaaatctagtatctctagggtgaggcccgtgattctgcagccgtcaaaaaaaacaaagctcgattccatgaccggaaggcaaagttatcaaggttttaatttgcacagaattctccatctgcattccacagtgtcgtgcccgccaggctaccttaacgacgcggttagtcgacgcgcttgacaccgacatcgtctatgctatccaccctaatgtcctatgtgccatccctatactaaccacctcgttgaaaaccagttgtggaccctcagatattcgacgtttcgccgaaacaaccgctgcttcatggcctatggtaagtaatttctagaaaaatctctggggttccaactctccaaatctagtctctctagggtgaggcccgtgattctgcagccataaaaaaaaacctagctcgatttcatgaccggaaggcaaagttatcaaggtttttatttggcacagaattcttcatctgcattccacagtgttgggcgcgtcagcctaccttaacgggcgggttgtcgacgggcttgacacccacatcggnttaagttttcaccctaacgtgctatgtgcg

SEQ ID NO: 73800 - DNA, 7483 bp, Oryza sativa
aaccttaacgggcgcggttagtcaacgcgcttgccaccgacatcgtttaacctatacaccctaacgtcttatgtgccatcccctatactaaccacctcgttgaaaaccagttgtggaccctcagatattcgacgtttcgccgaaacaaccgctgcttcgtggcctatggtaagtaatttcaagaaaaatctctgggggtccaactctccaaatccagtctctctatggtgaggcccgtgattctgcagccgtcaaaaaaaaacctagctcgattcaatgaccggaaggcaaagttatcaaggttttaatttgcacagaattctccatctgcattccatagtgtcgcgcccgccagcctaccttaacagcacggttagtcgacgcgcttgacaccgacatcgtctaagctatccaccctaacgtcctatgtgccatccctatactaatcacctcgttgaaaaccagttgtggaccctcagatattcgacgtttcgtcgaaacaaccgctgcttcgtggcctatggtaagtaatttatagaaaaatctctgggggtccaactctcaaaatctagtctctctagggtgaggcccgtgaatctgcagccgtcaaaaaaaacctagctcgattacatgaccggaaggcaaagttatcaaggttttaatttgcacagaattctccatctgcattccacagtgtcgcgcccgccagcctaccttaacggcgcggttagtcgacgcgcttgacaacgacatcgtctatgctatccaccctaacgtcctatgtgccatctctatactaaccacctcgttgaaaacccgttgtggaccctcatatattcgacgtttcgccgaataaaccgctgcttcctggcctatggtaagtaatttctagaaaaatctctaggggtccaactctcaaaatctagtctctctagggtgaggcccgtgaatctgcagccgtaaaaaaaaacctagctcgattacatgaccggatgacggaaggcaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatctctatactaaccacctcgttgaaaacccgttgtggaccctcagatattcgacgtttcgccgaataaaccgctgcttcctggcctatggtaagtaatttctagaaaaatctctgggggtccaactctccaaatccagtctctctagggtgaggcccgtgggtctgaagccatcaaaaaaaacctagctcgattccatgaccggaaggcacagttatcaaggttttaatttgcacagaattctccatctgcattccacactgtcgcgcccgccagcctaccttaacggcgcggttagtcgacgcgcttgacactgacatcgtctaagctatacaccctaacgtcctatgtgccttccctatactaaccacctcgttgaaaaccagttgtcgaccctcagatattcgacgtttcgccgaaacaaccgctgctgcgtgtcctatggtaagtaatttctagaaaaatctctgggggtccaactctccaaatccagtctctcttctgtgaggcccgtgattctgcagccgtcaaaaaaaacctagcttgataccatgaccggaaggcaaagttatcaaggttttaattttcacagaattctccatctgcattccacagtgtcgcgcccgccagcctaccttaacggcgcggatagtcgacgcgcttgacaccgacatcttctaagctatccaccctaacgtcctatgtgccatccctatactaaccacctcgttgaaaaccggttgtggacccttagatattcgacgtttcgccgaaacaaccgctgcttcgtggcctatggtaagtaatttctagaaaaatctctgggggtccaattgtcacgccctgataaattcatcccgaaataaaaatcattttctaaaaggaataatagagttaattaaaattcgaaaagaaattggcaaacactaaaatacgtacaagaaaaattcaaatgtggcccggagaatttttgttaaattctccttgttctaaaaggagccctcaaaatttacttgaattttcagagcaccgaaaatatttattaaacaacaacaacaattaacaaagtttattaaaaagaaaaagctaaaaataaatcctccttcctcctttgggccaagcccagcaaaagtctccctctcctccctctctttccctcctctcccgggcctgtcctcctcctcccggcccactcttcccctccccctctcggcccactccctcctcctccctctccctcccgggctgcctctccctcctctcctcctgggccgcctcggcttcgcccggcccaagccgagccgcgcctcccacccatgccgcgcacgtgcgcgtgcgtgcgcgccgttgccgcgcgttgaccgcgcgcctgcgtggggcccacgcgccaggtcgtcgttctcctcccgcccggcctcctcctctctcctccgtgaaccctagccatttcctccctcaaatccgcttgattcatttggctaattccaaaattgattagggggttttaatccccattgattcctcttcaattccccccaatttcccccttgattcgtgcccccaatcgtcgggaacagacgcgtcttccccagccgctttccatggccgccggccgccaattccgccaccgttccccgctcctcccgtgctcggctcccttccctccgctataaaacggaatccactcgctccgttctatcgttttagccccctcccgcgatctcccgtggtccctagccacctccccgccgtcgtcccctctcccgtgccgccggccgtcttcagccgcccctgccgccgcgttagcacgccggccagctgtgccgtcgcctcctccagcgtcgcagccgcctcctctccgccggccttccctctgtttcccgcgaagacctccggaagtgcatccccgccggcaacagtggcgttgccaccactgttccgcctccggccgcctctgccgcgtcccctgtgcgccggccgacgtcgccaccacctctcccggcaccggaacgccatcctcttccccggccaagccacggcatcgcccgtatttcgccggaacgccgttgcgcgcgccgcctctccctcggtctcgtcggcacccactccggcagccccttttgccgtgccagtgcgccggccgacgtcgccgtctccacctccggcatcgcagcggcaaggtcgccctcggcctcgtctccccttcgaccgaacccctccgcggtccatcctcgtcatctctattcgttctcgtcgtcgacgtcccgtcggtcgcccggctcgtcgtctcgcggcgccgcctccgtcgtcggcatcgcagtggcgtgttccacgccatcctcgtcttcgtgcagccgctgtaggctgcccacgtcgcctcctcgccggccccggtcgtcgtcgtcgtcgccctctcgtcgttcccggttgtcgtggcgttcgtccctccgtcaagccattctcgttcgtcgtcctcgcttcgtcaagtgccgcagccccatcatcgtcttcgtcctcgcctccgcgtcgtcaagcctcgtgccggccgtgtctcgccttcgttcaaggatcgccgctgaagtcgttcccttgccatccgtctccgccgcgcccgttcgtcgttgtctttcccacgcctcgtcgcgtggtggtaaggatctctcctctcgctgccccgtcctcgtcctttcggtgtcgccccgtacccgttgtgcggttgtcgaccccggtacccgtgtaccggtgtcggtagtcgttcacgtgtgcgggtggtgaccgtgtagtgtccgtgttagtgtgtccgctcagtagccgcgtggtttccacgtgtgcagcccgtgtggtgtctagtggagtccgtttgtcggccactcgcctcggttgacacacggggtccgcttccgtcgacccgtggaccgtctccgtgtactcggtctaccgcggtcctttaggttgacatgtggggtccgcatgtcaacagcgcagccttcctgtcttttccaggctagcgcttccacatgttttatagttgcaaagcttaattataataatccgcaaatctccatataacagcattaaacttcggatgatcatatcttggtcatacgagctccgaatcgacctgttcaagtctcttaatgtttgttataacctaaagaaccgtgtgctttctttttatatattgttattgcttctttataggcttgtagctttgcttgtgtgcttcgcgtagcttctgtcgttccggaggttcccgaagcgtggttcgcggccgtcgccgaaggttcggaaggccgttctctctgagcaaggcaagtcacatcatccttgaacatattgaatcccagtttataaaattattctgatttaaattattgcattatcgctttatttaaatccccgcgttatcactgttttatctagccatgcctatttacctttgttatgaccttattattgttgttattgttattattaccttgttcaccctaggataaacaaaaccccaactagtgggtactctattcatggttccactagtatgaatttaggtagatgcttcgctgattaattaggcaatattaggtggttttataactttagactttgggaattctcatatcatttggacactatagaatagttggcttatgttggaattggacacacacctccccctctattcaaaacccccaaaatggttttaggctgggctcgaggtgcgtggttgggtttggttagtcgtacctcgggtactataaggattaagctcgggcctctgttgcaaagcactaccgtacttccatatgtctagtgggtaaggcttagtttgtggctcagtctggttataaacaaaagtacacggatggagatggacgaagtcgggggtcgatggacatctctaggacaaatgaaggctacatgagctgtggctcggtagtcgagatgtcatggcacagggctggtgtcctgctgctaggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttttgggtaaagatgtacacctctgatcagagtataatctattcgaatagccgcgccctcggttatgggcaagcctagcaatgtacccaagttagtgttttagttcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggcaactaagtgacttttaaatgctgttttctacaaaacttaacccctatattattaccccttgtacccccttgcattaatcatgcatccaccggtgtggcttgctgagtactgtggttgtactcattcttgctcaatctttccccccccccttcagtaagagaagctttggagaagaagtcttaggtggagtcctggcttataccccagttgagcgcctgtgaagatggagccgtatgcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaatgtatttttctcggtcgcgacaccaactctccaaatccaatctctttagggtgaggcccgtgattctgcagccgtcaaaaaaaacctagctcgattccatgaccggaaggcaaagttatcaaggttttaatttgcacagaattctccatctgcattccatagtgtcgcgcccgccagcctaccttaacggcgcggttagtcgacacgcttgacaccgacatcatctaagctatccaccctaacgtcctatgtgccatcccaatactaaccacctcgttgaaaaccagttgtggaccctcagatattcgacgtttcgccgaaacaaccgctgcttcgtggcctatggtaagtaatttctagaaaaatctctgggggtccaactctccaaatccggtctctcttcggtgaggcccgtgattctgaagccatcaaaaaaaacctagctcgattccatgaccggaaggcaaagttatcatggttttaatttgcacataattctccatctgcattccacagtgtcgcgcccgccagcctaacttaacggcgcggttagtcgacgcgcttgacaccgacattgtctaagctatccaccctaacgtcctatgtgccatccctatactaaccacctcgttgaaaaccagttgtggaccctcagatattcgacgtttcgccgaaacaaccgctgcttcgtggcctatggtatgtaatttctagaaaaatctctgggggtccaactctccaaatccagtgtctctagggtgaggcccgtgattatgcagccgtcaaaagaaacctagctcgattccatgaccggaaggcaaagttatcaaggttttaatttgcacagaattctccatctgcattccagtgtcgcgcccgccagcctaccttaacggcacggttagtcgacgcgtttgacaccgacatcgtctaagctatccaccctaacgtcctatgttccatccctgtactaaccacctcgttgaaaaccagttgtggaccctcatatattcacatcattcactcaggtttacatctcaacgttttttttgcaactaatgtggcatctgaaaattgagtttctttgcatctaaattttagagtagtttagaaatttatattgtatcctctctgttttatttacaaaaatgagtagtttttggtttttagagcagaaatctagctgcaatgttcacaaaaatgtaaagagagattaaaggggaacacaaccaacttccgggatccgcaacagcacgcgcgttgcgatgattgtgcctgcagtcaggtccctaatccgccgaccttagctatgtgattcatttttgtgttgctgtcatcagtgtttcacttgttctgtaggccgctcgcgaagtacacactggagttgtgtgtgtctacgccgccgccggtggccgctgcggccatgaaggagtgtgtgcttgatgagtacgccaccaagcacaggatcttcatcgataggtttctccagcttaggat

SEQ ID NO: 73801 - DNA, 857 bp, Oryza sativa
ccacataccaccacggtatacagacggaagacgtgacatagtttccaacccatcctagccatagacaagagtaccgacccaatcccacctacggccggaacccccggacaggcaggcaggactgagcccctagcagcaggacaccggccctgtgccatgacatctcgactaccgggccacagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccatttgtcacaccctgaaaattcaaaatatatatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatcccttctctctcctcagcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggggtgcaggaat

SEQ ID NO: 73802 - DNA, 5437 bp, Oryza sativa
agtatggtgctttccgtttgactgcaagtcgttcatcatcgacgacggcgagcgacggaggacgatggcgacggcgggacgagctccggaacctcctaacgaacaaaaggagaggggttagagggagagaggagagtgcgagagggcgagggcgccggccgaaggcggcggccatggcgtcactcaccggcgcacgacggggatggggctccggcggcgaacctcgacggaggaggggtggacgaggtggacctcggccgcgcgaacccaacggcggcgacggcgcggtgcggcggcgagtgtagcggcggctagaggcgaccggagtagcgggagaggcggcggcggatgggcgcacggcgcgggagcaatggagggcacgggagagagcggtggaaaaagaaaaaaggtggaggggagtgcgggcatgctttataggggctcgggagagacggacgtgtccgaggcgagcccgatttcgccggcgacgtgggaggttgaaggtgggggagagagagagagcggcgtgattcaaatttgaatcccggccatctcggttgagggcgcggcgagacagagagggggagtgggtccggaaggcgcggcgcacgcacgggcgtggccgacgtggaccggagaaggcggggtgcggcggtttcggcagcggtggcaacgtgggcggccggccggaggttgggaaagggcccgacaggtgggccccacctgtcggcgaccctggggagaggagggaggcggccggcctggctgggcctcggcttgcggcccgcccagcagggaggagggggaggaaggagagaatgggccggcggcccattcgaaaaaagaagaaaaagggaggaaaaagaaaaggaaaaaggaaaaaggattttccctggaattaaaatattgcttgctcaattttaattggttaaaattatttctagagctctgaaaattccactaaaaatcctgttagtgaatttcgacatgtagaactcaagaaaaattccacatgcccattccgattattatttgcattactttcttagggttttctcttgattgcacctgcatttttttggggtcgtttataaactaaattttaggcttgggaggagaacttcggggtgtgacaccaagccgcccctccctctctccccgggacgccgacaggtgggccccacctgtcggacccgtccccttcctctagccggcgccgccgcgcccgaaaccgccgccgcagcgcccccgcctccgcctcctccgggccacgtcgcccacacccgcgtgtgcgctgcgtcccccgcgcccactcccctctctctcccgcccgcgcccgcgcccgagatggccgggattcgattttcgaatcccgcctctctctcctcccccactccccacgttggccggcgaaatctcgcctctcccggccatgtccggccctcccctcccctatttaggcttccccgtcgccccctttcgctttttccccatctcgccgaactccctcgtgctccccatcactcccgcgccgtgcaaccacccgccgccgccgtttccgctactccggccgccgctagccgccgctagggtcgccgccgcactgcgccgtcgccgccgtcaggttcacgaggctaagctccaccccggccaccccttgcccgtcgagtttcgtcgccagaatttgcatcccctcgcgctccggtgagttcaacccctaccgccgccttcggccatacgcgccggtcgccgtggttcatctccctccctctaatctctctcttctccttccttagggcaccccgaatcccttccgccggtggccgtcgtcctcccgtggctcgccatcgccgttcgccatcgtcttcctccgcgccggccaccctcggtgaggcatcctctcccttctattcccctccctctccctcttagccgccgctttagcgccgccgcccattagccgtcgctttagcaccaccgcccgtcggcgccgcctttgcgccgccgtctccgccgccggttgccgtcgccggcaacgcgtgtgcgcgcgccgtcgccgtcgccgtggccgcttggccggtcttgagccgagctgggtcgccaccgcccgtccgatcggccccgagggcgatctgggccttcggtcccgtggactggcggtggaccacccgcgtggtcccggtccacggtgaaccgccctcccccttgtgccgctgaccggtggggcccgcttgccggcgccgcccccccccccctttgatgacgtcagcaaccatctttttctttggaaaaataaataataattgcgtcataattcgttaataattctagaaattcatttaaatggctcaaaacttctaaaattcatatctaattcattcgaactccgaattgagccattcaacttgtaaattcatctaaaattgagctctacatgtttgtttagtttttatgtactgtttccttggtttttattagagtttttcctcgttttgcgtgccagcgtgtagaatccgtcgtttcggaagatcgcggtcgcaaggataagagttcggaagatcaaagtgaagaagcaaggtaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgatgggataattacagtattagaccttttaatatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagaggggattatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatacactgtagttcaggtgggttggttgggcctgttcaatgtggtgtagcgttgatcaatggagattcaatattactttaattactcaacagttttactgttttgctcaataaaatgttttacaacctcctttatgcaaatagccacaaaccatccttgtatccccttgcacatctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttatgtttggaactgtatattacttgtcgttttgtgtaccctggctggtcctggacagggatttaatacgcaaaatagtctggaaatttgggttaaatttctgggcgtggcaaagtggtatcagagccaacttgactgtaggttgagccaaatggtcaaaccctaaggacaagttttctgaaaaccctatttgcaaattgtctcctctcgcccttcggcatttctttgtcaaacggttttcaaaattctcctcccaatctctccaattcttttagttgtcacacctagaggaccagccgtcagcttcatgtctgttcagaagtcaagtcaagtcaaatctcaagcttcgcgcagaaggagcaagaagatcagcccagagtcgtcgtcccgcgaagatcaagtgaagtttccccggagctgacccaaacccaatccttcccagaagagtagttccgttagctttctagatcgtgtgttgtttgcttgtgtgtaggggtatggtttgcatcattggtggggatgcgaccatactaggttgtttgcttaaacaacttgaatcataaaatccattcaccacagatcaataggcaagtggtttagtacctcatctttagtaacccctctcatctccccctccctctcttgtgcccgcagcaattggtcagcatgagggacaatttcaacggatcaggatcccatcagtttcatggatcaactcagctcaattctaatagtattccacgtcagcctcttgaagatcagcctcaaccccaagtcatggctaatcaaactcagatagtggaagagttgttacaacagatgcgacgtcggtaccaaatataccagatgcaacagatgcaacgacaatgtcaggagtcacgtcaatgtcacccaccgcaggtgcgagatcagatgccagcccggaacccgaatcagagtcagagtcaggagttcccaatatcagcaccgaagacccctgtcaaaatgcagtccagatccccgaagataacgacagccaagtcaacgtcagaccaaaggacagtaagtgctacctgttatgactgtggtgagcaaggtcattatgtaaggaactgtccatggaaggtgttcgccaggtcacctgaaaaagacgagaagtagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacaatgacgacaacgatgatgataatgatgacaatgatgatgcgacccttgactgtttcagggaaagagagtgaagttcaaagcatgtgctagatgtgggatagtcggacacactgctagctattgcctccccacatgccgctgtggtgaatatacccattactcaga

SEQ ID NO: 73803 - DNA, 1170 bp, Oryza sativa
  unsure (1)..(1170): unsure at all n locations
tcgatttccgacgcgggcaaggcatgtataaatatggtattttgatcttgaactgaggtcctccaaggaggtattgacggcggcggaaattgaatccatcgaacatgtcgaggcggaaattgaatccatcgaacatgtcgagactgatcttcccggctagattggatccgagtcgaagagcaagagcatgttgaagtggtcggcgaaaaaaactcccgaagcgaagatgaattcggtgactcatgaagttgattccatcgcacttgtcgacaggtaactcgacgcaacccctacctggcgcgtcaactgtcgaaacaaattttcggcaatatgaaaagggggtagagcacgagacctaaaagtggatggatgtggagacaaaggatttagacaggttcaggccctctcgatgagaggtaataccctactcctgtttggggatttgaatccgccgggtgtatattgatctgacgatcagtttgtgtcatgtcccctagagggcttcctgcccaccttatataggatggggggcaagattacaagatagaaaccttaaccaatacggtatcggtttcctaaatctattttacaatattatcaaatcaggactttaggccgctccataatataaaaggaaacgtaatacccaagtcatgatcagttacatattccatagatataagctatcccctatgactaatcggataaccatgccgtgtgggtatggggtacccataatctccacagtagcccctgagaccttcacagtcgtaaagataatcttttcttgaactagattacttcaaagccgagtgcttcaatcatctccgccatgatctcccgagtgcttttaccaaatatgaagactgtggagggctaaaaaataaagtcaggtgcatcgaatagatgtacctaatagatgcaccaactgagtggttttgataattgtagtcaaccaagcgacttgatattaatatgtagcatatgcggtgtgaatccttgaacgacatgatccgagtgatataccgactgctttgtaaaatatgatgagtgtaacctaaagttggctacattattgaaaattcacatagcaaaacagctataaagaagcttgaatgccgtgaatatgatgagctncttgcagagngcgccagtcaatcaaggggcgcg

SEQ ID NO: 73804 - DNA, 8089 bp, Oryza sativa
ctgagatattggtagttcacttaaaaaggttctcatacagccggtttatgaagaacaagcttgatacctttgtcaactttccaatccatgatcttgatatgagtagatatgcaaatcactcaagaggtgatcagccccccatttatgaactctatgcagtgatcaatcattacggcggaatgggtggtggtcactactctgcgtatgcaaaggtactttttgggctaagttttcctaggccttgcatatccttttaacttagtaggtgtttcctgttggttgctgaattccttttgctgtacattttgtatctgcagttagtagaagaggacagttggtatcattttgatgatagccacgtttcatctgttggcgaagaggacatcaggacatcctcagcttatctcctgttctatcggcgagttggtagcagctcctgcagtgtgtctaaaaatgttgcagtggacactgatatggttgattcgctggacacatagatttgaaggcgagaattcagtatggcatagttttctgggcaatacatatgctgctgagaagattgctaggactcttatttgctggttttgggcactgagtattggtttatggtaggtccatccaaccgtggaggttttgagggtgcagcatctcgttagcatcatcttccaatatgttacaaccattctcatgcagattagggcttccaatatctcctgtcttgcccttttagcgaatcgttgaaatgttgccggctatatgtttactaaaacttcctttgccgatatgctgatgtacagcagcaggtcttgttaatttacgtgatcttattgttgtggttggatgggtggtggaaaattggtactgcaactagctgcgtcagaaccagagaaaaagccaatgtactgcatttttgcttgctgagctacatctactcatgttcttattttactggaatcatatctgctacatactataggtcttgacgatatattgattttctaatacactattcgattcataaccaatatactatgctgtggccatgtatcgtgttgtgagcaaatcaatcccttgaattgcctacttggctatctaaaatgatcacatatattagaaatctgacttgttttaattggttaattaatgtctgcaattgtttccatttgtccaactttgatttgggataaccacgatcttatcctggtgacgtacgtttttttggctattgctattctccccctgtaatatccattgtttatgctgtatctatcagctatcaattgggattggctatcaaataccaatgctaaacggaacaagtcagaaactataattcttgttgcgtcggcaaatgtagtttggttttttttcgaaccaagcttcaacatgaattggatcattattcgctaactggtgaaatgcatattgcagcaaatgcagtttttttatataagaaacgaaaattaatttaaatcctacaagagccacttggacatactttgagccaagtatctgagattcaactatgtaggatcacacacaatgtcaatgtcaaattggatgaagggccatagtcaatagtgactgcgaagttcaacgacatacttgtcctctgtttaaaaatacagaattataagatgcagccaaatttgtcttgcatggtgtggttaattgtttagaaactatctggttctacttctacctctgtttgaagttatatgatactgttaactttttgcataacgtttgatcattagtcctagtcaaaatatatatataaatattactttttagttgacttgttttatcatcaaagaaaccacaatcttaactcatacctttacatattaatactaaatttttaatttttaaataagatggataatcaaacgttttgcaaaaagtcaacagtatcatacattttgggaggggagctagtaagacgtaatcttgtcctccttcattggaatatatttacaaccttttgaatgcgttatccgtgtgacatttactgaattatttataaattcttcggtttgcttctgaccaaaacaccattagctgtgagaatgggatagtttcattcctttctagagtttttgcagtcattttcattctcccatggaaatagtaaaatatgttattgatatcgtaagtacaatccaccgtttaaaatatatatcattggatctttccatgattgtcattctaaaagataatattgtttttcaacggttcctcaaggtctgctcatagccgcctagcctcatagcttgaattagataaagactattggcacttttatactaaagcaaaaataatggaagatgaattttatatcctggcatcaggagactttatattcgttccataaaaaactacaatttacaagacgggtagactaataaacaatagtagaatctgacaagaaaatagtctagtatgatcagatccgaacgaagaaaagaaattcagaatgtataaaatatattgagggtacatcttacacgtttgaatcttcctgttgccggatttaatatttagtacttgcaagcaactaataaaagttggctattagaaaaaaaaaagctgcaaactgcaattgccgattaatttgatatattaatactgttgttgcaccagcattgtcaagcaagctttgcctggccatgcattaatttgacaaacaccataaattgatttgagtgactagcttttggaaaagtgatgctgtcattcagaaagaaattaaatccaggttggagtttctctgcttctattgcaagtcaccgctcatgcaaaacagagtgcggcttcttgggattctccgggttaagcaaccgaaatgtgtttgatatgtgtctatactgctgtgcttcgaaaaagaaatatgttgtttctggaaaccggcaatacaagttccatcatctattcctattgcagtatcataaaactcgatttaataagtcaaagctgatttaaaaaataataattttaggtagaagtctttgcttgtctcctcagcaatcatgaaacatagttggcacacatggcatctaaattttagacagacattgacattcaaaatttcgatcatacatttagaaatttggatcataattttagagatagtggcccatgtgaaatcgaaaatttagaaataaaagacaattatttgactagttgtatatacgcttatcctatgcattctagagagggacaaagagagaaaaaaagtctcgctttttccacgcgcatatatacttcccgaatagctaattgatacttttcttttaaatttttttatacaaaagttactttaaaaaatcacattaatccatattttaagcttaaaataattaatactaaactaatcatgatatgctaatggctcatctcgttttgcatgtcttgttaattttctccaaccccctcctttcaaacactctataacatgtgttccgagaaggccaggccatcaatttgctaatatgatcacttaatgaaggacggcagacgcacacggttgtggcgagaagaggaacttcttggacgcctcagaagccacacaagactaagctgtccacgtcattgtcatgtaaagctcaggatctagctaggtgtttctgtgacctgttctgttgtgtggccacaaggccaaacatgccatcaattcatgcgtcacaattgaagatgtgtgattgatcatgggtgaaatggtacacggggcggcaacgagaggaaaggactgaagttgaccttgttggaattggccgccatgagacctgatgcaaattcgttagaccaagaggtaagatttgaatttgcacacatgagacttgatgcaatgggttccatgaaaatggaaagtgagcatgtgcgaagattcgatccaagtattcatcaacccgtagatcgatctgcatcggtagtattctttgtatccattttgcatatctgtgttggagtttattcaacttaatataatcttaagttcttagcctaaacatgatcacctcttactcatgcggaattcaatcgatctactaacctttgatgtgaagccattgaagccagtcgtcaattccctttcttactgttcttccttatctatttcttcttttccgtaaaaaactatgggttaggaactggaaatagttgtatccgtccttatgtcccatattataaaatatatgtcaattatattataatttcacctataaacatgataaaagattagttaatcactatttttatgagctcacatgtaatattatataatttgttccttgatgtatctcttttagcactttaattatcttcttaattagtattaaatatctatgagttagagatacaaataaatatccgttccctaatccgattcaaagaaaataatatgagagataggatacgagatgagtgacatgttatccgatactaccagtatccggttccgaatttaaaggaagagatgggttaggatatgagaatgttgtgatctgacactaccggtactcgggccgatttcacctctagccctggcctactacttgccatggggcagaaatatccattccaaatttttatctctccaatgaatatctgttggatattctagtaggttagattgttagtatattccttttccttgttaatttgagtatttcagaaatttcttattcatgcagatatttctagccccttttgtcagtctataattaacgtgaaggcctacataataaaaaaacgtttggtatagagatgactaaagatgatgtttaattacgttagcaaatacacttttctattaatttgcaacatctgatttatgacaatcggttatgctttcaaataaaaataaaaataaatacatgacatgtgggtcaggatagcatatctcaaactttgcaaaattataatggcatggttccaaattacccttcaaataaagccataggtgcctgcgcttcagctttattaattgagcttttccactgttattagagaggaactgcgagccatgcctcttaaaattaagttgtgcccatagacaagactgaattcttatgccttgtacagagccataacatttaaattattgtgttaagttcaatggtaaaattttgtttgttgagcacttcgatattgaaataaatatttttaagacagtgaataacatggactctgctttgacagattgaagttatagtcacttattataaagtttttggctcaatcatttgaccaattgtaaatgacagaatcaaaggatgacgagaagacacaagtttaaaacacatctacacaaaaagagagatacatcttatttgagtagctaacctatttagtaaatgttcatataaagttggcgcagatctgcatgagcattatactacagattcttatatgcaatgtgtatgacttctttgtacttatcacacctttatagtttgcctaaaaactatgtcaatatattaccctaaaaggtaaatctatattacttaaaatgttagtagtggtagtgtccattttcacacccaccctgtcactgacatgtgggtctcataatttatactattacgtacatcaccatttaatgagtcatctcctgttttataattgactcttcccaaatttcaaaaccacctatatgttcaataaggaaaatcataatatttcttgaactaagtgcttaataattgatttaataaggtagaaacactacttaaaaaaagcccatagagatcggcactataggtgccagaattaactaaaaccggcacctataatgccttttcctcctccgtgggttgaaaacatataaaaccgatgcctttaagcaattataggtgccggttttactttaaaaccggcacctattataggtgtcggttaattaaaaaccagcaccaataataaattataggtgtcgttttttttttaaaaaatggcacctatccaaaccgagccgagctgccgagccgatccaggccgatgcattggccttatcctataagtcaaccttatcatctctatctctctctcgcctctctcgtcttctttcgcgcacacggcggaggcagtagcagtggcggtcgtgccctcccctccgctggatccggctggaggggaggcggcgggcaatgggtggcggtggtgcccgaggaggtaggcggcggcgcaagaggggaggcggcgggcgacgggaggcggcgacgccctcccctccgccggatccggcaggaggggaggcaggaggtggcgggcgacgggttgcggcagcgccctccgctccctcagatctggccagccgtcgtcgccacttgccgctgccgtccgccaccctccagcgctaccgtccgctgccaccgcccaccgcccaccgctaccgtctgcttggagcgccatcgcctggatctgcgtcgccgctccctccgtcctccttcaccgccgccgctccctccagcgcccgctcgcccgccagccaacgccgacgccgttgggcccgttgccaagaggttctcctctcctctcccctcccctacaagctttgagaaaatatttgattgccccaagattttgagcattgtaatgtctgtgttgtgaaatggtggattcttataaattagcatttggtcatttaggatgaaatgctgatgcaatttaagaataattttgcaaatctagctcacgaattgtaggtagcagctgttgtaggataattgacctctctttgcattttttttttgattggcctctcttctgcatcgacacagtcctccaccgccgttgccctccgacgccgtcctcctcccactgtccaccctccctcctggtcaccaacaccgtcgtgttcttctgcgtcgactccggtcaccaacacaaggtgatcgatcttgcctgatgctgtaattatgtattataacatatgcttgcctggctgatcgatctttgtggtccagattaattggggagccgctctttgatcatttgatatgtgtgtgttttgaaatggggaaattttggtaaattcttgttctgaaatgtatgctgaacttgatcttttcaggaaagattaattgtaaattatgagttgttgtgttgatggataggagtagcagaagatgagttgtgaatatcctattagtattaatagaaatgagtcactggagaggaggggttaaaatgcttttgtgtagctttgggaaagttaatatagaacttgatgcaatctgaaatctgaacttgatggtgcagttttgtatatgccatgaacctgtgtattccatgaatttgaaacaatatgaggatgctagaatgcagtaaacctggaaattttcttttcatgacgtagacctgttacaaatatcaatattacttgattgcaatttttagaatcatagaatagggtatgtttttgctgaatgacagttggacagctgccccatatttattttgtgatgtaatctgaaatctgaaaaatgtgaaggatgtggatgtgcaagatgtgaatgtaatattctgtgacttgtgtggaggatgtggatgtggaggatgcgaatataatattgtgtcatttttgtgtttcaggatatatttctgttgcgctatttattttttttggcttttattagtataggtgccggttctttattgacacctatgtggtgagtacaaagtgttggcctttaccccttgtaggttccgattatttgcaggaaccggcacttatagtaccatataggtgtcggttctgatggtataaccgacacttataatattataggtgcccaatgattttgatcattggtgccgaccaaaaggtgtcggatccaaaaccgacacctattaggccttaagaaccggcactaatgggtatttttgtaacgcacaggctattggctagtgcatataaaatttagttgggactttataaaaagcctctacaatttctacttagccatacaaactaacataaagagaatgctcgtactataatactacctccgttttttaataaatgacgccgttgactttttctcacatgtttgaccattcgtcttattcaaaaaatttacgtaattat

SEQ ID NO: 73805 - DNA, 12196 bp, Oryza sativa
cgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggaatttattagagtaaaagccttttcttttccgttggtcgtgtagacgctgcagcttcggaagatccgctcttcgtggaagtcgaagccgtcggttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttgtgaccatattattattgttattgttattattattaccttgttcaccctagattaaacaaaacctcaactagtggacactctactcgtagtatccctagtttaaatttagatagatgcttcgcaatttaattaggtaacattaggtggtttacaactatagactttgggaaatattcatatcacctggacactgtggaattgttggatcattgtggaattggcttcacaccgccccctccattcaaaatccccaaaaatggttttaggctgggttcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcaggattgggtcggtactcttgtttatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataactttgtatagttctaggatcgcgtttacaaaatagccctgagcaactaaatgtctttaaatgctgtttactgcaaccctaaccctttacattataattcccttgtactcctttgcatttattctgcatttgtgggtgtgtcttgttgagtacggtggttgtactcagtcttgctcaatttttcccaagtccagaagaggagttccttgaagatgaaggtttcggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgatttgtatcaacttatggtgtaccttgcctcctgggacaaggattaatgcacacacgtcaggaaagcccgttgggttatttccggtcgtgacagctatgacgccgtcctcgaccgcttggcgggcctgcgatcccaggggctcacaggggccatggtgttcggcgactaccttcgtcgccggattgcgccgctccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggtagtcggggcgttggaggagcgggctcctcgaggccacgatggcgcgggtgggagccgcaggggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaagatgggggggacagaaccatcccggggaaacctcatttcccctccaaggtggtcgtttaaccgaccccctcgcaggttcgtcccacacccatcgtggccgtattcattccctcaacgcgagttttcactcattcatcttgtttgtcttctggcttttcttctgcttcagcgagatcccgttgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctcttccccacgccttccgttgctccactgagcgcagagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcaaagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctacccgagaacggcgggcggcggagaccgaggtggcatcccggcggcgcgaagaagcccttgaggcccgtgccatggcgctggaagagcgtgcttgcgccgtggagagggacctggcggatcgcgaggccgccgttgccatccgggaggcaacgctgactgcgcacgaggccgcctgcgccaaagaggagtccgcgctctgcctccgcgaggacgcgctcaccgagcgggagcgagctctcgaggaggccgaggccgtggcgcaacggctggcggacagcctgtcccttcgcgaggctgcgcaagaggaacaagcgcgtcgcaatctggaaagtgcccgcgccgagagggccgcactgaaccagcgggccgctgaactcgaggcgcaggcaagggagctggatgcaagggcgcgtagcggcggggcggccacgggcgatagcgacttagccgcccgcctcgcagctgccgaacacaccatcgcggatctgcagggcgcgctggattcgtccaccggggaggtcgaggccctttgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaaggcatcctcgagggacctcgcccgaggagcggtggagctcgtactggcgagttaccaagccagggatcccgacttctccccatggacggcgctggacgagttccctcccgggaccgaggatggcgcgcgcgcaggtccgggacgccgccgaccatatcgtccacagcttcgaggattcggcccctcggctcgtgttcgccctcaactccgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactgatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactagccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacaacctttaggaaatcgaaaatgcttttattgaaatacagatataagagaaataagaatatgcatatgtggtagcccccggccgaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcagagggccgcgcgccgccttcgctcttccaagtagtcgaggtcatctatgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcaccgtgcttcttgaggatgttgaaggtcttggttttaaggtctctgaggatttccgcattggcgcgctccacttggccgttgcttctggggtgggcaggtgaggcgaagtagagcttgatgcccatgtcttcgcagtaatcgccgaaaagttcactagtgaattgggtgccgttatccgtaataatacggttaggcactccataccgggctgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccacattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactctcttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgctaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccctagtccagctgccaccctgagtcccgcaaggagtccctcgtactctgccatattattggtcgcccgaaagtcaaggcgaaccaaatatctgaggacgtctccgttcggcgaggtcaacgtgacccccgcaccggcgccctgaagagacagggagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagtggcctcgcggagtgcactcgtcttctgtgccgacgacctcggggtcggaggatgataggggcggccttcccacagtggcctcggggccgtcctgggggtcgggggctcctggcgtcgtcggacaagcagggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcggggtcaccaggcaccgtctgacaagcgggcagagggcctgctccggtcgtcgggggccttgggccaccgttcggctcgggggcctctcctccctgctctctcccgggccaagccggcacagggtgagggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccactctatagctcgtatcttctcggggttggcctcgatgcctcgggcagagaccaaaaacccgagaagcttgcccgcaggtacaccgaacacacacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacataccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcagctccctggggaccccgggcatatccgccggtctccatgcgaagacgtcagcgtttgcccgcaggaaagagacgagcgcgtcttcctatttaacgtccagaagaccaccgatccgtgtggtcttggacgggccgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgctactccgtacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggttgggacggccggagcaccatccccggggccttgatagcgtcaaaggcagcgggggaaaggatgttgagggctgctcccccatcaatgaggacacgccccagtttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatgatccctgaggctctggcgagaaacgtgagcacacgctcccccatcgacagtggcaatggtggccccaggctcttggaaacctaggtcatcatcgccgtcatcgatgtcctcggtgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatccttccaagagtggactgacgcgggtggcaagttcattagccaaccccgtgcttgtcccttcagggccatgggaaagaaattcgccatgaccctgtcgtcacccccggcggcctcgatcccagtcgtgtagacctggagaaactcggcggggttgacgctcccatcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgagaaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctctgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctgcccgtcgtcaccgctaactctcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctactcctgtgttttggtggatctatgtatgaagaagctacaaaagagctggagaaccagagagctcttactctctccctctctgatcgttctgtatccgaaaaaatcaatcccccttctaagtgggcaaggtcctccttttatacctcaaggggataccacatgcaccatctctcttttttttttgtggggacttatcctctcttttcataaacagacggagacttgtatggttgtcgtccgaatgaccttctgatgggacggcccatacctacctccacttccgccggaagcaggcgcgacgtgggaacatggttgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcgggg

SEQ ID NO: 73806 - DNA, 10003 bp, Oryza sativa
tttaacaataaaataagtcataaaaaaattagtgtactttttttaataagacaaattatcaaattttgttgtcaaagtcaactgcgttatgaccagaggaagtaccggaatttctcttaacatacagttggcattgtcttaattgtattggacttgtcgagcttggtgtttttttgtgggcatttctgacatgattttccctaatctatttacaggaggaaccattaactttgacaggacctaataatcgagtacttggtgcactagacagaatagagttacatttaaagattagagacgatggtggtgttgaccaagatttctgcgagaagccgagaacacaatgcatcagctataattttttaggttcataatataaatttagtgaaagtggcaacaaaatgtccggaccagtatgtgaacaagtagaatcgaatggcaaattaatcttctgtagctgccataaaattaggaacaaaattatgtagctctgtgatggaaagcttgaaggagctcagaattccagtcaatttctagtatacaaaagaaaaactaaaaaaaagtttaaactcaaagcccactagtaaatactactaatacaactaaggcccatattgggcccacacggcccacgaacagcaacctaatcctcgcgctggaagagacgagacagtacgccacgcgccgcctgagccctcgcgtcgcgacaccgctcgccgcggcggcgctgctcctctccagcgaccacgcgaggagggagaagaggaggaagaaggcgagaagggagcaagctagaagagtgggagagggggacatctaggtcgtcgacggcctcaatggggtggggcataccgacgcggccgccggcgacgtcgacgccgtcgcgggtgcaggcgctgtacgagctctgcaagcgcaccttcccgtcgccgtcctccgtcgccgcgtcctcctcgccgtcgtctccacctcccgaccacgccatcggcgccatctcctctctcatgggtaggtcacctgacctccaccaactcctcttcctcccgacctcggcccaatttttgttttgttcttgtgttcagagttcggacagccaattgattgctctttcctctgcaaaatcgttcgtatgctgatgtattgaggaattggatgtgagttttgtgttcagatacaatcactcctgtggatgttggactcagagatgataatcttgaggatggaagaggatttgggttctttgaatcaaacttcttgaagaattcagcaagggttgctagatgggcgcaacccataacctacctgcatgtctacgagtgtgacgccttctctgtatgtggatgttcaaatgttcaatttggtcatcttcttgtaacacttctgtgacagagaatactactagaagttaatgaataattggatatcttctctgctaatctgcaattgcttcgtgtttgttctgtagattggaatattctgcttaccaacatcggcggttattcctctccatgatcatccgggaatgactgtgttgagcaaattactctatggttcgatgcatgtcaaatcgtatgattgggtagagcctgctgttctagcaaatggcaagccaggttatttttcataccctgtttcaaatatttgtttttatttatctactagtatatattgcattgcagagtgatgacttaatgaactcgttgtctctgagaatacaagtgtactgaaaacatttatttcttcagatggtttctacagtaccaagttaatgaacaatattggttgtagcatagtaatagtattgatactacccaaccctattggtcactagtgttgcactgttgctcaggcatcattttagattgctcatttctatgccttgatgatttttcgggttctggtatattaaggattttttttctttctcctgatgtgcagtgaaacttggaaagttacatacggatgatgttctgaatgccccttgtccaactgctgttttgtatccccaaagtggtgggaacatgcactgcttcacttcagtaaaatcatgtgctgttcttgatgtcattgccccaccatactctgaatcatctggccgtgtttgcacctattttcatgattatccattttctagcttctgtaagtgaaatccctcactgtcgtcatattacatatttctgtcaggttcatgtttaactaaatcttttggcggaagcagaataccagccatctctggtattggctggtagttgttcaaaacatatattattagtcacaatgctgttcagatcttttctgtcaagaacagcaattaccttatacattatgttcattttatatgagaagaaaacttaatttgttgatatattgtcaaaacacaaaagtgatcattttcactatgctatatcatgtttgatttttctcacggatcactccaactgcagcagctggacaagcaaaagtagtccatgggccagataattatgcttggcttgaggccttaaacgtaccggtgaatattaatatgcgccctggcatgtatactggcccaactatacaggtatagcctaaatttctgcattttgttgatagtcttctgtagcaaccaaaacatgcttgagagttgagactgtttttctgatggaatatttgtctttttgctaggaacatctgccataatcaataaaaatgggcaggacagagcgtcaaactgtgtccaagtgccatctcacaaatacagttcttatcatgtagtgatgtaaatgtaacatgttcatctttaacttttgatttatgttgtccttcattgaaaaggtgtggctataatggtgacatagtcaaaacagtttgtactagccactttgtatcttagttaccaatctgcaaattctgcattctaaattgcttctggagatattgtaaatgtatttatgttaatgcctacatttttctttctatttctatgccttcagagaggctggttgccatggtgtcaatatggtctggaattcaaatattcaacaacccttgttaagatggtagttgagattcaatcaaaatttttagattattgtgctccattttgtacctgttctttccgtatttttattgggattacaaagcaaactcaatgcagttcaagaaagagttaaagtgtgaaactgacaagctggcagctcaaaaagtactggcccaatatgtatgggctgaacatgaactacaacactgttctggcccaatatatatgggccgcatgtgagtcacattactcttccgtcgttcaagcccattaatttgggctcagcacgcaggacctggccttcttgggcttcttgcgggaagttcaaatttttgcaccacattggcgcgggcgccactatacatgaaagctacgtgaattgggacgtccacgcacgatccgacggccatcattacatggcgtcttcagccgatggcaagctatgctcaggcaggtctgaccgtctgagatatagggcgtgtttagttcacgttaaaattagaagtttggttaaaattgaaacgatgtgacagaaaagttgaaagtttgtgtgtgtagaaaaattttgatgtgataaaaaagttggaagtttaaagaaaaagtttggaactaaactcggccataacatactactcactggatggagcactagaatagcatctagtagctcattttcactttcaggaacatgaatcctctgatcctctatatctaaagtagtgtgaaaaaactagagtttttcaccatctcagtgcgccacatcatcaattaaatacagaccatccgatggaagaaagattcatttgaaccgttggatctggagtgtgtcacggtcaagcaaagaagcacaggcttcaggaagcttcgcccatcttcctgtcactcccgtacttgccatatgtgatcagtgatcggttggttaagcagacaaataggctacttaggccgagtttagttccaaactttttcttcaaacttttaactttttcatcacatcagaacttttctacacacataaacttccaacttttccatcacatcgttccaatttcaaccaaacttctaaatttcgagtgaactaaacacacccttacatgatgtatgttaatatgcatatgtaacagtgtagcaagtcttcttttaagcatttttattaagtacttcctctgtcgtatattaagattatttttagctcatcccatttatctcaaaataaattgatttttagtaataattatatcaaagtttataatagtaaagaataattgcattggaagtagataaagtgataaatagttatattaggatgagataaagtagggtattttagtcttttgatgtttgtattggtatgtgtaggatgagtgaacaatgaactttttttggaacatctgtattactaatatgcatttgtactaatttttttaccaggtatgcatatatacaaattactccctttattttaaaatgtattgagatatatataaatataattaccttttcaaacaatcttttcaatactatactttaactactactgttttctttcgtttattatcaatacctacaaaatcaacgccatataaaaatagtcaaataaaaatctaacaatactactttattatataatgatataaaaatcaaataaaaagtcataacattaatcaaatatccaatcataccaggtatgcatatgtacaaattactccctttattttaaaatgtattgagatatatataaatataattaccttttcaaacaatcttttcaatattatactttaactactactattttctttcgtttattatcaatacctacaaaatcgacgccatataaaaatagtcaaataaaaatctaacaatactactttattatataatgatataaaaatcaaataaaaagtcataacattaatcacatatccaatcctgtacttttaatccattcattagacaagattttatgttttgatttttctcaaaataaaaatgccttatatattttaaaatagacggagaaacaagttagtatttctttatcatacaataatactctattgtcataaatatataacgtttgttttttcttgagcaaactttcgaaatttttcccatcaaggagatctcaacggcagggcactgttggcctgacctatatatacacatcttttaaacgggtcttaagagcctcgcaacgcgtggcttatgtggctagtttatatgaagccatgaagcccccatttccattaccagaaatgagaagttctacagttcttaaacctccaaaacaagagccaagaacagctacagttcaaactgccagcacctgaagaccctacaaactaaaacgagctactaacctccactgcatgtgtggagcaaaccagggccaaataacaggagctagcaactcaagccatcatcaacaaaacccaccacccaactgacaacagcaagcacgcagaaaaaacacactcaggttctggagacgctgagccacgaaaatataaagtctaggaaataaagtggaatagtttattataaacttgcaggtaggtctgaggaaataaagtggaatagtttattactaccatatgacttgacagcaaattaagtcttaacatcaataacagctttctccaaaatgacatacatcttccctcccaaaataaatcaactaatcaagacatagccaggatttgaatctttttgagacggagaggatgcataccaataaagtggaaacaaagtggagtatatatcaacctgcatccaaacgcttatatttcatacaaacagcccttcattggcaggacatcctattaggtaaataataacatcatataaggatcaggttgcatattttgaagaacctgatgaattgctacaagcctacagcagttttaaattttcaaatgacaacaaaatacatctactggacctagtttgtatgtatgttgtgctctgactgtttcgtgcctactacaatagcacaaaatggtacgctaatgtatacccttaagttctttaagaatcattgtacaaatttcttccgtgttgattggtaggaagagagaaaaaaaggaatgtatccaaggagagctggccaactcataggagaagtgagagctcatttctcctgtatcacaactcagtctcacaagcatatgtaataaccatcagcatgttttgtgcaattgtgcttattacagatttatgcattagcaagctttggaataggtattaccttcttcagaaatctgttcaaaacagcccagcattcagtgctatgaagcttctttagtcgagattgatgatgtctcaacatcttgaggacctcctgctgctcgttccattggggtttcactttgagcttatgattattatatgcaacaacacctgctattgctccagattgcagaaaagatggtgtaagagaaattaatgggctcaaacttgaacaagggtgtaagagaaaataaagttaaaccaataagagaaaaaacagtataatatacctatcaaataaccaattatatttataaaggtaagctgtgtatctgcaaagatagcagctgacagcaacaccacagtccaatccctcacaattccagtaacacgagctgtcagtgcactagttctggaaatgacaaggaagactgagggatttagggtgaaagtgcatatgcagtttaagaacaattttcaagttaattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattttaaattaatagaaacctataacttgatcaaaaaccagagagctcacatacttatttccttcaacatctgtgcaaatgcaacagatatgtaaaggtacgcactgctccctagacagtgtgtcattgaaaacattgctccaattgcaatgaccgaactaacatatctgcaagtccaggtgtactggttgaattagatagaaatattgtagagcacctaaacatgtgctgctgggtagctacaaccaaatattgaaaatcaaacctttccaaaagagtacaagccaaatattgctgtgtgtggagattatgggtaccccatacccacacggcatggttatccgactagttataggggataacttgtatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatacatgagacaactagatcgtcagatctataatacacccggcggattcaaatccccaaacaggagtagggtattacctctcattgagagggcctgaacctgtctaaatcctttgtctccacatccatccacttttaggtctcgtgcgctaccccgttttattattgccgaaatcatgtttcgacagttggcgcgccaggtaggggatgcgtcgaattacccgtcgaaaagtgagatggaatccacttcagaagaaacggcgagatcaatctcaccgaattcgatggctcgaactttggaccgggtttgtcgttccaatctattttttattagattaattttttttctatcatagatcaatcttctggtatattttcctgtgtcgatcttgtgtcggtcggcggagatcaagccgaagctgtcgacgacgccctcacgcatcgagactttcttcgtgctttgccggcggacatgtggtggccatcgctgggcacagtttaccaggagaaaacactgcatgagttgattcaactgatcaacatacatgcacgatccaaccaacatgcacattacatctacagagttaatctgtttactagttgattctaaccagcaattattttgttgctatctgtcttgcatgtacaccgccggccgtatctactgccggctatatccgtcagcgccgaccggctccaccgtctccgtagtcggtcgcctccgagctgttatcattaggctttacagctgccccggtcggtcatctacatgctgccgactctccgaggtcgcagggccgttgatggcttccgccggctactgctgatcgaggcattgcgacccaagctgatcgacgcgcacgacgtatccaagccacgccgtacaacttgggttggctgttccaatttaatttttattagattgattattaattaatccctaatcgccggccgttttgatttcctggcaatttttgttgtttttcacatgctggttgagatcacgacacggccgccatcgtcgcctactcggccactcgggtgcctcttgccgtgtccgagtgctcctctcttcccttccatgcagatggacgtgctgctagattggcacaggacacaggaatatactcggccaccaggagcaagcacgtgtatacgtcgatttaatctacatgtatgctggagcgatggttgttcgcatgcattggatggcagtcgagatcaaacaatcattcactgcttgcggcctcgctgccacggttggtgtgtgccgccgccgttgccgatagcgacatcgtcttcaccactggcttgcctccgtcgccgccgattggtgcctccgcctacacggctggtctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtcttcgcctatatggttggttggtcacaccaccgttgttgggcgtctacatcttcaccgaccggccgtctcgtccgccgccgactggtgtttccgcctgcacggctggcctattatgccgccgctgttgggcgtctacgacttcaccgccggcctgcctccgtcgccgccgactggtgtcttcgcctatatggttggttggtcacaccaccgttgttgggcgtctacgtcttcaccgaccggccgtctcgtccgccgccgactggtgtttacgcctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtgtacgacttcaccgccggcctgccttcgtcggcgccgagtggtgtcttcgcctatatggttggctggtcacaccaccgttgttgggcgtctacatcttcaccgaccgtccgtctcgtccgccggcgactggtgtttccgcctgcacggctggcctattatgccgccgctgttgggcgtatacgactataccgacggcctgcctacgttgacgacgactggtgtcttcgcctatatggttggatggtcacaccaccggtgttgggcgtatacgtcttcaccgaccggccgtct

SEQ ID NO: 73807 - DNA, 9670 bp, Oryza sativa
aaacatatattattagtcacagtgctgttcagtccttttctgtcaggaacagcaatcaccttgtacattatgttcatttatatgagaagaaaatttaatttgttgatatgttgtcaaaactcaaaagtgttcatattcactattctatgtcatatctgattttctcacggatcactccaactgcagcagctggacaagcaaaagtagtccatgggccagataattatgcttggcttgaggccttaatcgtaccggtgaatattaatatgcgccctggcacgtacactggcccaactatacaggtatggcctaatttctacatattattgttgatgttgtcttctgtagcaaccaaaacgtgcttgggagttgagagttgagagttgagactgtttctgatggaagtaatatttgtctttttttctaggaacatctgccataatcaataaaaatggataggacaggagcatcaaactatgtccaagtgcaatctcacaaatacagttcttgtcatgtagtgatgtaaatgtaacatgttcatctttacattttgatttatgttggaacttccttcatagaaaaggtgtggctatagtggtgacatagtcaaaacagtttgtactagctactccgtatcatagttaccaacctgcattctaaattgcttctggagagattgtaaatgtatttatgttaatgtctacatttttctctgtttcgatgccttcagaattcagagaggctggttgccatggtgtcgatatggtctgatattcaaatattcaacaaaccttgttaagatggcagttgagcttcactcacaatctgtggattatggtgctccattttgtacatgttcttttcgtatttttattgggatcacaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcacgtgaaagctacttgaattgggaccgtccacgcacgatctgacggccatcattgcatggcgtcttcagctgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccatttccattaccagaaatgagaagttctacagttcttaaacctccaaaacaagagccaagaacatccacagttcacactgccagcacctgaagaccctacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagcctgaggaaataaagtgtaatacttcctccgtttcacaatgtaagtcattctagtatttcccacattcatattgatgttaatgaatctagacatatataccgtttcacaatgtaagtaattctagcatttcccacatttatattgatgttaatgaatctagacatatatatgattcgacagcaaattaagtcttaacatcaataacagctatatgagggagtagtttattataaacttgcaggtaggtttgaggaaataaagtggaatagtttattactactatatgatttgacagcaaattaagtcttaacatcaataacagcttactccaaaatgacatacaccctccgtcccaaaataaaccaactaaaataaatcaactaattaaaacatagctaggatttgaatctttttgggacggagaaggtacataccaataaagtggaaataaagtgggtatatatcaacctgcatccaaacgctcatacttcatacaaacagcccttcattggcagggcatcctattaggtaaataataacatcgtataagaatcaggttgcatattttgaagaacctgatgaattgctacaagcctacagcagttttaaacttcaaatgactacaaaatacatctactggatctagttggtatgtatgttgtgctctgactgtttcgtgcccacaatagcacaaaatggtacgctaatgtatacccttaagttctttaaggatcattgtacaaatttcttccgtgttgattgatatgaagagaaaaaaaggaatgtatccaaggagagctggccaactccggcccggctaaaaaaaaaaaaagagctggccaactcataggagaagtgagagctcatttctcctgtatcacaactcagtctcaagcgtatgtaataactgttagtataatccttgttctagttagttatttggtttccttagacagtaagctataggctgcagctgttactcggttgtcagactgctgctattagtggtagtagtcaatttttattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaattggtatcagagctcaggttaaagaagtgtgagagagatggagggagtaccagctgctggagccaatgcttccaggtcgccacaacaccgcggccgccatcactcgttatcgccaacaccacggcgaggacgaggtcgaggcgctgctgttcgagaggttgttgtgcagcggactgtcagggaggttggcggcgctgctgctttccccaccctcacgcgaaccaactacaccgagtggtcgctgctgatgaaggtgatgctgcaagcccgtggcctttgggacgcggtggagcatggtgaatgcgatgagcaagaagacaggatggcaatggaggccatcctacgcgctgtccccagcgagatgatctcgctgctcgccaccaaggactccgcgaaggacgcctgggatgccatcaaagtgatgcgcgtcggcgtggaccgcgtgaggaaggcgaaggcgcaacagctgcaccgggagtatgaatccatctcgttccatgatggtgaatcgatcgacgacttcgccctacggctcacaagcctagtgtctcagcttgggacattaggagaacgaatcgaggagcagaacgtcatcgagaagttcttgcgcgtcgtcccagagcgattttcccaaatcgctgtgtcgattgagaccctgttggatctctcgacactcaccatcgaggacgtcactgggcgtctcaaggtggcggaggaacggcgaccagctccaacgtcgacgactactccagccggaggccagcttctcctcacggaggagcagtggctcgcacggcagaaggagcgacaaaaaggggagcgatcctccaagcagtcgcaaggtggagctcgtcagcgacctcgctcccatcgcaagaaaagaggttttggtggcggcgtaggaggcgagaaagggaacaccaatcgggacacggcaccaaacagatgccacaattgtggccgtcttggccattgggccaaggactgtcgccagcccaagaaagaagccgctcacctagcccaaggtgatgacgatgacgacgtcctgctgctttcgcgggcatgcgagcttgaagatgacgatgccactttgttgatggcccacgcttgcgagctcaatgatggccccatcatcgcgccatctcctgtctccctcgttgaaccgcgagtgcaggtgagcctaggagccacggacgctgaggacaaggaggcgtggtaccttgacacaggagccaccaaccacatgacgggccgtggtgacgtctttgctgagctcgatcgaagcatcaccggcaccgtcaaatttggagacagctccatcgtagacatcaagggtgccggtaacgtcatcttcaccggcaagaatggcgagcacaaggttctcagtggcgtctactacattccgcgcctcaagagctcaatcatcagcatcggtcagcttgatgaaagcgggacgcgtgtgctggtcgaggacggcatcatgcgtatctgggaccgccgccgccgccgccgtcttcttgccaagatcaagcggggacgaagccgtctatacgtcctccgcctcgaggttgctaggccgatttgcttggctacgcgacacgatgatgttgcctggcgctggcacgagcgcttcgggcacatccacttcggctcgctagagaagatgggccgacaagagctcgtgcgtggcctgcctcgactggagcatgtcgagcagctttgcgacacgtgtgtcatcaccaagcatcggcgcgctgcctttccaaaggcagccaagtaccgcgctcaggagccgctagatctcgtccatggcgacatctgtggccctatcacgccggcaacgccaagtggccggcgttacttcttgctgctggtcgacgatgccacacgatacatgtgggtggcgctcctagcagccaagagcaatgcacctgacgccatcaagaaaattcagatggcagccgagactcactgtgggcgcaagctgtgtgtatttcgcacggacaacggcggcgagttcacgtcgcttgagttcgccacctactgcactgatgagggtatccaacgtcatttctccgcgccctacgccccacaacaaaatggcgtggtcgagcggcggaatcagacagtggtgtccatggcgcgcgcccttctcaaacagaggggaatgcctgcggagttttggggggaggctgtcagcacggctgtcttcctcctcaatcgtgcaccaaccaaaagcctcactggcaagacgccgtatgaagcttggcacggcaagaagccgatggtcagcttcctacgtaccttcgggtgcctggcgtacgtgaaggagctaaacgatgtgcgcaagctcgacgaccgcagcacacccggcgtcttcattggctatgaagaaggggtgaaggcatatcgtgtcctggatccaaggacacggcgtgtacgtctcgcccgtgatgtcatctttgacgagagccgtgggtgggactggacggcagcaagcggcatagatgctcgaccgagcagcgatttcgccatcgagtaccatgttgagaagaccactgggcatcctatccctagtgtggggggaggcgtggtgaccccatcagcatccccaacgccactacaagagacttcaccagcaacccctgccacaccagcaccaagtcctagcgttgccccaacagagttcgtgtcacctccctcacacgacgaggagaggatcgacgcggcgcactccaacacccctgtccgctaccgcacagttgacaacttgatcggggagaatgccccggcaccagggattgcaaaacgggaactcgaggaggcgtctttgctcctcgctggacctggtgagccatgctcgtttgcagaggcggagggtgatgatgcatggcgagcagccatgcgtgaagagatggacgcggtgaatcgcaatgggatttgggagcttgttgatctcccacatggccatcgcccaattggactcaaatgggtctataaattgaagaagaacgaggccggaaaggtggtcaagcacaaagctcgtctcgtcgccaggggatttgtccagcaacctgggattgattttgacgaggtgtttgcgcccgtcgcgcgcatggagtcaattcgtctcctgcttgcggtcgccgcccaaaaagggtggcacgtccatcacatggacgtgaagtctgcctttctcaatggagatttggcagaggaggtgtatgtgaagcagccccctggttttgtcgtcgccggagaagaagacaaggtcctccgcctgcgcaaggctctttatggcctgcggcaggcgccaagagcctggaatgcgaagcttgattgtactctgaaggagctcggtttcgaccaaagcaagcatgagcacgccatgtaccgacgaaacaatggtggctctgctctactcgtcggggtctatgtagatgaccttgtgatcaccgggccatcgacaagagcaattgaacaattcaaggaagaaatgaaggcaaagtttcagatgagtgatcttggcttgctctctttctaccttggaattgaggtgaagcaaggagatgatggaatctccctgaaccaggggcgctatgctcagcgcattgtggagtcggctggcctcaaggactgcaacccttgcgccactccaatggaagaaaggctcaagctgagccgtgatagcacggcacctcccgttgatgcaacaaaatatcgacggctggttggtagccttcgctatcttgtgcacacacggccagacctagcatttgctgttgggttcgtgagtcgcttcatggagcggccaactgaggagcacatggtggccgtgaagcgcattctacgctatgtcgctggcacgatggagtacggacttcattacaaaagggagaaagaggagcagcggctgattggttacagcgacagcgacctcgccggcgacattgatacaaggagaagcacaagtggcatgttgtttttccttggttcaagcttggtgagttggcaatccatcaagcagagagtggtggctttatcttcctgtgaagcagaatatgttgcagccaccaatgctgccacacaaggaatctggttggctcgattgctcggcgaacttcttgggaagcaacctaaagcgatcgagctaaaggtggacagcaagtctgccttggcgctggcaaagaaccctgtcttccatgagcgcagcaagcatattgatttgcgctatcacttcatcagaagctgcttggaggaaggaagcatcagcgccagcttcatcaccaccatggaccagctcgctgacattctaacgaaggcattggggcgagttcgattccatgagcttgttgcaaggattggagtggtcaagattagttcagaatagaagaacaaggattaaggggagattgttagtataatccttgttctagttagttatttggtttccttagacagtaagctataggctgcagctgttactcggttgtcagactgctgctattagtggtagtagtcaattttgattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaataaccatcagcatattgtgttcaattgtgcttattacagatttatgcattagcaagcttcagaataggtattaccttcttcagaaatctgttcaaaataacacagcatttacgattgatgatgtctcaacatcttgagggcttcctctgttgactttgctatcagcaccctgctgctcgttcccatgggttttcactttgagcttatgattattatatgcaacaacacctgctattgctgcagatcgcagaaaaaatggtgtaaaagaaattaatgggcccaaatttggacaagggtgtaggataaaataaagttaaaccaataagagaaaaaacagtataatatccctatcaaataaccaattatatttataaaggtaagctgtgtatctgcaacgataagagctgacagcaacaccacagtccaatccctcacaattccagtaacacgagctgtcagtgcactagttctggaaatgacaaggaagactgtgggattttgggtgaaagtgcatatgcagtttaagaacaatgtgaatggtgggaagttctatgagactttcattcatcttgggtgctctaaataaagacacacaaagtgcaggaaaacaatatgataaagttaaaatagcaaacaggtttgaagttaattaattatgagatcaagtgggcaagatatatgcaagggctaacatagtacatggaaatcaagttaagcctaacacccttttttttttcagaaaaatctcatgaagatcagtctaagggcttctgtgatgactccacccatccggttaaccacacagacccagctgattgtattttcaccaacagatgccacaattaccccaacgctgatgacaggcacgatagcaagcatttaacagctcatttcttcaagggcaaaagcagctttgagaagaaacacagctactacaatgctcgaacaaagagtacattaacatcatattttaaattaatagaaaccagagagctcgcatacttatttccttcaacatctgcgcaaatgcaacagatatgtagaggtacgcactgctccctagacagtgtatcattgcaaacattgctccaattggaacgaccgaactaatatatcttgcaagttcaggtgtactggttagaaagaaatacatttctgggtttctgatactcattattaacaggacaagcaagcagtatgccaggagttcagcgttacatgctagttaataaacaaatagtgaaatactttttctgaaggaacaatggcattgaattagatagaaatattgtagagcacctaaacatttgcttctgggtagctacagccaaatattgaaaatcaaacctttcgaaaagagtacaagccaaatatagctgtgtttggtggatgttagttgtgttaacttcagggggaaaaaacggcaggcagttgtggtaactcaactgttcaacagtcttctgtcaatgtaaaaccttcattatctaccatgtaaaactatctcccaatcctaatgtaattagtcagcctactttggctggcccagctaaaaaaaaaagagtgcaagcaagcctactcattacactattcagaattaagaaacatccacccaatcgagatccagggactaccaaatttcaaattacttctattatgttctataatcgtatgcctcttgacattaccatatgcatattcagttgctgcctcagtcagaatctttacaaaaaaaatgtgaaacccgctcaattagttgaaatcttaagcataaagttttttttttcattaacaacaaacagcataacatttttttttcctgtcctaagaggaggtttcaagaaacagctgtctaactgttgtccttttttttttccttctctaacatgagatgcatgtatctattttgacaaaatccaacaatgtcagcaaggatataataatacgtcttcaacatatacatataaatgcataaactacattcctgctttcttctatcagtgaaatggcagagctccaacccattccctagaaaaaaataaactatattcctga

SEQ ID NO: 73808 - DNA, 17034 bp, Oryza sativa
ccggtagtgggctacactattaaacttgctgacgataaagaactcatttattttcactatttactaaatattattttatttactagtcctttatattggaatgagtcactagtcaaatgttttggcaattcctcgtgggcggatgatgcaatagaattttgaatcagctttttgatctttggttatccttcatgctcagcaagtttaatagtatagcctactaccggctccaattcatctatagccaatctaatagccaattcatacaatagttacttactatactattaatatatggtcccacctgtcatacacacattgcgtcttggagtccgtgttgcagctggctatagatctatagcctgttgctcttctctcttattgtttatcttattaaaatatatttatagctggctaatagcatgttattgtacctgctctatgtgattagtcaaaatgggatggatggagtgttattatctttcctcctagtgatggaaggagcaaccttgaattaaatgctccaataacaatcactgtccggttcgctttatttaggttcacccggtttttcgaatatggtgctgccataaagttacggttgtttagcataagagcaagtttaatagtatacgccaactactggtttcaatttatctatagctaatctaatagcttatttatagaactaggaaggtggcccgcgcggatgcgcgggcattatattattgaaagataagattattgtttgttcgttataaattaagggcaaactaatgtttggataatgttattttataataatttaagggttctatttttcttaaagtatcttaaaaaaccattcacaaacttttgaataggagatggattaagtacttatgacttttaaatcatgttttttttctcaagtaaataagaaactattggaagttaattattatacaatccatttatagagcaagatacttaaaattcttatgattaaatcatctcatgaagacgcatgatatagtaagaacgggaggaaaacgcatgcatggaaaaaaaagaaagggaaaaatgaaaaaaagggagaggaagcatacgtactcacgtacgtaggtgcgtacctatgccaaggcggagaggtggaacctcgtagtatttcgtttgttctaagatcaatttaatctaatggtttataatattggacacaccgatttaagtgaaaatcaaataatagatattttgctttttttcttagaatttttaatagttgctttaatttattagagcaccacgtggcagtttgagagcattttaagaaattttaaaggacttaacacatgtaattagaatattaactacataatatatatatgcatggggcatatggtattatttattccagcttcgtccatgtttatatacatgtagagagaaattaattatgtggctaattatgtggctagcaagccattagatgtctaattaatagcaattaattttgacacctatttacagttatatagtagctcttacatatttatcttacgactttgattatccgttgatccccaatttactgatcactatgactcgcatgaaaaaaacatgtactacttaggatttagaatagcttatttatatgatagttatttgagggtacaaatgaatgaattgacttctaaaaagctaaaatgttgtttaaaaaagacatcatttagaaacttggaaagcgtgcaaacgaaaacccaaactatggaattgggaaaaaaagagggttaaactctcttatagtatgcttgtcttagtaaaagttctattgatattcgttaatattatgcccatatttataacataatgatttctttcacctgtacgaacaaatagtacaaaatccaaatatgacataacacaatacattataattattctataatcaactcttagtttcaggttaaacagagctaagtgttggaaaaaattcaacccgcggtgcttaattcttctctcacggcatcacacctttaattttctttacatgttattaataaaattaatcaactccatatatgacttgatatgtggcaaagtggtagcgtagcggcggtcgtaatcaccttagatgccttagacacgacgctttgtcacgcgtgcaaaaggcaaaaagtgcagacgtgcattgtgtagcgggccaaaaaagagaacttcgaacgctttatttataagaaaacaatagatccgatgatttaaataatgggtccaccggttctagtgtaagtataaattagttattatagattttaaatttttaatttaatgggtacataatataatagtgtagactttattttgaaacaatgcattattggagaataatagtccaatgtaataaaaaataaatccagtgatttaaataatgagtccatcagcttaaatgcacgtataaattagttaatatagatcttaaattgtttatttgataggtacacaatataattgtgtaaactttatttttaaatagtgcattattggaaaataatagcacaaagtaatgagtacaccggtttaagtggaaattatcttacattattaattttatgggtaacatataatggtctaaattttattttttaaaattgtagagctaatttagttacatgcaagttgtacgatggtagattctctatttgtaaaattatgattatttaaaaaatatatatccattatataaatagaaaaaagaagaaaaaaaaggaaaaaataagcgaaagaagcgtacgtacacatacgtatgtatacaatataatgtgtgaactttattttaaaatagtgcattatttaaaaataatagtacaaagtaatgagtacaccggtttaaatggaaattatattacattattaatttaatgggtaacatataatggtgtaaattttattttcaaaaattgtagagataatttagttacctctaagttgtatgatggtagattctttgtttgtaaaatataattatttaaaaaatatatatctattatataaatagaaaaagaaaaaaaggaaaaaaagaattgaaagaagaagcgtacgcatgaattatgattatttaaatatatatatatatatatatatatatatatatatatatatatatatatatatatatatatatatatatatctattatataaatggaaaaaagaagaaaaaataaaaaataaaagagaaaggaaagaagaagcgtacgtacttatataaatggaaaaaagaagaaaaaatgaaaaaaaaagagaaaggaaagaagaagcgtacgttcatggtacgtatatatgatatatctagggaggaggaggacttttagtatataactaggaaggtggcccgcgcggatgcgcgggcattatattattgaaagataagattattgtttgtttgaaaattttgtctcataaattaagggcaaactaatgtttggataatgttattttataataatttaagggttctatttttcttaaagtatgttaaaaaaaccattcacaaacttttgagtaggagatggattaaatacttatgacttttgaatcatgttttttttttctcgagtaaataagaaactattggaagttaattattatacaatccatttatagagcaagatacttaaaattcttatgattaaatcatcacatgaagatgaatgatatagtaagaacgggaggaaagcgcatgcatggaaaaaaaagaaaggcaaaaatgaaaaaaagggagaggaagcatacgtacccacgtacgtaggtgcgtacctatgccctgggaggagaggtggaacctcgtagtatttcgtttgttctaagatcaatttaatctaatggtttataatattggacacaccgatttaagtgaaaatcaaataatagatatttttcttttttttcttagaatttttaatagttgctttaatttattagagcaccacgtggcagtttgagagcattttaagaaattttaaaggacttaacacatgtaattagaatattgaccacataatatatatatgcatggggcaaatggtattatttattccagcttcgtccatgtttatatacatgtagagagaaattaattatgtggctagcaagccattagatgtctaattaatagcaattaattttgacacctatttacagttattcatagtatctcttacatatttatcttacgactttgattatctgttgatccccaatttactgatcaccatgactcgcatgaaaaaaacatgtactacttaggatttagaatagcttatttatatgatagttatttgagagtacaaacaaatgaattgacttctaaaaagctaaactgttgtttaaaaaagatactatttagaaacttggaaagcatgcaaacgaaaacccaaactatggaattgggaaaaaaagagggttaaactctcttatagcatgcttgtcttagtaaaagttctattgatattcgttaatattatacccacatttataacataatgatttctttcacctggacgaacaaatagtacaaaatccaaatatgacataacacaatacattataattattctataatcaactcttagtttcaggttaaacagagctaagtgttggaaaaaattcaacccgcggtgcttaattcttccctcacggcatcacacctttaattttctttacatgttatctattatatactaaaagtatatgaagcttccttaaaacgctctcaaaccgccacgtggcgctctaataaattagagaaaattctagaaaatctgaaaaaaaagaaaaacatctatccctcgattttcacttaaatcggtgggtccaatattataaaccgttagattagatttatctcaaaacaactcctctgttccattccatatataggtacgttactgcttgcatgcgatctgttaaagggggtgcatgcacgtacataacctttttttccaaggtacgtgactattctttctctttttttccggtatataattgagataataataataatagtactaataataataatactactaataataataattagtgataataaattttgaataaaagtcactttacaaatatagaatataccagcatacaaatctttacaagtgaacataaataaattagctctacaatatttgaaaataaagtttacaccattatattatattatgtacccattattttagattattttgtaacaaaaatatttgtccatcgatattcacttaaatcggtcctaagtcgctacatgccacccctacaaatgctcctaagctaccatgtggcgctctgataaataaataatagaaattctacaaaagcaaaatatctaacccttaaaatattcacttaaattagtgggtccgatattataaacccttggattaacgtacaacggccccagctctcccataagtccgtacatatgaagtaagtacgtacgcacgtgcgaaaccgctcacccttatcacgtccatatttctctcctttccttttataatttctaaggataattgaaataacattcattattaaaaacaaacaattataactttgcaaacctagactgcatcatcataaacgtatataatgtttgaagaaagtttactgcattatattctttacacatctatctatatattatatactgaaaatccattaaacaaaataattcaacaccaattaataaaattaatcaactccatatatgacttgatatgtggcaaagtggtagcgtagcggcggtcgtaatcaccttagatgccttagacacgacgctttgtcacgcgtgcaaatggcaaaaagtgcagacgtgcattgtgtagcgggccaaaaaagagaacttcgaacgctttatttataagaaaacaatagatccggtgatttaaataataggtccactggttctagtgtaagtgtaaattagttaatatagattttaaatttttaatttaatgggtatataatataatagtgtagactttattttgaaactatgcattattggagactaatagtccaatgtaataaaaaataaatccagtgatttaaataatgagtccatcagcttaaatgcacgtataaattagttaatatagatcttaaattgtttatttgataggtacacaatataattgtgtaaactttatttttaaataatgcattattggaaaataatagcacaaagtaatgagtacaccggtttaagtggaaattatcttacattataaattttatgggtaacatataatggtctaaattttattctttaaaattgtagagctaatttagttacatgcaagttgtacgatggtagattctctatttgtaaaattatgattatttaaaaaatatatatccaatatataaatagaaaaaagaagaaaaaaagggaaaaaataagcgaaagaagcgtacgtacacatacgtatacgtatgtatacaatataatgtgtgaactttattttaaaatagtgtattatttaaaaataatagtataaagtaatgagtacaccggtttaaatggaaattatattacattattaatttaatggtgtaaattttattttcaaaaattgtagagctaatttaattatctatgagttgtatgatggtagattctctgtttgtaaaattatgattatttaaaaaatatatatccattatataaatggaaaaaagaaaaaaataagcgaaagaagcgtacgtataactgtgtaaactttattttaaaatagtgtattatttaaacataacagtacaaagtaacaaagtaatgagtacaccagtttaaatcaaaattatcttacattattattaatttaatgggtaacagataatggtgtaaattttattttcaaaaattgtagagataatttagttacctctaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggtgtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttatagcctgctgttatacatgctctaagagaaactatagattatccccgatgatggacagaatcacaggaggttcactagcagcttagcttgggagattgaagcccacaaggtggatagaggatttttttggaggcggagatgaacctgaggcggctatgggaggtgtggggggagtgggagatccgcgtgctcgtcctgtccagcctgtccctgcaggtcttcctcctcttcaccggcggcctgcgcaagcgcaaagccgcttggtggctgcgcatgccgctctggctcgcctacctcctcgccgactacatcgccatctacgcgctgggcaacctttccaagaagcagaagctctgcgacggctcattcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaggtcgcgttagccgggtacgtctactggaagtcgcggcccagcatgcggctcatgtccccggcgataatcatgttcgtcgccggcgtcaccaagtacggcgagcggacgctggcgctcagggcggcgagcatggactgccttcgcagctccatggtcacgcagccggatccgggcccgaactacgccaaattcgtggaggagtgccagtcgaggacggagtccggactggtcgccaagatcgtcatcgtgcaggagcggcctccagatgacgaggaccatgtcgaagtcaagcgagaggagtacggcgacctggtgtacagtgcgcacaggttctttcacaccttccgccgcctcttcgtcgacctcatcctcagcttccaggaccgcatcgacagcctcgccttcttccggaggttggagatggagcaggcgtacaaggtggtggagatcgagctggtgctcatgtacgagtgcctccactccaaggcactcgtgattcatggtcttctcggccgcagcctacgcttgttcagcctcgccgcgccggtcgtgtcgctcgtgctcttcacccgcgcgttgggcgacatgcgagaaggctacaaccaggttgacatcaacatctccttcgtcctcctgggaggagccatcttcttggagacatacgcgatcctactgatcttcatctcctcctggacctacaccgacatgcgcggcagagaagcgctccggcccgtggcggcggcggtgttttggctgatcgccctattccagccggagaagaggcctaggtggtcgaacaagatatctcagtacaacctgatcagctattgtgtcaaggacaagtcccgtcggtacaagaaacccatggagtggctggagtggaggtggaacttccgcgtgaagacgatgtgggacagctggaggtacaagacgagcatcggcgtgtcggagctgctgaagagccacatcttcgaacagctcaagagcaaagcaagcagcatcagcaaggaccccaagagctaccggaaggctggcgagcaccgtggccagtgggcgctccagcgcaagggcctctaccagaagctgggctggagcgtcgactgcgagtttgacgagagcatcctcctctggcacatcgccacagacctctgcttctacgccaatcatccggcggacaaagatgatgacggatgctgcagctgctcctcgtcgtccaagtgtctccgttgcctctgcagctccagctcgggctatcctgatgccgaggctcgagggcgtgactcgaataagctggcgacgatgagcagggagatatcaaactacatgctgttcctgcttgtcatgcgcccgttcatgatgacggccagcatcgggcagatccgcttcggcgacacctgctcggaggccaagaacttcttccggcgagacgacgaggagatcggggacgaggagcggtgtgccaagaggctcacgaaggtggacacgtcgattgcagagccgcgggacgtgaagggggacaggagcaagtcggtgctcttccaggcgtgcaaactcgtgagacagctcaacgagctggagggcatcacggaggagaggaggtggaggctcattgctggcgtgtgggtggagatgctatgctacgcggccggcaagtgcagcggcaatgcccacgcgaggcagctcagccagggaggcgagatgctcaccgtggtgtggctgctcatggcgcatttcggaatgggagaccagtatagggtggagtctggccacgccagggccaagcttattgttcatcataatcatagtaccatgtaggcctgtttggtccattttctctgttcagccatccaccatggccagcagccgcaggatatgctttgagattcgaacgtacacgtaactgccccgctcgtatcactttctgctggcgccccagaatacatgccgtgggtcccaccgaactctgtataggttttttttttttttgagaagactgtatagggtcttggttttttgtttcttccccaatccccaacccccggatccaccgcctccggctagcaggttgaggtggggcgcatcgatctgtccgcgtgttggcggacgccagcgagccgaggagaaacaatctactttgtcccgccaggagcaccatttgttggcgtaagcacgacattgcattatattttcgcccgtgttgcctggaacatgtgtaattctcagaaaagaaaataccaagttcgaggaaatatttaaacacggctaattgcaacttaattcatgtggagcaaccaagacaaaagcgccaagtatatatcagtgtccactaggctgtgttccttggtcaaggtttccaatgatgcgttcaatgagtcgtgtttatatgtataaatctaatgatgcattcaatctagtttatatctgcaatgtcatgatttatttatggaataaattaaatcattatgtacttataatttcaacaggaaaaatgtaggattctaatagaaatgcaagtgcaaaacagatgattgcaaaacaaatgaaaaacccagaaatgaccatctgattaaaccaccggaaaaccaagaatcagatgagataaactcaaaggaaagtttccaagaagctgaagcgcttactaaattttcttcaaaatctctgtggttttatttagaaaatagggtaggaaaaataatatcccacctttcaaagggtaatattgtatcctaactatccattcttcacacttcatttaatcctagccattcatctatttttctttcctaatccaattgccaaacacaccttataggattgtctattttacaggaattttaaaaggtacgataggattcaatcatttgttttaaggggtttcatagaaatttttttctataggattagaattcttcaaatttcttatgtttttccttcatatcaaatgaccctacttgttgaagggtttcgtctgtgttgtaagttgtaattaaattccatcgggatttcgtaggtccgtgcaaacagagtaaaaggggataaaagcttttcagcagcttcgccgctgcagccgctttcctccggccgcattcgcttctctcttttccgccagccgccaccagaaaagcttcgtccacgagatcatgacgatcactgtcttcgtgggcggacgggaggggcatcggctcggtaaccggcgtgacggacgtggtcaaataacagatcatatgcatatgtggttaattacattgatgcatgcaattgggataattaaattaatgtaaaacacctaaacattcacgcatgcatgttatgggtttaattaccgagaatgctgcaaatctctatatacgatttcagggtccgatcccgagcctcagatagggccacgtggcatcaagcgttgcgctccattcgaattctcgatggagaatgtgccacgtattcccaccaatcccaggaccgttagatggtacatcaacggtgaaaaatcgtctggatgagttatttacaaaacgtaagatctaatcatctggaagattggaagagtccggagtattggacatgaatccagaaaaaaaaaatcgcaagaaaaatataaattcctatctcctactcaccgtgcctccgccctgcctctatccacatcgccagcacctgcatcggctgatgagcagggggtgatggcggctcgatctacacagcctgctttgcctagacatgcgtcgccttaggggggaggcgagaagcggcggtcgcggcggtgcaggagctcctgcggcacgtcggcgacggcgacgacgatggcgttctcaatcacgtcgtagattctgcgtggagtcagcggcccctcagaaaagctcgcgccaccgttccagctggttggccagagtcgcctcggccacggccacgcccacccgctcccctttgcccccaactccgatttcttgcgcttgcgccgccggaggccgctcccgttgggcaccggacccgccacgcgcgcgctcctcctgatggccgccgtattctcctctccgctcgcatggtggtggcctcgtgggaatcgaatggataatggagtaatacagggattagtttgcctcttcttcctacggtagtagtagacgaatagcagcatactccctccgtcaaaaaaaaaaaaaaaaaaaaccctggtttccatgcctaacgtttgaccgtctgtcttatttaaaaaaaattaaaaaaaaaattaaaaagacaagtcacacataaaatattaatcatgttttatcatctaacaataataaaaatatgaattataaaaaaatttcatataagatgaacagttaaagttggacacgtaaatccagggtttgccatttttttatacggagggagtatggtctgcatttttttaagcctatcccttctcaaacgctgccttcagcatctggctggcaggtggcaggtagatacgctttaatcgatcggtgccgtgcggtgcgcgacttgtggggtaacctatcagtttgacgcaggtaaaaataaaaaataaaaaataaaataacgaatgcagacttttatgtagcgttaggagttcccataaaaaaattttataccttgtcataccgaacatttagatacatgtatgaagtattgaacataaaaaaactaattatgcagtttgcgtgtaaattgcgatatgcattttttaagcctaattagtccatcatttgacgatgtagtgctacagtaaacatttgctaataacagattaattagacttaataaatttatctcacagtttataggcggaatctataatttgttttattattagtctacatttaatattttaaatatgtgtctgtatatccgatacgacgtaccaaccctttacaaccgagatataaacacccctttaattaccgcggcgtgataggttcacgaacacaagaagcgcaaaaatcttgccatcttacgtgcatcatagatagatcgaaaacaagcaataaagcacaatgtggtgaacgagtcatgttggatggattatttttatttctcttttttactaattcctccgtttcacaatataagactttttattattgtccacatatatatagatgttaataatctatacacatacatgtgtctagattcattaacatatagatacatatgttttacattgtgaaacggagggagtaatttaactgctcgttgtaaggctacattaaaacgagacaaatacataaaataaaagtcaaatatgagatatccctatatgactagatatgcgttcgatagtgtcaaaaggccagaaaaaaaatcccacgttttctatgcacatgctatccgaactgataaacaatatgttatttttataaaattctgttaaaaatttactctaaaaaaatattaatccatttttagttcaaataactactatctccatcccatattagttatcgctttgagtttttattcgtaatgtttaatcattcgtcttatttaaaaaaaatttggaattactatttattttatttgtgacttgttttattataaaaatgctttaaatataacttatccttttttatatttttactaatgtgaagtgggccctcagggtgtctacgtagttaattttctcatcaatggtttctaaggtaaaaaaaaatcagagaaatattaattaagaaaataaaaggactgaaatagaaagctgaaatacaaaatctaccataggtacaataaggctactgttaattactgtggcttgtacaaccttattctatatgttctatatctagaacaaggactaaaatagagagctgaaacatatgttctatatgtagcttattctacatggaatttttttttatttggccactcgtaaaagttacttccgttggaacatactagctacaaagagagcacaccaaccaacatgtttattttttccgaagagccggttcatgcgttcttgaagaattattaattatatcaacgacttgcacataaatgtttacataattgctctactaaaacattcaacatactagaattaatattttctacttgtcccattatgtagaaaagttctcttttgagatattattttgagacggctcttgcctactcgaagaatcgttaattatatcgaagagcactgcatgtgaaacatttacataattggcccattaaaacgttcatcaagctggagctttttttttagtttccatttatatgtttgtcgggaaataaacattttcagaattgtttccaaatagaagtatcacaaataccagctattatcgttgcttggttcatttaggatataagaaattaaaattctttcaaataactctacaacatttataaatcctaaatgaaaaatataaatattcataggttattgttaagttgttgcgccaaaggcgcgtctattttctagtcggacatctatggatgggtacgcctaataggcgatcgatagccatggggatggggtagcaatcagattcgctccccgcctcccccctccctccacctggtttcctttttttttcaccgcattatttttctattttagtaaatttatacaactaaagtttatacttctaaagtttacacatctaaagtttagagaccaaaagtttataagtcaaaagtttatatatccgattcaaatttgaatttgaattcaaatatttttttatatatagtatttctgtacatttaaagtttatacacctaaagtttatagacctaaagtttataagtcaaaagtttatatacccgtttcatatttgaatttgaattcgaattcaaatatccgattcaaatttgaatttgaattgaaatatttttcatatgtagtatttctatacatctaaagtttatagatctaaagtttatagacttaaagtttatagactcgattcaaatttaaatttgaattcaaatattttctatatatagtatttatatacatctaaagtttatacacctaaagtttatagacccaaagtttataagtcaaaagctgattcaaatttaaatttgaatttaaattttttatatatagtatttctatacataaatttttctaacttttgtttttcaaaaaaatttgtgtggtctactatagtagaaagaggagaaggagaggaggaagggggagaagagggaggagcgatcgctgggcgggtgggggagcgatcacccgtccattagcctttccgtctatggatcggactgatggatgtatgcgagtaagcagctaaatgtttcttctcattcctttcttctctctctaaatatttttctcctaaattacttatccgatcataccatgttgatgcgaaaaacacacactgggctggaagatctgctcagctccagtgcaggaccaaaagttgatgagatacggacataccagtaagtttgaccctacaactgacaagatatataaatagtagatcaatgagccgataggctgataagccgatagattaattccaaccgatgccgataccaaccgatagcgatagggttttgagctatcggctataattctgatgtagattctgacgcttgatgtaaataataatataaagacaatcggctgatgataatgcaagaaatcaacaatataatctgaaggttaaagcatatatcgactagaggtccgatatcataaaatccacagaatagattaaagcggtgaacggctaaatccaacttatatgcaatccttgtaagccgatgcaacgtccagatactttatcggctgaaacccagatgaaacctttattggcggtcaaaaaacaggctagggattatggttctaaacatgacttagtagatcaaacttgacttatgcagcactaagtataaaaagaaacacaatatctagataatcaagccgttgactgatttttagggtggtagatgccttatctaatctaatatagtaaaacaatttagccaataccggcagtaaccctaaagcgagagacaaccgataaagctaaattaagatactaagactagattaagacatatgataaatagccagacaaatatatcaaccaaaccagagcaatccaagaggtcgaatgtaccgatgcagccttgaacaacgccgacgtagacgatacaattgcctgggccagtggaacattggacttaccccttcgttagagatcgaaaacccccgcattaggtgccaagtcccgccggacgataaaataaagtagaaaaggtaaaaggtggcgatacgctgaattgtaattgatcgtggagatagtttacaataaccccgggtgtacatatttatactcatagggatatactagtccttgtaggacaagaaagaaactttcctaaaaataaaaagaaaactaacaaactattcctaattaatagataacttgccatgctgtatcctccttgaacttggtcacttctagataagcttcctttaatagattaatttccttaaccaaatatagcagaaatccgactattggcgatgtgataattctcttagggcttaccaaatttcaatcttaacacacggttgtattcgttttttattaaatctttacaatattatgttaaaagaaaaacatgtgtttcaaacctttaaaactcaatgtttcatactgttgatgcgaaaaacacacactggcctgaaagatctacttaacttctgtgcaggtccaaaatcttgcttttagatttgtgagcgtgccaattgatttgatcctacaatcaacaagaaagaaagacaagaaaaccgcggttaaatccataaacgatagccgatcggctaattgccgatgacatatcatttatcatcaagccgatgtcatattgggatcgattgacagtcatgaataaataagattagactaaatctactcgatcggctatagatattaacgacatataaccaggggcggacgtgcccattaggcggcatggggc

SEQ ID NO: 73809 - DNA, 29627 bp, Oryza sativa
acaaaaaaaatgtgaaacccgctcaattagttgaaatcttaagcataaagttttttttttcattaacaacaaacagcataacatttttttttcctgtcctaagaggaggtttcaagaaacagctgtctaactgttgtccttttttttttccttctctaacatgagatgcatgtatctattttgacaaaatccaacaatgtcagcaaggatataataatacgtcttcaacatatacatataaatgcataaactacattcctgctttcttctatcagtgaaatggcagagctccaacccattccctagaaaaaaataaactatattcctgatttgttcagatgaggagagacagacttgcaaatgctttattcatgctgcgatgggtcatggaacatgatatactgatgaaatactactgtgcaaataagaaaaatcatacactgttcatgactcgcatattggtagtcattccctcctcaatctttccaatctgggaaatataaggttatcagtatttgttgtaacatctaaggcagtgagcaagacctagtcaagcggttcaattttagctctgataagaaataagtagatcaatcatatgattgcaagcaactttccagtcccattatctccatttccgtccgctccaccaactccagcaacaagaatggacgaaggaaaatcagatgcctttatgattgtatcaatagtctcttgcaaatcagtcatcgcaccaccctggacaacaaagggaaaaacattgacaacatggaaacatgggttcagcgttatacatactgtgactattaacagaacgaagtatttctgctgattcatggcaagtgattggtttgctattgcagtagtagtgctaattactggacaaaatagtgttggccagccaatgatacattacgaagtgcactgatataaactgacataatcccttgtgttccttcaacctcaggaagtttaatatagtcaggcactcggccaataggcaaacagctaacatataatttcaagaagcattttaaaagcacaaaacactaagtacataatttcttacagaagaaaaggaaatgttctgtaaaccaaaataagatgggtgagaaaaggaagatttccacgtttgcttcccagatgtggtacttagaaattcttctacagaagatgtcatggtgattaaggtagcaaagagtaggatacctcaggttgatagatgctgccattcaggttgaaacagtggaaataggaaacaggacatcaataggtctagctccaaagcccccataaggggaatcgcttagcagggtcatagcattgtagtgcatctctgtttccagtactgcctgccaaccaacaaaaaaacagtggaagtacttaaatcaatgttgtcatatgaccatcagaacacaagaactaagagattgttacaaaccatttggccgaccagtgggttcgatgtaatgcaaggaatctggaagccatgggatttccatttgaagctacagagcacaaaacatccaagatttcaaggcaacgacttcaagacagtatgcgtttatcaactagagagctgacgatgaaatagtgggagggccagcaagaactagcacacctgtgaagtctatggctaccatgaaattcaattgacacccccctaatgagagagcacaagttagcattagattttgtccttaagaaaaaaagatagaaactcgccaccgctgcgcgcgcacacctaacctgcgccaaaaagcatgcgggtgctgtggatgccgcgcccgcgcggcgcggcggtggagctgagcgccgccgcatggctcgccgccccccgccgcgaggagcagcaggctcaattagccggctagccaacggcggccgcggcgcgaggcagggtgagccggtgaggccgcggcgcgaggcagcccgtggcagtggagcggagtggccgccggtgatcgccggcggcgtaccacccggccgccggcgagggttttgtggatggggtgcggcggtggctttggtcggtgggtttgccttgcctttgcctcgcctcggggagacttggaatgggagggagtgggccccactctctccctctctctctccaagagagtagtagtagtagtaggacaaaacaaatataatatttaaaaaaaaacacagagagagacgtacatcaccacccttggccttggccggcatctttcgcaacaccaactccgcctcgcctaaaacccttcctcaatctcttcttctccggcgccggcgacggcgttgcaacttcaacgatgggaagaagaagaagatcatcaagctagtttttctagatcatttccacggccctatccacagtttcgtcaccactctctctccaatccagtgcttgaacacagcaaaagctcctgctcgctatatctatctactccgattcaaaccccccaaaccccttccgatcgatcccttgctggtaggggtgaaatcgggtcgggttcggtcggatctcatccttcccatatcctaacccacattttataatcggaatcgggtcgggcacggatattatcggatacgaatagaagcacggataatatcgggcataaatacggaacgaatacgtaccaagacggatacgaactctatcggttacgaatatttattcaaatatcaagtcaaagcaacaaccaaatataccacatagacaatagccattcagccatttcctatatgtctattatgaatatattaggggcttatggcatcataatgcctatcagcaaaactgtaccaaagtagtagcaaaagtagacattcattgcttgatagcttcagactcaatgctgtactgatctgaactgtgaagtgaaggctagggtttgtgcttggcactttgtttggtgggccttttggatgtgggctggctgttgcctgttgtgttggcctgttgggcgcttgcctgttgggctgttgtccatctatccgagtaatatacggatagattatcgggtaatacccgcataatttcccggataatccgtatccgtcggataccgctctcccgaacccgatctcatatccgcaaaaaattacccgtattcgaaccctgtatccgtgtaagggtccgggtacccaaattcccgacccgaatttgacccgaaataatgtggccgggcgggcggtcgggaaatacccgccccgttttcagtcctacttgctggtacgcaaaaatgcctccaacgaagaaggacaagggaaaggaaaagattaaggaggtagaatgataatttttttaaaaaaagcttcatgatctttattttttttctgtttcttcgcgcggtagcttgatgtgtgtttggtttgtgcatttgaaattttgcgtgtttcttcaacagcccaagccatcggatgatttctacttggatctgggtgatcttcctaagagctatgccaatctaatgaaagatattcctcgtcgcttggaagaaattatcaaagctgaggcgccctccaccagtaaggggaagaagctcttcaagaaaatctcggggaagctatatactgcccagagtggcacatttttggttcatctcacgcctgataaggatactgcagattctggaagagtgtctctgctattccgctggaaagacttgtatttcgagggattttactccaagggtacgtattacggtatatctaatctactcgctttatcatgcattatattactaacttattaagaacactagccatactgcctcttgcttgctggatgtgccaattgttgttggttgatttggtatgtatagtgctaacacatggagaatcggagacgcacgattgcaatggcccttgtccaggagtgttcatgcatatgcaccgcttttgtctggaattgtttcgaattgggaggttaaatcgttgcaaagttggagtactacaagtatttgaggcctggaatagttttgagtttccaaattaagggttgtagttctatgaggcatgattaatgctgtagagacttgcattagcattctgacatgaaggatgcaattaatcatgtgacagtactatatatatactcttgcttgcatgcatgcatgcatatgtcaattgtggttggttgcatgcatatgactctcactgctgggctacttactagcacactgacacactggtgtggaggagcattgcattgcaccacacccccttttgtcaatttggagttaatttgtttaatttgggaggttaattaaattgttgtacattaatgtgtacaatattgtgttaattgccctatctgttgctttcgcagggatttggttcaggctacaggattttcaggcagaactccctcctcagtctcagttgccatatgctgccaagggtgggaaaggagtggtgattctctcaatcgaatctaactatgcagggataggaggaaataccatatacatgggctctgatgcattcgacaaatgtctgaaagcaatgctgagagcacctgacctggaaggtcataggctctactcggttctaaaatcaaacagagttctagctgtccctgttgtaggaatatctgaacctttaaggttccctcaattccaggaatgggttctctcaaccctctcaccacctcctaccgatgctgaccactcctcgtcgtctgatgatccttctcctggaactgatgctgctgaatcgtactctgctggaatgggtacgggcagggacaagaaggttcctgagaaattctccttctacttcacaaaatggggcacgctttctgaaggattgttgaacaatagtgttccagaagaatttagcacgatgtccattgatgagatggctgcacttcttggcattctccgatggatggaggggatgtcattacctgcaccaaggagtggaactcatgatagtgaggcctccagttccagaccaagcagggctaccaagggtaagcataataccagtaaatagatgatagctaggcacaagatgtcaatctggaaagagtttgaagctggttgcggacaactaaggttgatgtttcgatcaggcacaaacgtgcttttgtgattgagtgagaacatatgcatcacacgtactaagttttcaactcaaaatacatgcaaataagttgtaaaaaatattgttcgaacatggtaatttgcgtgtgttttttattctttttatgatgcattttgagacaaaattttaaatgactgtgcatatcatcattgcaatctcagattattttttcttacaacaaaagagaatggcggacgcgacagggggctgcatgacccacgttaatccgtcttatatattactctctccgttttaaattataaatcgtttttaattcgattagaatcaaactattataagtttaattaaatttatacataaatataataatatttacaacaccaaattaattttattaaatctgtaattaaatatattttcataatatatttattttgggttaaaaatgttattatttttttcaataaatttaattaaatttaaaataatttaactttaacaaagacaaaatgattatagtccaaaacgagggagtactagttaattatctgagtaattaagcctactaatccactgcgcgctgttcacgtacgtaagccatgaccaccagtccgagtcttgcaagcaggcactaggcctcacccatatacgacaagacgttagttagacagtttggtgaatttaactaaactaaatcatttctttgattacttacagtaataatggtaatttaatcaaccaataaaagccctgatataaagccctcatgaattttagtccccatggtataatggcgaaacatgcccaaaccatctactctagtcgatagtattgtgttactagtttatttcataagcacacctatatttaatcatgcatgtgtgttcagtgttcgccacttaaaaggatgaccatttaagcgcatgtttatacattaatataaacacttcctgatccttttcaagtaacgataattaacctttgtcgtaagtagcattttttttactactattagtttctataaatccatatagtgtaacattataagatttatatttctaaaattcactagaagaaatttttttataatgtataattaaacaacattgacctgatcgatttgccctattaatctttagttatttgagtggttttacgtgtaatttcaaggttgttttgaaaacacccgatccactttgaaatctaacaaaagcgatatagatacctatacaactcaccatatatatatatatatatatatatatatatatatatatatatatatatatatatatatcttaaactttaacatgcaaaacatgtaatatgacatcttaataaagcacatacgcattacatcatcatccacgtttaatttccttctagtagctagcttaatttcacatctagtactacgaccttccatttcaaatatacgtaatattggattagcatacgtacgtaaatattaggggtggttggatgacctactagctagtagttctaaaagctaagcgaataaatatgttttcttgaatttaacacaattttattataattgactggcataagagagaaaatatagaaactgatttgatttgatttgaatgtctaaaacaactttatatttgtataagacttagcaaatctatgaaatcttgatgaggggatcggagactaaagtacatgcaagtcacttgagtacgggcaagtgcaatgtaagaataacaattaattaaggaggaaattgataatattgccactcgatttgttgggcttttcaccctctgcgtaaggaggatttgagccctttttttcactgattagtcacatatgcatgaaaggaccaattaccaatgactaccgttattagttgcgttaaactggtgtcagttcaaaaaaccggcacctataggagctttggaaccggcatcaataaaaatttttctactagtgatgcctgttcgatcatccacctgctgccattagcaccagctaccgactaggagaagcggctaagtgctaccgtcttgaagcaccctgcccttcaagctcctcaatattccccccactcccttctaactgagctccacttattgtcagaagaacacaaggagaagaagcaggactattgtcgatcaccccaagttcccctcccctaaggatgttgagatgcgccaccaccgtcaagagaaacaccaaacctcacaggcaggggtggatctaggatttgcttggagggtggactcatcctcttcttctcctttcagcccccctactattattcccccttccctctcatcttctttccgtggggatccaacggggttgaggggactcaagccctccagtattcacgttggatccgtccctactcatacagaagtcctctagcatcgcttgctatgtctactatgctacttgtactgtagtgtaggcaggtaagttagggcaagagtccggcgggagtataccagaggaaggccggcattgagatgggggctgtcaaatcttggcgtgcggcacccgagtcactcaatttgttctcggctggtcctatggagacatagaagaagggagggggtgcgttatataggtatgtatactattgtataggcatcatcctctctatgccgaatatgtgcaaaatagtaaatcttcaaggtaacaacgaagtgtagcaaataattcattaatttgagcgtggagggtgttattttatcaaggccaagtggcaaaccgtcgattttctcttcattaagcagcctaaagatgcatttattattccgtttaattagctatcctggtgtttacatccaaatttggcacctatggacgaaatagaggaaaattgccaaagtttggagagtgccgggtttccttcatagggccggtcagaccagaggtatatgggcggtctgaccggctagtagggccggtctgaccacaggtatgtgggcggtcagaccggcagggtccgagtccgagtctgttttcgtcgggtctcgggtttccttgctcgggaaggcatgtttcgtgtttcctttggtttctatcccgagttggacgtagagaagggcctatagagggtaagaccaacccctatttaagggacaaggccggttcattgtaaaacccccaaatacaatctacttgaatcattcttttactatgttttctattttaccctagttttagtccatctttgtcggtttgcgccgtaaaccgtccgccgccgctgcgagagtgcgacacctctttgtaggtttgtcctgaaaaccttccgttttgcccacgagacgggtagttatcctcatatcgatctaaatcagcctagaggctgattttgatctctaaatcggctccgctagccggtttagcttttctttttgcaaaacccatcttgatttggccctttggttagatcgaggtggttggcgactccatatcaccgcaaggcgtttaggtgttgcgatcgtgcttgtcgacttgtcacaaaaagttgccaacacgatttttggcgactccgttggggaagagatccgttcatcgtcaactcaacttcgacttcgccatgatgaagccgccatccaagacggaggtggagccatccaatatgatcctggtcacattggatgacttcgaaggagaagatcgtaaagctatggaggagtacatcaacgagttcacgcaggaggcgttgatgagggcaagcactaggactcgtcaaggcgtgatcatcaagcccgggccacgtcctaagctcactcccgactcggtaagcaatgatgaggtatcacaatctatccaacaacaaattgcatctacaatagattcatctatgcttgtttttaaagatcaattagatgcaacttttgagggtaaatttgatgagtttttaagggttaaattcggccctcttttggccgatcacatggtaaaaaataaagcctcttccactactaatcaacctcctataggtcaaaccgaaggaacggcgcacacggccggtcagaccgcgacacagccgtcggtccgaccggccagacggccggtcagaccgggtattaccccggcggtcagaccgggactcaggccggtctgaccgcgcctctggacgccggtcagaccgggcattgggccggtcagaccagcgcaattataccaatacaggggatagatccaatgactaatgctaggtatttgtatcatcttagaacatctgatcctcctatatctactactacaagcaatccccaagttcccccacatgttcctaatgcctataatgatgttgctaggggatatcctcccgatactagacaaggccaatataatcatattgcgccacaaacacaacctattaggccaccaaatctaccgctaaatcaacaagggcctaataatatggaggatataattagtgatattatgaggaatagattcaggatcgaaactaggaatcgtgctagaacttacaaaaagccgtatcctgattattatgacattatcccatatcctcgtggttataaaattcctgaatttacaaagtttagtggtgaggatagtaggaccacatgggagcatgtagatcaatttttagcgcaatgtggtgaggctaattggaatacatgtaaattacgcttgttttctttatctttgtccggtactgcttttacatggtttacttctttaccggcaaattctatttctacttgggctcaattagaacaaaaattttatgattattttcacactaatgaaactgagcttaagttgtctgatttaacatcggttaggcataaatgcaatgaatctgttgctgattatatcaagagatttatgaatgttaaaaaccgatgttttaatttgaagataactgacaaagatttggccaacattgcatttgatggattacttgattctattaaagagaaattgaatggccagatatttcttgatgttgatcatgtgttgcatgaagttctggctcaggaaagccgagtgaatgacgatagcttacatgctagtttagatgaaagtgcaatatcatgtatagccgaaccaagcgatgtttcagattgtgttaatgatttgtgcaatgataccataacgattatagccgaaccaaatgttggttcggattatcttgctagcttgggtaatgatgcaacaatcattatagccgaaccaagcaacggttcggagtgtgttactagtttagacaatgatggaatagccgaaccaagtgatgattcggattgtgttgctagcttagagaataatgccattgaagatatagccgaactaaatgacggtttggattgtatcacaagcgaaagtgaaatagcattgtcacctaagaccgagtcacaaatcggtcgtgtggatgttgaaaagatgatgacaatgtcttgcggaatagtagtgaaatagaatccaaagtagccatgcatacatatcaaaggccgtatcctgaacacgtagattcggtcccatacccgcaaggatttgaggtgcccaacttcacgaaattcacaggtgagaatgctatgactacaatagagcatatcggccgctttattgatcaatgtggtaaggccggtagtgatgatttgcttaagttgaagttgtttcccctttctttgtcaaactttgcatctacatggtatagtttgcttgctcctagttcaatttctacatggtcacaaatggagcatgagtttcatggttatttcaaagatgcaagcttgatggagcaaagaccgattaatacttcatcggtcacttgtgaaactatttcggttacacctatgctaagaccggaattgttagtaattctctccctattaatcctattgatgttgataaaaagaaagggaaaaatgttattgttaaggatcctcggcccaagacacttaggatcaataatgcgaaggccgaagatcataaagttgcaaaggatgagtcatctagtatccaaaggaccaaaaagccgaagctcacttttgatatgcttatggctaaatacaagaaaggattagccggtcaatgatttgacaaccaaactagtgattcgaaaagaccaagatcatctcgtaggaagagatttggtcaaacatcaaagcaatcggagccatcaaccataccaactccatataaacctccaattgtgatgccatggtatccatatccaatgtcactatatggttatccttttatgtattacatgccatggatgcctcaattctctacgccgtttcatcaaggatgggaggaatcacctagggcagtaccaagtcattctaactcaagacaagaccgtttcccacaaaagaatcggtccggtggatcaaaggtgaaaaaggcgaagaaggtgtgggtgaggaaggaagccaaagctccggaggtcgttgctatcaaagaggagtctcaagatgttcatgtacctactggagatgcgatggaaattacgcaagcaaaggagatcgaagccgacgccgtgactgtcaacattggtggtctaaccgagatagctggccggtctaaccgccagactatggccggtctgaccaaccctcctggccggtttgaccgacggcttgtggccggtctgaccggacctagaggccggtctgaccgaggggcattagagaagagtgagaaaattgagagcaacacaggaggttccacttcgaccaaaaatatgaagaatcatcatttggctcctggaaaacaaccacagccgaagtggataccttccggcttatctcgctctcaaaacaggaggcttcagcgtcttcgggccatgggtaaaaaagaaaaggagaccaaagatgtggagaacaaaacatgtaacaatttagatcctcgaacgacatctaggcaagtgtggagacccaaagaggtaaaagttaagagaccggtgatttcccatagtagagataaatccaatttgatgagagaagaatcatcggtcattagagataagtctccttcgcatgatgctatggatgttggtgcggtgttcatcttgccttcgaaatcgtgcagtcgagaaagccgattttgcttgaggggcaagacattaatatgctcatgaagaaatcaagagaagatgaacggcgatggatacaacatcacatctttgagccgccgttcgtcggatgctaaggcaaggtatgggtttattgtgtttaccattatatgcctatgccatgttaaaacattgcttgtgtcagggttacgggttaggtataccccttacccttcgatatgcaccacatatcgacatggcatacccgcgcatacacgggcattatctgcatatactaaggaaatcttccacagtgtttaagtcctactcggacaagacagggtcgtcaatatatcgtgtagggtccgatgtctccgagttcgacttggagaccacttgatttgcgatataaaagggatcccctgggaggacctaaaggatggaatctgatagccaacacaacccccacagcctacgaagtcggagcctgcaggagccaaatcgccggggatctagtcgaatcaacttaattacgatctcgccgcttcatcgagttccattgttccctttgtaacatgtggttttccatcatataatcccatatcaactggattaggactattacctatcaaggggcctgaaccagtataatttttgtcttttattgcttgatgtcgtactacgtagatccttgtaccaacgtaccccaataccctctatatccggtctacgggtatcacccgtcgacagtggcgcgccaggtaggggggcttggtgctcaaggttttactactatgtcatccagcttcgtcgacaacagcgtcaacaccaacctcaaccacgggtttcctgcttcaacaacgttggtgtggactcaagtcggcgaaatcgtcttcccggtgtacaccacgatgccgatctcagccggtccatcaatgaccggaaacgagaacgcagtggctgcaacccaaggcgactccatgtcgaaggaccctcccgccgaagcagggaatggaacatcgacaacacccgagcttgagaaggattctaatgcggccgaaccttgtctttccgacaagaaccacgagccgacgagaacagcttccgaagcgacaaggtcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctccgcgatcacctgaacggccgacgagaagcacgtcgcacacagggcaacgggagccgctctcgacatcacatcccttcacggcatcacgataatgaagaacgaggaggccgctcgaacgaagaccgagaccgtgatgatcgcgacaatcgtgagcggcgggcgccgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaacccactgcccccagcgctgggtgtagagctttcggtcgttccctgcgtgatgtccgatggcctgagagattccgacccggaacaatagagaagtacgatgggagtactaacccagaagaatttcttcaagtctactccatagtactttacgctgccggagcagatgacaacgcattggcaaattatttgccgactgcgttaaaaggctctgcacgttcatggctgatgcatctaccgccctactcgatttcttcatgggcagacctgtggcagcaattcgtcgccaacttccaaggaacttacaagcgccatgcgatcgaagacgacctacatgcgttgacacagaactcgggtgaatccttgagggaatatgttcggcgcttcaacgagtgcagaaatacaatccccaagatcaccgacgcttctgtaatttgcgccttcaagtctggcgtcagagatcactatactacccaggagttagcgacaagacgcatcacaactactcggagattattcgagattgttgagcgatgcgcccacgtggacgatgcgctgaggcgcaagaacgataagccgaagaccgggggcgagaagaaaacagccacggacgcacctgagttaagcaagaagaaaaaccgcaagagtgcgaaaaggaaggctcaagcggaagttctcgcagcagaatacgctaacccatccaagcgcccagacccacagggtagcgacgcaaggaaagcatggtgccccatacacaagacggacagacattctttagaagattgcctcgtttttaaaaagtcgctcgagaagcacatggcattggaaaaaggcaagcgagtacgcgtggtcgagaaggacgcggaggcagctgctcaggaattggactcagcatatccagactctgacctccacgtttcacacatcttcggaggctccacatcgtactcttcatagcgagaatacaagaaagtggaacgtgaagtctgttcgacatggcagggggctgcacctaatatgaagtggtctgaacagaagatagaattttcggaagaagagcatcccaagactgccgttatcccaggacgctatccgatcgtggtcgagcccactattcggaacatcaaggtcgcgcgggttctcattgacggtggcagctcaatcaaccttctcttcgccagcactttggatgcgatgggggtcccacgaagcgagttgacgcctaccaatcaacccttccatggaattactccccagtcctcgtccaaaccattgggcaaaattacgttgcctgtgactttcggccaagcaaacaacttccgaaaggagcagatcacctttgatgtcgctgaattcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaacaagccatacgagaagagctcgacaaacttctcaaagctggctttatcagagaagttcttcatccagagtggctagccaatccagtcatggtgcggaaggccaacgggaaatggaggatgtgcgtcgatttcatcgacctcaacaaggcgtgtcccaaggatcacttccctcttcctcgaatagatcaactggtggactcgacagccggctgtgaactgttgagctttctcgacgcttactccggctatcaccaaattagcatggtgaaagagaacgaagagaagacagcattcatcacgccgttcggggtattttgctacgttaagatgcctttcggactgataacagcagggaatactttccagcgcacggtccagggcgcacttagtgaccagctcggcaacaatgtcgaggcatacgtcgacgacattgttgtcaagaccaagacaagcgactcattgattgacgatctgcgggagacattcgacaacctacgacgatatcgcctcatgcttaatccagagaagtgcacgttcggagtaccgtcgggcaaactgctcggtttcctcgtctctggcagaggaatagaagcaaatcccgagaagatcaaagcaatcgagaacatgaagtcgccacaagactcaaagaagtacaaaagctaaccggatgcatggcagcactaagcaggttcgtcgctaggatgggagaacgaggacaacccttcttcgctctgctgaagaagaaagacaaatttgtatggacacaggaagccgaagaggcattcgttgcactcaagcgctacctaacaaacccccctgtacttgttgctccccaacctaatgaagaattatttctttatattgtcaccacgccatattccgttagcaccgtcattgttgtcgagagagagaaaatacaacgaccagtctactacgtcagcgaagctctccatgacgcaaagacaagatatccgcagattcaaaagctgctctatgcagtaatcatgacatcaagaaagctacaccactactttcaagcccacagagtcacagttgtctcctccttccctctcggtgaagtcgtgagaaacaaagacgttgtcggccgcattgcgaaatgggtagtcgagctaagctagtttgatgtccactttgtgccacgaacaaccatcaagtcccagatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccgagttatccaagtatctcgcagaagttaggaagcaggagaaaaggttcgatgggatcaaggtccgacacgtataccgcaaagaaaacgtcgagccagacgagctagcacgacgcacgtccagacgagaaccactcgaacccggcacttttctggacatcctggcaaagccatcggtaaaagaggtcagcggcgaagttaacccagacacccccgacatcagctcggaggccacagaggcagaacgcgccgttgccgatatcaaaaccacagacgactggcgcaccccactgatcaaattcatcaacagcgacgagttgctcgaggacgatgcagaggccaagaaaataacccgtaaagcaaaaatctatggcacgatcggcaatgatctatacaagaaagcgccaaacggggtacttctcaaatgagttccgtccgacgacggcagacacctcctccacgatatacacgaaggcatctgtgggtcacacgccgtcggtcggacgttggtcgggaaagcttttcgacaaggattcttttggccaacctccctcaaagatgcatgcgacatggtccagcggtgcgaagcctgtcaatttcacagtaagcacacaaagctacccgcgcaagcgctccagactatccctctcacttggccgttctggtgctaggggctagatatactcgggcctttcccatgaggacagggcggctataggttcctattcgtggcgatagacaaattcacaaaatggatcgaggcgatgcccacgggagaaatcaaggccgacaacgccatcaaatttatcaaagggatattttgcagatacggactaccacatcgcatcatcactgacaacggctcccagttcatcagcgccgatttccaagattattacatcaggctgggagtcaagatatgcttcgcttcagtctctcatcctcaaagcaacgggcaagtcgagagggcaaatggcatagtgctacaagggatcaagacccgtgtctacgacaggctcatgtcacacgacaagaaatgggtcgaagaactcccatcagtactatgggccgtacgcaccacaccgacaacgtctaacaaggaaacacccttcttcctcatgtacggctctgaggccatgctccccagtgagctacgacatcaaagtacatgagtacagaagtactccgacgaggatcaggaggaacagcgaaacgacgatgtgaatctactcgaggaacatcgcgaacgagttgccgtccgagcagccggttaccaacaggccctccaccgttatcacgagaagcgcatccgagcacgcatactttcgacgggttcaaagccaagcagggcgaaacaagctctcacccaaatgggaaggaccttacatgatcacgcaagtcttgcggccaggcgcattcaagatagcagatggcgacggccgcgagttggcaaattcttggaacattgaccaactacgtaaattctacgtataggtcaatatcatccatacctgtaagacaccttacagtatcaataaagcctatgttcgggcacatattacaattacagtgttcatgcctgatgatcccttacccagatgatacctagcgttgaaacctatccttatgtccctttacaccgtcctgacaaggcctccgaggaacctaagggatcctcggctggggacgcccagagccgataaggtcttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtctaagagccttgtcccccgagaagtatcctccgacgacaaggctgggggctagggagagtgtacgactcaaacgactgaccaaagtcgtgaactgaggaaacactcttacacactatatccagagtaagaaagattcaccaagatagatttcttccctacttcgcaaaatacttcttacaattatatacaaatccagaactttattacattctttccctaagatatctgtcacagggtacgaatactaccaagaaggccaacgccagtccatagactggaaaaccttctccgctaacggtgccatcgacttcgccaggtggtctatctccgcaggagtcctctgagaatgagtgaatccttcatggagaaactcgaggtgcagttgcggacgatgatctcgtacacaagccaatacatgccctcctgcatatcggctcgatcggcggcattcctgtttcagagcctcgtcaatccgcttgccaacgccctcaagctgagtacaagccccattcaaccacgggatatatccggctgctgactcctcgggatccccgcgaggtactcggagctctctgcaaacttgggccatggacgtgcagcaactcttcaggtatgagttgaaccacacctcacgacctcaaagtgtttccacggcctgctccttctttacttccaacatggctctctcgagttccaccacttcaaatttcgtcttccaatattggatacgacgatctcggtcagcaagtgcgttctcgaggtctgttcgacatggaaacgactacgttaggctgctcttctctctcgagaacacggttgatcaagtcggaggagcgaaaaggatgaaaaggccaccaaccaaaggaagtcgtcgccgtccccgctctcccgggtacaatgtcattcacatcgtccagcaacgcgtgtccctcaaacgcaagaatcggagggatcactggcgactcaggttgcccgcgctgctggacaccctcgtcatcagcatctctacaaaggacaaaaattcccgaggtcaacatacaagggcaaactagaatgataattgcacgtattctgaggcggtccaatttcaagttttacacagcatgtcttggaagtacaagaagacctactcttcaaatagggggagaacagattccccagatcaccgacttcttccatcacctccttacgcgtggtactagccgccccctgatccaagatctcgcgcagatcgagttcaggacgcgatagctttacgcacgcaaggacataacacgccccagtgtagatcccgttcgatgtctcctctgcgaccctggccgcatgcttggaggggatctccgtcatcgccgtcaatagtaccgcaagggaggaggtcagcgaaaattcgtcaggattcaccgggatggtagacttgatgccgcactccccggcaagctggtgcagcccagtgtaggtgacccgcaacgagccctgaatttccgacaggttgtgcccgagttccgacatgcggttctcgagcccctaccgttgtcgctcgttgccggccaccagttccctcatcttcgtgaggtcttcatgagcttccgccaactcgcgcaccaaccggtcagcacgcgcgttcgccaacgccgcttctgaccttgcctctgcaacctcgtggccaatgctgcgggcaccagcttctaggaggcgccccatttcgacttggagctcctcccaggcgaggatagcagtgggcggaccacgacctgccgcgggatcgctgactgggccactaggcgtcacctcccggctcccagctgcgagtacgacatccgtcgaggccgcggtaggcgaggcgctggaagcccctcctgacttgctctgcgcggcctttgcccacgcttccctatgggacgaccacggatcatacaacgcttgaacagaatcatgggaacttaaaaacccaactacttacttctcgccgatcgtcacaagacgttgtcgtcgcggaggcgggggagatgcgtccaaagcctgaaagacaaccaacgcgaagtaaggcaaaatccctctggctgcgcgatctggcgataggataacttaccgagggggtcggcgctttgcgacgatgtccgcttacagaggagaacttcctcccctttgtcggagcattgccaccactagtagtggccgcagcagcatcagacgcctccttgacaaccttctcttttagagacgccgccacctgatggtccgcgagcggcccgatgatgtcagtcagaggaagagcctacgcttaatcaagtcataagatgatctcaagaggaaaggcgggatgtccatcgagtatacttacgttaatagcggcatcacgctccgtcgcccccttttcacaaaggggcacggggacgtcactcgccgttgtcggtccactgatcattaactgcccgacttggcgctccacggccctactgctcaaacctgtgaatcgaggaccaagtttcgataaatcaagaggaatgcgaacgtgagtatgtcaagataaatacgagaaagataccccgaggagaaacctgggtcgcgtcctcaggcctggaatagttaaaggctagatgggcccgagcctggagcagctggatccgcctaccaacgaagtccgcaacgacttcataccccgacaagccccgcactcggagatcgttgatgaagtcgataaacgactgaagaaaggggtcaaaggaggcttggcggtccaagacgaaatcttgcccggttgttctgtgggaacgatgaagacagggttcgaatctttgacctcaagataaaaccatctattccgccatttgttgcgagaagaagggcactagaacgggatataacgcgacttcaggccatctcgaagtcggaacccaacggagccagataccctgttggactccatccaacgcagttcgtagtagaagcgaaaaagatcaagaaaagactctaccccaatgtaagcctcgcaaagatgagcaaagatgctaagaaaggcaatagaattggggttcaaatgaagaagagaaagaccatagaagttcaaaatcaggaggagaaattcggaaggcggagggagaaaaccgcagagaacatagtcttcgatcgcaaccatgcgacctaagacgggctggggattagtacctcctgcttccctctccatggctccacgaccaggaagggcgccgtcttcctgaagctccttcagcgatgcgctggtggaagatgacttgccgaggtccatcgctgatcgaagatcgccggtgaaaggacctaagttgctgaactagggtttttgcgggagtggagaagacgagaggcgcttgggggctggagaatttttccactacaggcggacttcaaatgaatccccaaaactcccttaaatagacgcacttccgacggtgcgaattccaaggaaagaagagagatggccgccggaaatttctgggtccgttacgcgcggcggtttttcagactttagtttaaactcactcgtgaccgttgggcttcacacggtgttctcgatcatgtcctgtctctacggttcccacaccgagaacgacatcagcctcgacatcagaagtcgttattggtcgcacgggttcatttaagcagaagttgggggctactgtcagggttacgggttaggtgtaccccttagcctttgatatgcgccacatatcgacatggcatacccgcgcatacatggacattatctgcatatactaaggaaatcttccacagtgtttaagtcctactcggacaagacagggtcgtcaatatatcgtgtagggtccgatgtctccgagttcgacttggagaccacctgatttgcgatataaaagggaccccctgggaggacctaaaggatggaatctgatagccaacacaacccccacagcctacgaagtcggagcctgcaggagccaaatcgccggggatctagtcgaatcaacttgattacgatctcgccggcttcatcgagttccattgttccctttgtaacctgtggttttccatcatataatcccatatcaactagattagggctattacctatcaaggggcctgaaccagtataatttttgtcttttattgcttgatgtcgtactacgtagatccttgtaccaacgtaccccaataccctctatatccggtctacgggtatcacccgtcgacagcttgatatttagcacatgtgtgttttgcttatcaaatccatattatacatacatgttgcaaatgccagttctaagtggtggaattggtaggttggcatataatatgtttgaagtatgatttggctcatcagtctttaatatttatttaaagccaaatcgtatgtgtttttatgggtcaccatataagatatagatttattgcaccatgaaagttttgcttattagtaattcggctaatatcaatggtcaatgtgatgatttgttttagagttattttatttaggaacattggcattgttaatattttgcatacacgctcaagccaattacttacatttgtagtttattggaatctatgcatgtgacacatatgactttggtgattcattattgattatacttcaattggctaagtgttttgatgccatgatgattattgttttaaaagccatttgaattagtattcatctagacatgttagttggatgttatagtttttcatatgtctatagagaagaaaatttggtccaatagtttgatacaccaagcatctggctattatgtgaagaaaaattatatactaaaggccgatgcttgatttcaaaggtttggacgaaattggcaaagtcatagaccaggggcggtctgaccagcattgcacggccggtctgaccggtggtaccggtggtctgaccggctctggatggccagtctgaccgggcagacagggtggtctgaccgacattgcgtggccggtctgaccgatcccagacagaaggctgggggcacattacagttgattaaaaggccgaattaattgtgaattcggacatttgtgcccatgagttagaaatagcttggagaattcctttgattagatatttgaaagatcctacacttaaggttgattggaagattcggcggcaagcattcaaatattatatcgccgaaaaatagatggagtattgttgaagtacttagataatgatcaatctaaagttgctaggagaatagtacatgaagggatttgtggaattcatcaatcggcccgtaagataaattggttgcttaggagagtggggtttcattggccgaaaataattgatgattgtttcaaatactatagagggagtgaagcttgttaacggatcagcaatgttcaattagcgcctaccgctgtgttgaatcctatcattaaactatggctgttccgaggttgggctttggatttcattggtcaaatttatccttcgtcatcaaaggggcatcggttcatgctagatgtaatggattacttcactaagtaggccgaagccgtgccgctcgagaatattacttacacggaggtaattgactttatttttgaagcatattgttcatagattcggtattccttaaactttgatcgaggagcttcttttatgtctaagaaggtgagaagttttgccgaaattttatgatattaagttgttgagttcttctctctactacgctcaggctgatggataagccgagtcgagtaataaaacattgttgaaattgccattttgccagttgaggtaaatcttggctttcttcggtattttaagaaagacgacttatcgattgaagattacaagaccttgatgggaagcaattttgaagacgtcatcgacaagcgtttgaagactttgaaggagatgaagacacttcaagacggtgttttcaaagagcaattaatgggaaatacttaaagaaatacttcccgagcatttggtaagatgcttaggaagtcctatggccggtaattggattatcgccctaagacaatatgttctatgcttttagattcacgatattcatcaaaaaggcaggggggcatgtgtttacaccaaaatttggcacctatggacgaaatagaggaaaattgccaaagtttggagagtgccgagtttccttcacatggccggtcagaccgtaggtatatgggcggtctgaccggctagtagggccgatctgaccgcaggtatgtgggcggtcagaccagcagattccgagtccgagtctgttttcgtcgggtctcgggtttccttgctcgggaaggcatgttttgtgtttcctttggtttctatcccgagtttgacgtagagaagggcctgtagagggcaagaccaacccctatttaaaggacaaggccggttcattgttaaacccccgaatacaatctacttgaatcgttcttttactatgttttctattttaccctagttttaatccatctttgtcggtttgcgccgtaaaccgtccgccaccactgcgagagtgcgacacctctttgtaggtttgtcctgaaaaccttccgttttgcccacgagacgggtagttatcctcatatcgatctaaatcggcctagagcctgattttgatctctaaatcagctccgctagccggtttagcttttctttttgcaaaacccatcttgatttggccctttggttagatcgaggtggttggcgactccatatcaccgcaaggcgtctaggtgttgcgatcgtgcttgtcgacttgtcacaaaaagttgccaacacctgggtccaagtttaactgattaattataaataatctttctaataatgagtattgtagtctctgtagatctacgtgagtacgtgcataccccctcgtcccaaaaaagacaaaccttgggtttccgtgtccaagtttgaccatccgttttatttgaaaaaaatatgaaaaaaattaaaaagataagtcacgcataaagtattaatcatgttttatcatctaataataataaaaatactaattataaaaaaaatttatataaaacgaacagtcaaaagttatacatgaaaactatggtttgtttttttaaggacgaagggagtatcatgcatggcagaacagattacgttatatgggctaagtacgtgtggcgcatgcacttaccattactccattctactcgtgtcccgatcgatcgagctggcaagtggcaaccacacgcaagcaatacgtacgtacggtacggacgtgtcgacgtgaccagagtgtcacggcaccacatgcttagtactgtttaaaacgttttgattttgatcaaagtttcaattttaaagtttaactaagtttataggtaaatatagttacattaataaaactaaattagtttcatcaaatcagtaattgaatatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctgctcctgtgttttggtggatctatgtatgaagaagctacaaaagagctggagaaccagaaagctcttactctctccctctctgatcgttctgtatccgaaaaaatcaatcccccttctaagtgggcaaggtcctccttttatacctcaaggggataccacatgcaccatctctctcttttttttttgtggggacttatcctctcttttcataaacagacggagacttgtatggttgtcgtccgagtgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctctggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggtaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccagcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagagatgcccggcgccacgctactcggggtggtccgtcttcttcctcccttttgctatggcagggctggttccgccattttcttctttcttcatggatgttatggagttttacgatctccagatggcgcacctcatccccaacgcggtaatgacattggccatcttcgcgcacctatgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccagctggcgggcgccggtagatctgggagatggctatgtcacgtcccaaatcgaccctaaaattcatcctcgaaattgtgcaaagaataattaaaattcatgtgaaagcctccaacaattaaaatgtgcaaatctaaaagtcaaataaggcttggaggatttttgtatatttcctaaaagcctaaaatgcgtaaataaattttagtggaattttcagagcacaaataataattgaaaagaaataaacaaagtggaaaaggtttataaaaagaaaaaaaccctaaaagaagtcttctttccccccttcccttcttgggccggctcggcccaatcctctccttccctctctctctctcctttcccccgcggcccatcggctcctccccgcgcgcgcgccgctaacaggcgggcccgcccgccaccctcgctgacgggtggggcccacctgtcatcccccacctcgcgccgcgcccgccgctcgcccgtgccctagcgccgccgccgtcgcgaatctcgccgcctcccgccgtccccgcgcgcattaaagaggggggaattattccccacgattccctctctctttcccccggg

SEQ ID NO: 73810 - DNA, 53364 bp, Oryza sativa
  unsure (1)..(53364): unsure at all n locations
gaccgcctccgcgagtacttctacaagtacggcgaggtggtggacgccgtcatcatgcgccaccgcgccaccggccgcgcccggggattcggctacatcgtcttcgctgaccctgccgtcgccgagcgggtcattatggagaagcacatgatcgatggccgcatggtaattaaaatcaactttgtttgcttacatcaacatgtttgtgttaagattcatgatgatgatgatggtgtgctagatccatccatggtggtatgtaatggtggtttgtaggtgttactgattgttgtcgtttcgaggaattcagaatgttttttgggattttttgttttgttttgttttaggtggaggcgaagaaagctgttcccagggacgatcagcacgctcttagcaagagcggcgggagcgctcatggatcgccggggcccagccgcaccaagaagatattcgttggggggctagcgtccaccgtgacggaggcggacttcaggaagtactttgagcagttcgggacgatcaccgatgtcgtggtgatgtatgatcacaacacgcagcgtcccagaggttttgggttcattacgtacgattcggaggatgctgtggacaaggcattgttcaagaccttccatgaactgaacggtaagatggttgaggtcaagcgcgcggttcctaaggaactatcacctgggcctagcatgcgttctcctgtcggtggattcaactatgccgtgaacagagccaataacttcctcaatggatacacccagggttataatccgagcccagtcggtggctatggaatgaggatggatgcaaggtttgggcttctatcgggtggccgtagtagttatccttcttttggtggtggttatggagtcggtatgaattttgatccagggatgaaccctgctattgggggaagctcaagcttcaacaacagtctccagtatggaaggcagcttaatccatactacagtggaaattctggtagatacaatagcaatgttagctatggtggagtcaatgacagtactgggtcagtgttcaactcgctggctcgtaatttatggggtaattcaggtcttagttactcttccaactctgcaagctctaattccttcatgtcatctgccaatgggggccttggtggaattgggaacaacaatgtgaattggggaaaccctcctgtgcctgcacaaggtgctaatgctggcccaggctatggcagtgggaacttcggttatggatccagtgaaaccaactttggtctcggtaccaatgcttatggaaggaatgctggatctggtgttgttaatacattcaatcaatcaaccaatgggtatggaaggaactttggagattcatcaggaggaggtggcggtggtggcggtggctccatctatggagacacaacttggagatccggatcttctgagcttgatggaaccagcccatttggctatgggcttgggaatgcagcttcagatgttacagcaaagaactcagcaggttacatggggcattaacaaatagaggttagatatattcttaatgcttatgttctgtttatctaaagttccattttgttgctggctagtgtttcaaccattaccttcatgtggtgccgctatgatggtagcaatgtgaaaacagtgtctttaaatattgaatattcattctgctgaaacaatatcgctagatgaacccatgcatattcaatgcttatataggaaatgtttttaccattgcaaatataatgctagtgttagttgtcctaggaaaatactggatgacactgatcattcaagcgtggtaacaccacttggcagtttggccttttatagaaaaacaagtgtgtgttttttactgcttctggagtatgttagatatttactcaatgttgcaactgttacgttaaaatgcgtatgatgattctctgaatatttcattctttggttggttattgcattatttatgaactagacatcaatttgtttggatgattcacccatcaacgtttaggcatgctgtccaagtagtacaacaattaaatttgtagctgtgaaaacagaagctatgcgtccagttttgacctgtggttcgtaatagatagtaacacttgcttggtgtagaaactttattcccttctccaattattgaactttttgtcagtgcttaatgtgttatgtgtgtagcgtcccatcaagctggagattctagttaacatattcatgacggtgttatatttagacattaatatgcctgtgatatatccaatatatagttcaaaagtatacatttgttccatgtttggctaccacctaggtatactagggtcatgggttcagctagctgtttagtctttttggatgttcttagctttctagttgttaggttatgtcaccaactcaccaaacttaaagtatctgctaagaattataaggtacttaggaaaactgtgtccctttaataactagttttttcattgattccagtctcaaagctggaaatcattaactcgacaaactaatcttatttatgattagcttctgaaatatggtgcaaacatatattttagattcagaataattctgaagtgcttcaataacttgaaatttcgttgcaaatgatatgtttcagttcttatcagaaattcagtattctgaattcattgctcttaccacaactaaccatgacataacattttgcttgtttacgcaatgcaaatattaattgtggtagtccttggatgtttggtagcttgagtcttcagtcatacggtagacaactttgcatcttagataaatataaatggcctaataagattttggaaacttaagcctgacctgagtattttattttagagaatgaacttcttaggggcactggtgtaataatttttttgtcaaagcattcttcaagttgatttttgttaaaaaaaaagatcaattattacaacatgcttgtactcatcttattttgaatgtatgcttttcatcttcgttatattacactgctaaggacattactgaaactaaaccttattttttgtgctctttgtttttctgcatgcattgcacaacactatatatactctctaacttttatgttctcctgtgcagcaatgtcgccgcctaggaatctttttcacatacaacatttgtcaaaataggttgaggagagaaccacaggtgcatcaggtgcaaattttgaacctcacatgatttacagaaatgggttagttaatagagctaaccaccagggatttggtcaatgagatcagatatatatcctcagagaaccatttaaacgtatttccattttatgtaaggtttgagattgtggtttcggatttctacagcgagtttaggttttggcaaccttgtgttttttcttggttgagatgtgaagtaagattgcgggatatatatatctgaagagtgttcagttgtacggcggcgctgcccccatataggcccccctttttgggtttttgttcttatagtagaaactgctctagcgttttgcaaattgtgtgctagctgttgttatcaggatgataatttttttccccttcttggtttttatcttactgaagtgtatgtaccagagatcttgctggtctgtgtttttcctagtggaacttttaagggatgccccttctgggtctcaaagaataataatgctacattatattctaattcattttgaggctttctaaggctatatattatttgtatgtaccctgctggaacatctgtacattctgatgctctttgcaatttgcctttgtgctgcttttgcatcttctcttctgggtctgtctagtggtcagtgggtgatgcctggttcttctaccatgcataatttaccttgtataatgttgctattgtaccatctcttcatgtgccttttgatggctgggctacatggatgatggctctgcaggctgcagccatgcttgaggattgtgatgttaacatataataatatcttcatcttgtgatgtacagtaaattaccagctttttttttaaaaaccccaaatgcaagggattcggtaattgatatgtcaatcactattccttctgataagctccagaattttgtaggagagtcatagacagttgagtttgtgatttgtgaatagattagaaattaagtagttgaagttattaatagattagaaaatcagcaacctgtcatgagaattaggaactactcccctcgtctcaaaatataagcattttttactctaacacggtctccgagatgctactttgaccaacaatatctataaaactaagatgttttaaataaaaaaagttgcatattatgatattttgtttaatgataaatctagtaaaatcaattttacatgattgatcttttttataattttgttattaatagttaaaattaaaaatgtttgacttgtcactatgctaaaaatgcttatattttggaatagatggagtacctgtttactccgtatgtgataggtgcctgatcttttaactcttaattattgattttcatatgcagcccaacctaatttttcatgcttaatcaacggtttggtatcagctttcaattcttctagtgttaatgaagttgcttcaactgatgagcagttaaaaaaaattatgaacaatttcttacagcagaattctccatagatcgcttactgaatgtagcttgtcagaatgaaaacagtcacttagctcttgcatgatgtgaaacagcgtgctcgccaaagaagttttacaaattcagagtgaagcagttgaaaagaagttatgccccaatgcaagtttcctttttttttaaaaaaaaaaatcatggcccattagagaactacatcttttccataattccaaccaacttgaaaaggcattttgcaaattcaattgctccatttgaaaaggaagattaccccaagtttttttaaacaaaaatacatgacccaagacagaattgtgtcgtcataattcatttgcccatagaggtagagaattaggtggtagatttttttttttggggtgtagaaatcgatccatgcaagcaaaacaaaggtgctttcctaactggaccactgctattaatagacaattctttagaaattatatagcaatctgatttttaatagttgatgctattgatttttcgatatacattttgaccactcatcttattaaaaaaaattactacctccgtctcaaaacatattgtgccaaaacataacatggggcagaggcagcatgtaattgtcatttattttattgtgacttgatttatcattaaaactactttaaccataacttgcattttacatatttgtataaatttttaaataagataaataatcaaatgtatagataaccgtcaataacatcttctattaaagcaaaggaagtaattgttatgatgggaagaaactgtcacttagggtcctttgaatcaaacaatttatgaaggaatttgataagatttaaattttattaaaaaatatatttggtcctttgatataaaggattggagctttccaaatcctataaaatcctattgaatggctcatcacatctagattttggtgaaaaattagcaaaaactccaacatcttagaaaacttcctttgaggcttatctctttcatcctattctttttttccccttatccgatcaaacaattattcatgtattctctttttacagaatcatatgtcttttctacgttttttctattctgtttttccattcaggttagaaaagggccaagcaagtaatcattttcatgtctcgatcccaatgcctttatgattctactctggttccataattcgtgacgttttagacattgacacagtctccaaaatatatctgactatgtttttctattataatatatgcaataaataatttttcattttattataatacttagtaaaacgaatctatatacgttgttctagtgtctttaaattaaaaattagattaaattagaaattatttatagttaaagttataaaagtttggcctcaacgttatccgaagcatctagaattatagaaccgaccgaaccaaagaattgaattatgaatccaaagggagttcagttaaattgaaccacctaaccctttcatacttaaagggaactaactaaatctgtttaggtctgacagataaagtgctaaatttgtttagctctgacagataaaggaagacatgatcatggcattctttctaccgtgaatgatcatggttgtgactttttgagaaatcatgcaaatggtggagacaggatataagtttcactgatacataaatcactaaaggtcttctgaacaaatccagactgatgtagaagttccaataaatacaagtagtacaattcctgttctgccaaaaaaaaacattctctgaaaatacagcacaacagagctcagagttgctagttcaccaaatctcctagaatctctctattcaggcattcagttctgtaagaacccttttggtgcattatacaggaaagattaggccctcaattttgttgcctacatgaattcaatacccaattaattggtagctcccattgataagctgcagactctatcttcatctctttcaatctttcttgacacggttccgagccgccttggctgagctcgatcgctctgactgcgagaacatgatgaagacatgcatgaccgccgtcaccagtgcgagcccaaggcccgtaaacccgactcctttccatgtcgacaggagttgagtccataggaagagcttgacggcgccatataaaaggagacatgaccaaaacaaagtcacctgttacataagcagaattagaaagtcagtaactaaccaaacactagtagcatatacatacaagacgtcctatggaagttgctacagtaattgtattggaccaaacaaggaacagttctatgcaggcttgcagcaagtacttgagttttgcatttctatcaccaacagtgtgttcttacggtagtcccagcaaaacacctcccctgatcctctgacttggccctgacaaaggaaggggcttcgacccaagttttcagtttcagaccagacaaaccccaaacagcctgatttcgaattttaaaaaagatgttttctataaaattaaactgtttttttttattttgacttgttgagcatggaccaacagactttgagctaacccaaaaatattcacagttggtacagctgcaaatactgccactagctagccatgctcactgaaatttgtcttctgctcactccaaattgcccctcacactatgcatctccagttgtgagcaaatatatcacaaccatggtcaaaagggccatttctatgtttttatttgcctgttcacactcagaccgtactggtatgtctgcacactgccattagccctaggttctaacctagagactatcttttatgcaattaagtaaaatgctccggtattgagattttaccagcaatgattttactgggcggccaattggtctaatctcctcatcaaaagtgcctgtcgccaaatgcttatccagtaatgcatcctgtagttaagaataaaggaacatacaacatttacttcagaattaattgatcgaccaatgcatttggcattttaactgtaagatgtctaaataaaaaatatatatagctcagcacctttgctacaaagatgtctttgcaccattttgaaacatcgtcttctgactttggcatctcactcattgcatgacgtttcatgcgaacatgtacctagagaaacagtggagtggaaatttgtttcaaatcaaatcaatttattatgactatgtatctatatttatttgcaagacttcaacagtgaaaagaaacccatcaaatttcaatatttagttctgcaacactctcttgattggtctgccattagatatccaagaagttagcaaacataccactgaagattgccctttcaaaatccgcagcattgttggttgaggtgaatcttttggaataattactgttgtatcataaatagctggaacaaaatcccgcataatagttacagctgatacaaatccctggaaattttcatttttttcacaagaggtatcagtaaatagatttaatgctgcaatacgaaataactacatggccaaatgcatgacataaccatgtattcttaataactgtaaggagctgatcactcagccactccataaacagattaaagaagtaactgttgtactgaaagtattacagtcatatattataaaaaaatgctgtttcaaattgtcattttagaacttcaattaagctttaattttactggaagtattacagttatatctttcagttagttgcttttgtttatttctttaaaacaatttgtgaatgtccaattgaccagtaaaaatctttttcatataagttcaagaatttatcttgaaatttagcgtattaggtattctttttcaggaaggtaataaacaggcaggcatcatcatattactatgttgaaacacctgtacacatgtttatttcggaatagaaaccatcagccagtacaaaagaattttcagagttcccctatttctcttttgtactcttatccataatccatcaatattacgagtagtagtgtctgacatctcagtcttcaatgcatgattttggctatggtggttttcatcattatgaaattactcattgtctcgttctataaactacattttaactatcaaagtttgaaaaggttgacctcatgtcaatcaaaatctaaaaacataacactgcataccggatagcaactataggtacaaattaggcaggcaacagacattacatgtaaattttggcagtagagcacaggacccacattgttacacgaggcaagttgttacacatgtatcttacattcgagtgtttcgaccttctttgtattgttctaagagatttcaaacacaagtaacatttatctacgtttgaaggacagattctgcatcctaatcacctatgaagttgcgtatgtttaatagatacacactgtgaacatatgcaacagaaatactctaatttaaccgtagcacagaatatgcagttctcgatatgtgaagattattacatttagaattacccatctgaaatctgtagtttactagtgtctagtgtatataatatgatgttttcatttctttcatatcagaactattacaagggtaaaacttgggagaagagatttatatttgtgaattctgatgcaagaatacaggaataccagatacaagaaatcatttcagctagaaaaaataacatacctttgtacgtggaatcaatacatttctgggtgctggcaaaccctgtgaaacagcatactcctgagctgctagaagctttgctggagtaaagcgagtgccctcaacaaaaagggctagccaaaatggtctggggaagtccttcaacctttggaggccccactataagcatagcaagaccactaagttaaagaacaaacaatagaattatgtgtgtactgtgtagatgaggtaaaaaagttactttcaatgtcttttcatcctttgcccagctcctttccaaaaagaggtattctgcaaaccacatggaccagccaataacctgcaaaatgcaatcacaacattgagcatgtctgcatgcaatcaaaaccgctaagtactatatcagaagatagataactgaatgcttcgcatgtctgtgtgtctgcatcactgagatactagtgcacattacattaggttatggatctccagtaattacaaagaactgaacccgataggctgcttctccatcagatttctagcaaaagcagaacacatcttttctgatcttagttgatggacatcaaattttcttcaagattgcttcataccattccattccacattgtacagcttccataaaagttggttgcacgcatattttcatgtgtaacagagagtttgaacaactatagctatgttaccagaaacacaatgtatgttctactactagttcttagacattttgggtactgaacatttaactgccaacctactctgctacttattgctacaacctgaatgacatccacttgactgaatacaaagttcaagcatatcaattttagccacccttagattaatatacttagcggttggagtggtggaatctcaagtgtaacatatcatctaacggtattatatcaaatttgcttcaaacaaattcaccatcaacaatcatagagctctgatgagaaggaacatatgacataataatgcaatatgttatcttatcataattttagtcccaagagcaagtttaatattttattaccttctttacattttttttcaataatagctttatgcacataacttaaaagtcagcggcactagtctataagggactgaactgcaaaacaaatgttccagtaaaatgtacatgagctagctaactcactggaaggaatttcgatgatttcttcataacagcaagtgtacttccaaggcatcctgagcgctgaccacatgacaaaaaaaagttttggatgatttattatatattacagacaaatctgtatatactgaacttctaacaaaatattgcagtgtaactgatgtttcaacaactagagaatgagacctgtgccaaaatccacccaataagccaatcgatatcgctccgatgatttgatatgacaagtgcatgctcattccctacaaagattcttcagataagtttgtaacaaaataaatgacatggtgaacattgtaagcactatcaactgtgctataaaactgattcctcacccattgccttgtaagtttcgtcatcagcatgcagttgtatctgcagaacatgggttgaaattattttaggggaaaggcgaaatggcaaaaattaaaattgtttgcttcattaacatcaaatcaaacatttaatcttaagcagaatgctcaagtggcaagccggtaaattctattgtaatctgaattgctgtacacatggatcattcgcataatgtacagttagttaattagccaccagaatttgattgattatgctgtactctaattttactgccataatgaagagaaaaatgcagttggatttcaattttagctccacgggccaaattcaatcacaacagtggcagtattaacatggctgtttttccagactcacagcatatgcagctaaaccctataaaaaaaatgtccaggcatgaggcgtccagaaccatcaaaagagagagtccacattcaaacttttctcactgctcacaactcaaataatgagctctattaaattgtaacatgcacggcatacacataaatgcaataacagttaatttctgatctgaaggttctggttgccgattcggttatactgtcctaatgtgacaaaaggaagctatttcacacggatgatttgcattgcacaacggttccaaaataaactttagaacattgcgtgtacatcaaatgtgggtattttaacattttagcagaacaggtaaatcttgatacgaagtgcatatcagaaagatgctttgtcactgaccatatcaacataccttaactcctgcccaccaatccacaagccagaccagctgaagccacagcagctcggccaagaacctgttgatccgccggtacaagctcttcgagaacggccttatcgagagaaacaggacggcctgcagtttttcacgagcatacgagcagatcaggtaatgccgcatgctgatcttgctgcgtagttgcgcgcagattagcagatcaaatgaagcaaagtttgatgattctcgttacagtttcgcgcagtgacagacaatttttttttaaagtgaaaataatttagtaatcctaaatctttgcctaaaacagtacaaaattaacccagaaatcctagctacaataatttagtaatccaagaaagaggctacaaacaatcgacgaaatgatttgcgcaaacagaatacaaaaaaaagaaaaagaaaccaaatctcgcgccacggccgcatcagatcgcctgagatacacaagggaagaacagaaaagaaaagatttcgccaccaatctagctgaggattcgggcgcacctggatggcgttgatgatgaggccggagaggaggaagaggaggccgagcgggagcacgacgagcacgagtgggaccgccatggcccctgccgccctgccctgccctcacttccaatctcgcggggccgagatgcgaagaggaggcaacgggccgaggtggctggatgctcacccccgagggagcgccctctcctcgtcctcctcctccggcggcggcggcggaggcggcggcgaatccaccggcgacgagaagagacgagacgaggaggaagaggtgaggtggggtgttggatttggagattttatagggggttggatggaaaaagacgcagtgaagcgtgtgcgcccatggttccccctcaccaggagaagaagaggatggatggtgtgacacctcggataatgattgctttttttcttcccaattttttcgaagctactcttacaatggtgtttgagatagatttaacttaatatgatgattgatgatgaaataaaggtatgaaaaactagaaaccctattagtataattaattatgttttcgttattaaaaaaaattaaaattagatttatacggtattccctccatttcaggttataagacattttaagtttggtcaaaattaaattatttcaagtttgactaagtttatagataaatatagtaatatttagagtgaatttcagaaaccccgggttttggggcacctataacacaaaacctcaggtattacgatttgttttaaagaaccctaagttttgggtcaaaatgtttcaagaaaccacatgtttaagcttatatcatcgtttttggctaatatatttatgcataataattacaaaaataataatacgagatatttttgagtatatataaatgttagcctcattttaatgaatataggtcattggtagtatgtttgtttatacctgtaaataataggttaatgtgttattattaatgaggttatgttgcgtttttatcatttgtgcaactcaagagtgagaaaaagataaattacataggatgggatgtgtttttgaaacctactaatgtaaacatatactaaataatcatatataatatttaaattatgagtatttgagtaaatatggggtctcttgaaatattttgctccaaaacatggggtttcttgaaacaaatagtagaacttggggttttgtgttacgagcacctcaaaacctggggttttgtgaaattcactttaatatttatactactaaattagtttcatcaaattaataatagaatatattttcataacaaatttgtcttgggttgaaaatgttattacttttttctacaaacttatcaaacttaaaacagtttgactttaaccaaaatcaaaatgtcttataacctaaaacggagggagtattttaaattaacttctatataaaaagattttgcacgaaatacaccatttagcaattaaaaaatatgctaacggaaccgaggtataatttatatatgaatttatatcttaatcagaaacggatggggaaatatgcaccagtaaataaaatcatacatcttgtgtatattgtgcatcttcggttataaatcatatcgtgcatcttgtgtattcagaaaatattgcaattgtaaataatagagtgcatctcgtatatttaaataagggtttacaatatcgtttggccagtaaaattcgagacccggcaagacatcgatttttcttcagtaacccttgggcatagttcgatacattttgaaagaaaatcaacaaattttgaaccaatagcccgaaatgcactgcaagacctgaatttcgagcaatatctcgtgaaattgtgaacctgaatcaaaccaatttatttaattaaatactatccagaaaaagtgggcgagtggtatgagaacatgagaaactttgtggtagcaagtgtgagaaacatgttacgttacactcgttgtatggttggaaaaaggaaagcagcaaatggattagtgtttcccacaatttggtcaaacaattctcagatgagacgtctaaaactctcaaatttgcgggcatcgttcgtttaggggtgatgggggagattggctctcgtttttcgcgcgcacgcttttcaaactactaaacggtgtgttttttgcaaaaaatttctataggaaagttgctttaaaaaatcatattaatccatttttaaaatttaaaatagttaatactcaattaatcatgagctaatggctcacctcgttttacgtatcttcccaatctcctcaatccccttctcctcaaacactccgctgcgttctttcggggagatagggggattgtccctcgttttccgcgcgcacgcttttcaaactactatacggtgcgtttttcgcaaaaattttctataggaaagttactttaaaaaatcatattaatccatttttgaagtttaaaatagttaatactcaattaatcatgcgctaatggctcacctcgttttacgtatctttccaatcttctctatttccttctcctcaaacacagccttagtaatcaaagacaccgttacgtgttatgctaatcattgggtttccaagcaaacttacgtgtaagctgatctacgatgtgaaaacgacactaacagaaagcaaaatacaagcaacatatatactgcagtttctcaactttactagttcacctttttaaacgttatttgcatgatgtcagtatttttagttttgcctcgcaaaaaaaaagtttctttagttttgttttagttatacatatgttacatttagttgtgagtaagatataaaagtggcattacaatggacaagaagaccacatgatacgcttggatcataataaaaaacaatattaacttgagctcacatgaagaacacctctagaatgtgttccctgttgacagtgagtctttttctccgattcatatgcatatactccctccgtttatttaatatatgatgccttaacttttatcctaacatttgactattcgttttactaaaataaagtatataggtattatttattttgttatgacttatgttatcatcaaataaatttcaatatgactgtttttttatacatacacgtttaaataagataaatgatctaatgccatgctaaaaactaacgtcgtcgtctgtaaaaataataatagtatatatcattggttaaaacagttcatatgaagtacattttctcacatcagtaacatgctagaggatttcagattcttttttttaccaagataaaagaaaaacagttgtcaaagtacatgaatgcccaagggggaacaatgctattagtcatcacctatgtagaggacaaaaaggttgcttttagatgtgagtgaatttaatgtcgcttttatctctccataaattaggtgtaggtatttgttggtgagcccaaaaattgagctgctaggagtatctactttggcatctcacattaaaatcacacaaggtgaattaaacaaggttctttgtgcaaatgttccttgaatgtggcatttgcaaaagggctctcatgcacgtttgttgctatcaatcagtatcaggtggttcaactaagagcttactgattgtgtcaaccaaggtcatattccaagacatgacctaccaaagatgttccattaatcagtgaatcactatttgatggtgtcatagaactgaggtttaaccaccactttgacttttacgatatgtttgatggcaacggaaactagagaaatacaaagaatgttttgtaggtttggcttttattttcttttttttattggaggcttttttttctagaacatggtttcttttttttttaaggttgttcttttactttgaaaagtgcgatgatggaggaggataactgtacctttacattactactatttcagtatgtaccaatatattataatgggccaggtccatatgggctaagaaatggtgattaataaggatataaagtattcgatatgatggttatgttacacggagcgtagtgtacaaatgcgttgtgcgcggtgagaggagggttgaaaggagaacgaaggtctgacacagagataatcatcatttgatggtaccatacactatatcataattgtggatggatccataattaacccaaatctcaaaccaactgaaaagaattaatccctagtacatagtaaagaaaaaatattcatcctaatgagcctctggtcatatactttatgcaacgatccaaatagccttgaggttcgggtccacccctagtcatagcagcatagtttttgggttcaaagttcaaatgttggggccgtgtttagttgcaaaagttttcttcgaacttccatcttttccatcacatcaaaacttttctacacacaaaatttcaatttttccatcacattgtttcaatttcaacccaactttcaattttgatgtgaactaaacacacctccaatctcctaacttcaagcacatcaatcttgaaatgctgcatacttgcattgacaaatttgtttatctttaaacatgtgcgaaataatcaaacacaacggacctcatcttttcgcatatacttgtgtttatcaaccaaaatttaaatttttaaccttaaatttgaagctgattttatctttttatcaaggcttattttttagcttttatttttatatcgctaaggacgcgtaaataaaaattttattctctcacctgaccggtggggtcccacctgtcagcctcacatccctccaggccgttactacccccatcatcaccaccaccaccactccactcctctcccctccttatccccttcgtctcccgcctccgctcccccgcgcggccacggcggccatggccaccacctccacctcgtcgctgctgcctctcctcccctccaggaccccgaccccgacccctcgccgccgcctcccgttcgccgccgccgccgccgccgcagcggcgccacctcgccccttcctcgtctcctcccctccgcctccgcccgcgccccgcgcccgcctcgcccgccgcgccgcagcggggggcctgtacggtggtggtggtggggaggaagagggagacggggaggatggggagatggaggaggagtattatgatgatggggacgaggagggggattgggaggatgatgatgcggaggagggggaggagatggacgtcgaggcgatggaggaggaggccctcggcgccgtcgccgacctctccgagcggctcagccgcgagctccgcatcggtgagtggggggtttcagcttcgattcgctacctccgacatggccaggaaagtaggaaactagttagtgcttgtgaagagatagtagcatttagcctaaagtgcataatctagtgtagtagaacaatcctgtgtggaattttgagtcaatccgtagttccgtactctggtcgtggcggggatgttcgtataagatcagatggatatgctgcttgttgatgatgaactgattgttgtgccgagaatcatgatgatgcagatcaattgatactttgccttggagcatgatgtatgagtttgggaattgcagttccctgtatttctatatttgaaagtttagttgttagtgcctagcgtcgcaaagtttttcaagtacagtatttcttcggttttctcctttagaagcctgttacatacttacattgactttgtttagttcatgggctaaatgcgttgtgtcttcagatgacgatgttcgggataaaagaagaatcatcagggataagacatcagcatctaaacatgtaattatatcttcgtattcttgtaaattgtaaccctagttgacaggctggttaagaaagtgcaaatgtaaacaacttctattttctttactattgggtccgtgattcagataccggataatcttcttccaagggtggcaataattggaaggcccaatgttggtaaatctgcattattcaatcgtcttgttggggtaagctatttacagctacaaatattacttgagcgaagagtcagcattgtgtgtaatttttagctgaatgcagaggctgctatggtgtattgaattctggtgtctcacagggcaacagggctattgttgttgatgaacctggtgtgactagagatcgtttgtatggacgatcttactggggggatcgagagtttatggttattgacactgggggagtgattactctatcaaaatctcaagcaggtgtgatggaagagcttgctattacaactactgttggtatggatgggattcctcttgcctctagagaagctgctattgctaggatgccatcaatgattgaaaagcaagcagttgctgctgttgacgaagcagctgtgatactattcatcgtggatggtcaggcaggttcagacaattaccctttttttaatttgatcatttcattttctggattcttctgttatatttggtagttctgatttttagcaacactttctactgcaatagttttttcaggaatacacaaaagttttgcgtatcattgcctttctactgtaatatgaaggaatcaattttagcacctggtcctgccaagtgatggactgttgattacatactaaaatccaccacatttacaattgctccaataatgtcttgtagtatggtagtttttgtacatgtggtaaacaaaggcatctagagaaaaatattagatattcctgttagcatgtttcttgtctcattctctttgtgtgatttctgtctgaatcttctattgggtattgaagcattccttttccaacttctgcatgctgatctattaaactttttaagcttctggttattttctacctggaagcagacttacgtatatggattcttatttaacctagctcatacgtagaaagattgaatgtgtgtttatagttgctagatttgataaacctcctggtgctgaaatttttgttttgtctagtgcctttgttgcttcatgcccctgactaagttcattcttacatggatttgcattacttgtagctgtaattccctattgttgtttttcggtactgttgattgaattagtgttatgtagtgtcttatctaacggaatgggtatcaaaaatctttcaggatggccttgtggcagctgatatagaaattgctgattggttacgtcgcaactactctgacaagcatattatacttgctgtaaacaagtgcgagtctccacggaaagggcaaatgcaagctttagatttttggtcattagggtaagttcaacacgcagtgaccccttgctgtaattacacaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttctagattttctcctctgccaatatctgccattactggcactggaactggagagctccttgatatggtgtgttcagagctaagtaattttgaggtactgaacttgcttagtttgcccagaggccagggaatgtttaattgtgtatgtctatatgcatgcttgatacccttttctgtttatggttggtaatggaatcattattataattttttgttgcaacactaaaatgttactcttggctgcggaaacaactcaagtattgcttctgacaaatggatatgctaacttagtggaatatttcactctctttcctccagtcctacaaacctagatgaatactgctagaaacacgtggtgtggtgacaccttgttatatccagcctacccattgagcttctagatccagaaccttgaatcataagttgtggtgtttgtcttttcagtagttctttaaaatagccttctcctttccaattttgattcatatatggaaatattttgtccattacctcacaaaatgttttacaggaactggatggagttgaagaagatggaaactatattcctgctattgccattgtcggaagacctaatgtcgggaaaagtagtattctcaatgctttagttggagaagatagaactattgtgagccctgttagtgggacaacccgtgatgccatagataccgagttcaccacagaagatgggcaggtttgttcagaatgcttatgaaagtttaagtgaccaagagcagcatcattatttcattattgaccctagctatgtccacttttcatgcatctttcatctttgtagcaaaacacaatttgaattggaagaaagaaatttacatctcataggaaagtaattctaatttgctgatattgcaatatgctgcagaagtacaaactcattgacaccgctggcatccgacgaagggcagcagttgcttctgctggcagcacaacggaaacactttcagtaaaacgtgcatttcgtgcaatccgccggtctgatgtggttgcccttgttgttgaagcaatggcctgcattacggagcaggtatctctaccccatcacatgcacatgtgcacccccaaacaattcaaagagatgttgtcttaccaatcttttctaacatggtgaatttctgtggtaccaaggactataaaatagcagaaagaattgagaaagaaggaaaagcatgtgtaattgttgtgaacaaatgggacacaatcccaaacaagaaccatcagagtacaacatattatgagcaagatgtaagagagaagcttcgcatactcgactgggctcctattgtttattgttctgcaacacatggcagcagcgttgacaagttaatcccttaactttattttttactccgcaataagcatttggtacttcactactatagcatttgatggtttaagctaggctatttgtagcttgtcggtgttattgtctattttcctgcataccagacctgaaatttaagctgatgtcattaaggcattaactaatgtttcatgctgaatcttcatgttcctctgttatctcccaatttcttgtaatccaactaattgcattgcatgtaggagattgttaacttcactagatatgtttttctgtattggcattgtaattattctttatacacaaatattcctcaggataatttctgctgctgcactagttgaaaaggaaaggtctagaagacttggtacgtctattcttaatcaagttgttagagaagctatagcattcaaaccaccaccacgaacaagaggtggtaaaagaggtcgtgtttattacacaacacaggtagcttctaacttcttattgaaccattctgtttattcctcttaagccaacaagtttatggtctcacctttcaagtaagtcgtaaaggtcactagcgttctcttgatctctactacaactaaattttcacttccttgtatgtcaagtgaagtccttaaatcaaatacagctccttaattcatttttaagtatctgaagatatatgattgattgaaactggatcccttaaagaagtatttcaaagtcagcaaaggatccactggttacccacttcaaagtatatttgatacactcactgtcctaagatagagtagtaatatgcattctgcaatattatcagggccctttgaaatccgtactgcttttagatttgtaaagttcaccttggggaaatgttttcatgctttccttttattttcgcaccaaaggaagcttattcttaacctgcaggctgccattcgtccgccaacgtttgttttctttgttaacgatgcaaaacttttccccgagacattccgtcgttacatggaaaagaagcttcgctctgatgctggattcccaggaacccctattcgtttattgtggcgtagcaggaagagaccagataaaaaaggtgagtcgatatcaaagtgcccacttgcataatctcaatgattttaactgaataatttttctactatcatacctgcatgcatagaattagaaaagattattttgtgattgaatcattgaaacagacagaacgacaatgctagataagtgaaaaaacacagaaggaacaaatattgtgctatcagcaagagagatttttgcagtcccattatatttgatttcaccaatttctatgatatatgtaggtgtaccgtgcacatgataggttaaggaccttggtccttgtattagaacaaatataatgctaatatctgctgaggcttgtagcatcaaggtagttgaccaaagtaataagaatacaaaatatcatgtgatgatagaacatatagaaaaactatttaattgatctgggtatatccaacaccgctatgaatttcatattaggagtaatgttttgtgctctaccatacctgctgttataagtcatatgatgatgaggttaaatagaattgtcatactaattactccatctgttcttggcaggtaaatctgcagacaacagcttgcagagctcagtaatcccaagcagaatggcgttagccacatgagttacacatgcttttcctttcttgagagcggaaaaagggagagaatacagaatgctttgcctgcattttttcccaagaggtcaagactgccggtaaaaaaagagtacaaattgtatatgtagtggacgagtactaggactggaggtcatctactaggtgttgtgactacatggtgctagtataagttctgtatccttggatgtctaggannnnnnnnnnnnnnnnnnnnnnnnnnntctgacatttgcttgtgccttggacgaatactgaatagtactctctccgtttcaatttcaggttataagaagttttgactttgatcaaaatcaaactacttgactaaatttatatacaaatatagtaatatttataataccaaattagttttattaaataataattgaatatattttcataataaatttttcttgggttgaaaatgttattatcttttactacaaaattagtcaaacgtaaagcagtttaactttgaccaaagtcaaaatgttttgtaacctaaaatggagatagtagtatattgcgtaccggaatttgccacatcggtgcctccacatttttttaacgtctcgcaacaatgcaaagttcatattcatattgatagagtaagaaaaaaagaaaaataacccacacccatgcaccgacagctccaacccaacaaacctaggagaaaaggctagcaccgaactggttgtcgctatgcatgaccagtcgctgctaggccaacaaaggaactatatccgagaatgtccaaaatctaaccctaacaactgacaccaagcccactctagccacctcttgagattgagggagagagggggtgagagagaatgttggaatgctttcccccctagcccttcgtcatgtccaccttgcataagctagagcgccgacacaaggggacatgcatctagagcaagcttacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtgaatacaataatcttttgctgcagttgtatcagctgctgttcgatttaaaagagctaatggagctttgtggccaagctgataagatccagagtgaggtgttccttaaaaaggcaatgaaaaaagcttgcagagattctgatgatgctgttgcagacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttctgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccagctgtggcaatatgctcgttgtatatgaattagcacagagagtggtgaatatgaaacttcctgttcttgttgatatttcactttatgttttaaattctcggcatcactgcttgtgaaattgttgaaattgtcctggttattcttggattataaatatctgatgacttttttgtttctgtttctatttttctataattttgaaatgtaataagccttcggatatttttttaagggccctcttaatttgtaaagtcttctgtattttgtgatcataacaaatttcttgttcgcggatcggacaagttgtccaatctttttcaactcgatgcattgatgtcagtatgtttggttgtggacagacaccgtttcggattggatatcatccgacaaccttggtcttcagtgcccgtgtctcgtttgctttatttgtttcggacgtccctgtcgcttcgactccgattctgttaacttcaagcgtgaaggccctatataatgaatgcacttgttcgcttctctctctccctctctgtcaaaccaagatcgacgctctggttgctttgttaagtctgcacagggaagagaaaattgtacgagttaactgatttgggcaatggaaacctcaggctctgacgagatgcagcagggcgtaaaggttgatacgactcgggtcatagagaacactgctagcaccgtcgacagcgagacgcccgtagagcaaaagaggagaaagaaggtggaaacggagtatgtcctcggtgggaaggatctagagtttatcttgtcatacgaggacgatgaacttgagacatttgatgaggatatgctcaaggaccaggcaatggtccggcaacagattgagaattttggctatggtttcctccatagctggagggaagttatctgcactgatagtgaagaagaagatgaccccgtgtccgatgatgatgatgatgatgaacaagatgacttcttcaccaatgatgatgatgatgaccagcaaaatgtcgaccaaatggataagaacatgtatgctgaggcctgaggggctaaaaagctaaaaacgatcacaatttgtacttttcttacaatatatattgcatgtcttaacttagttattcaattgattcatacctaaaaaaaataaattgatttattgtcgtatatataactagatctgatttatttctagatatattttgttcttcatattattaaaacttggtgattctttactttttctcctaatttataacaatattggatatttatctgttggataaattctcctgccatcttcccctgaaaaaaaatatatgttggataaattagtttatagcatctactaatcctaatttgctatagatagcatcgaaaggtttggctcactttaatagtaccaaaagttggaggcgcctataaatcgggcgcccgatttttttatcaaaagtttcgaaaccctagctccccgatagcgacggcggcgccgggcatgcctcctcgtcggttgcggctccacccacttcaggaggagaggagagagaagagagggggtgaaaataatattaggagagtagaggaggtgaaaaaaaattgaagtgctaagagggaaaagagagaggaaggaagaaaaaaatgtggataattggggtattttcgtaagtgaaaatatgctcatttttacatgtggcctcttaagaggtccgtttgcgaaaataaattttaaatacgggtctcttaaggagtcgtttatgaaaatagagatcattatttagacccgatcaattacggttcgcttgcaacttattagggtttatgtacggaaaaatcgtttctacaatagtgaatttttaattttaaaaataaagcatacttattttaaatctaaacggtaacagtacggtttgaaaattccagctcacgtcgactgtatatctgcgtttactcggtctcacatccgacggaattgattccgatcacaaatcaattgtttaatcctgttctattgagctaatcagattctggtttggttaggtatcctgattctgttaagttaagccaacctgattctgttttgtttagatctaaagatggtctaatatatactacctgcataatcagttcctgctaatctcaaaagcaagaaccgtgactactccagactccagcctagcgagaagagagaaagagagagacagactcagaacagtgacaatttcagatttgcaagaagagacagcaggagtaagccaaccgattaatcgatggaaacattcagctgctccgaaaaattgcagcttgatgcagacgttgatactttggttgtcgaaatcacagccaccgtcgtacacaacgggctagccacgaaggtgatcgagaaagaagaggagaacttgaaaaagaaaagaaaatgtgtgaagaagatgcatggtggagtttgtcattgatggtgatgacttggagtttaccttatcatatgaggaagatgaacttagcttccttttcgagaaaagcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaattgcctatttagaaaaacaccattactatccatcgaatcagtcggatgccactctgctcttctacaattggaaccgtaccactccgtcatgggttgacagaaaccgtgacggaatgacttggttccaattttagaatagtagagtagcatctaaccgattagtaatagtaatgatttgattttgcttttctccaatcctacaaaactgggaagcattgttctgcttagataatctacactgatgtgacaatttaacgccgtttgtgtaagttattaaaactggtcttttttttttcagttgggaaaagatggaaaggactgtagtcctgtgaaattcaaaaacaggatgactttgttaccgagttaaacaatcatttgataactgtttaccagacagcactcaagattagagaaatgattgaattgtgtgagttttacgcaaatatgtcaaactccaagaggaatgccattcctgcaaagatgctgaagaatgctcactgtcaggaagattttggtgtccttgatttaattgaccaggcgcagaaaaatgacaagtttttttttgctaacattgctgtgaaattgaagtgtttgctgggacgtctttgtactgcaggttacaaactccggctgataataatcaaaaacaatggcaggcctatcaatgatccaatgtcattagattctgctagctaggtagctccttatgattggaagtagtcctgggaatgctcttcagctttgatttggaatagaaaacaatgatagatgctcagtctccttccttaaagacctgtgagatcttcatattttctatttccctcttgtgtgtacaatcttctctttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttataatataaaaaaatggattagtatattttcagttagttcttcaattgatttgctatatggtggtgtcgagtgtgatagtgaaatcatgggtgcaagattacttcattcatttatcagcgttcaaatcccgatattcatccccaggtaaaccccatatataagattactgtaggcattcttgattggtccataggttaaagttatgtactccctctgtttcaaaatatttgacaccgttgactttttagcacgtgtttgactgttcgtcttattaaaaaaaatcatgaaatatgtaaaactatatgtgtacatgaaagtatatttaacaatgaatcaaatgatatgaaaagaataaataattacttaatttttttaaataagacgaatggtcaaacacgtactaaaaagtcaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgctcccgccttcgacgtcacatatcacgatgcgcttgcgagactgaacaaattaagctggagtactatattatcatgttgtttgctgcacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccagaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataaactgaatgatcatgttcagtgttggtccatatccatcttagttgtagtgtagggggaattatagtttctccttcatttatcagtataataataacagctgtgctactctgtggtttgactatagttctcttttagattcctgctatggtttgattctagtcgtgctatgtttttatcttggtcagcattgatctatcatcatggttcagggaacctgaaagtgacctagactgaagtcacagatcagtagttttgttgactgctctccctgagataatttcagtagtagttctgttgactgcttttttttggacacctgaaaaatgttaggttataatttggaaccccttgcaaaaagctcgcctgaaatatgttaggcctaatttaaagaagctaagctgatctctgttgacatgttttctcctacattattcagagttgcatgataaggattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagtactttaaacatgaggtagacgtaggagataataacatcaaaaccaatagcacttattatattatttagttgtatctggtagaagaataacaaactattgctagagttgacaacttttttcttccttaggaacggatttaaccgatttgcatcctattaaatctttaggcttatagaaatgatatagccaagctatatcatgacaaacggtgataatctacggcttgaggcgcctgataaaacgtgtattttatattgaaaaggatgttttcgttcagatattgtgttagtattttaacagtgttgctgctaatgctgatctgttatgctaaacaagaaatattaaaccaaaaactgataattgagattgagttccataatccaacacaggaagatactacgacaactagtaggtaaatcttaaaaaaaaaaaaaaagaacgactcgactgctaatcagcgaagtgtatcagcacatcgcttagtagctaattcagcttgttaacttttcctccattgatggaaacacccggtcgaaaccttctttgaccaggatgaggagcagggaaatcttcagcgcctgcaggagaggattcttggtcgccagcaggtaaggtttcttctccatcagcttcaccagaaggtaaggttttttctccatctttacctgcagatcgattcttcatcttcacctgcagcttcgtagcctttctgataagcgtctttctccacatagcctttctcatagtactgtttcagaacattgtctctcgctctcatatgccttgattcaatccggtttatatcacggatgatcttagcaaagtattcatccatatgatccccaaccttaaccatcctcctcacgaaactccacggtttggtaccggatgtggctatcaatctcggcttgagacatcaactccttcttcgtcgccgtcgtcttcttctttttcccttccgacgaactgcctgccatggtcgtcggctttttcccttccttctctgctgctgatgccgccgttgctttcttcttgccttgatcggaagagcttgacatgatcgctggctcgcaaatccagatgacaggaagcgcaccctgcgatcgattgtcgtgtgatttggttatgaaaaaacctgacctcgatacatctgctgcatatttattggttggtagctccagttcacaatcggagtcggaacctgcccctgccgatattcccaaccggaatcggcagagcttcagctgcccaaatctagtttagtttagggtctggattaggcatgactaatttttaggaccaagtttgggtatcggttggagacttgttttaaacttaaaattccaaaattagatttttaggaacatgtttggatatctcttggagatctctaggtgacatcatttattattgtaaattaattttctagaccctaaaagtactcaaaattgtgtctcatccagcctagattcgaagaataaatgtctcatctaatcctaagttggtatatactcctattttggaacggagggaatatatatttaatttttgggtgtaatttatgttatcctcctggtcctagttttgaaataatgttttgatcaccttaatctttcaatgttctatactgtattattgctcaattgattggagcatttgtaatagtacaatctcaggcagcacggaaacatcctaatatgcgtgcctttgaacaaggtctaagcacgtcatgagcaagaaaaaaaattgtgagctagcaccttatattactcagaagcatgccatagaatcaagctgcaaaaatattacacaactagaagatgagaagatgtcagtgagggctttttactgattatcatcgtccacagatgtgattgcaatctccatcttctctttcctcaagctgtctgcaagcttcaatggccgaagttcaatggtggctgctctcacgaaaccatcctctgcattgtccaagctgcgttcaatcaccatgcttgaggtactcatagctaaaacaagggacagacatttgcacaaactcatagctaaatagatttgaggccaccgagtgcttctgtgctaaagaaatacgagtaactttatatggtatgtttgctaatatcaagtgtttgttaataggaaaaagtaagctacattctgtctctagcacaactaggatccattttattggaaaacatcagaccaggctagataaagctacgaactgagcaacatagtactcatgcatgctaatgtgacagaagcagtatgcatggaatgaggtgatcatgactaatgacactgattgacaagtatgtacttaaattgaaaaggtagtaccttgcaatccaagcagaggtcgtttatcaggccttttacttgtgaaattaccccagcaatttgaagtctgacaactcccgaacagaaaaggcctcaaattttggaccaatcaagttcagagcacacataaggttgcaactcacaattgttaatccttgctctgcagaaagttaaccacaaaagatggtttgacacgatctgctcgatgaggtacaagaacattcatcacagccttcttgtttaattcaccaccaactgcaacatttgtaagcacaaacataccctgaagagaggaaacagaaaggccaatgactaactatgatttttgcattctttttttcagataataaatagtatcacagttaagaagcatgcatccgtatgaaaacaaaaaaaaaaatacactgttttattggaaatatttccctttttgccctccatagtttaaaaacacatatgaaaaaaaaaagtatagataaggtaagtcagtatactgtagtttaaggaatactgacctgtatgcacactcctaaggcatatgtgcattactcagctgtcttgaaatagcatttaaaatcatgccatcttcaccaataacataattaatggtgtccacatatccttcaacaaaattttgctgctgctgctgcacctcttcaccctactatttcaccattcgctcaaacgctcatgtgaatctatctgaaagtgccaagacaacatccttgacctcatgtattttgcgacaagggcagtgacggtaacaagctcaccgccactgctgagctgcttgacatgagaatctgtgctgcattgttccccacagcagcacagcatctgtgcccacacctggcagatcatctctagcgtgccagtgccatcagcaggcgagtcttgccggtcgatgaggaatgcaccaagcgagcatcctcccctcaacatcttgtccccaagtctattagtatttgtacaagttaatttaaacttcggtttagagctattcgtcctcaatgcatctgcgttaagttgtagcaagtggagcacatcctcagctgtgctgtacctcaggtgacgagtgatagcatagcacagcacaagataatcattgcggctggcatcgggaggcagcatgtggggacgtgatgcaagcaggaaaagcatgtgattggacagcgcctgagccgtttccataaggtcagcagctgaacctgaaccatcgactacctctggttgctcctctccagcagctgaacttgagccattggcaacctctccttgctccccttcagcagctgaaactgaaccaccgacggcctttgcttgatcctcttcagcagttgaacttgaaccactggcagcctctgcttgcccttcttcagcagctgaacctgaaccaccggtggccgctgcttgctcctcttcagcagctgaacctgaaccactggtggcctctgcttgcttcttctcctgatccttgtaccagcacaggtagatctcagtggcgatgtgccagatgaggatcctctgctccatcttggactcagcaacccaggctgggtccctgtacaatcctctgctttcaaattcctcctgaccccattgcttcgccttcatggtctccagcagcagctgcttggtacacgccgagatggggatgggcaggcccgagtaagccaacctgttccaccagtcctcgactcccatccacctcgcaatcttgctgcatcggctggccctgctgtgcacgcacaactgaatcaggttgagctgccccatggagcgtgaccagctgcgcctcctcctccaatatgccgcacggaccagccggcggagacaggcgggtatgtgagcaagaaaattacacacattacttccttccgatcccttctttaccaggagtgcacatgtccagctcgagaacatggccctcaaaagtgacatagtctccaggatgacggctccaacaaagaggacatatgtaacaatgacatctgctctgctgtaaccattcagcttatgctgatgatgatttccccagactagtagtatattaaacagaaagaatgcaacggtggtggccagagacgaaagcactcggatgcaaaggccataccaagtgtgtgtaatctcagacttggtgtagaagacgtcgtggaggagggagagttgcatctcagccaccttgtacaactcgtcctccccttgcaatcgtgatccttcattcatggggccacacaaaaacagacgaggtaatggccccttaaacctatccttggcaaaatccaacaataggtgagcatttaatagcaaggtttctgctggatccaagcgacgtatgaatgactcaggcaccatttgagaaaatcttcttctcgctatatcactctcgtactttccagttgggctactaccggcacatctgagcgcccagacacgctccccatacttggcaacacctaccattaacatgaggatggtggctgacaggagaagcaaggtccggctgtcgccaacaatgactatggaggacccatagatgacataggcagctgcggccacctgcacaacaagcgtctgcaggtggcgcagccacagccggttgtcctcgatggcgtaggcagtgattttgtcctgcccaccaaggtgcagcagcaggaacggtgcccagagtgccaacagctcatgctctggtgacctgctggtaacagagaggtggccaagcacgtagatcgctgtcccgtcggccagcatgtatgcggaccatataaaggcccttagcacgccagagtcaatgtaccggcggaattctgccaagatgaggagtgtgacttggaccatgaggctgagaagcaccagtgcttggagagcccattctttccatgcagcgctcacagcctctgctcctgccatcgatttctccaccttaacatctgaaatgtatacaccaatcgattgacataagtcaaaactacataatatttctttttagtttatcaacactatcaaacctaattctgatggcaatctcaagttctaaactcagcatccaagcccaagcagaataatgacagctgagggggtgtgcttccattctgttggactttcccttgttccgtatcacatgttccgggttgttgtttctttaattgtggttgtgtacatctttattatgcagagaggttgtgagtaaacttttgtgtggttgtacttgtattagctagctgtaataatgagagtaataaagctcccttttccacaaaaaaaaaaaactactatcattataattgttgtaaaagcagactcataccctatttcagcctaagcattcacattgccatgagaacttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaagaatcatataagagaggccatcaacttacttctttggtcagatgaatcgggctatcgagctttgtttcgttggtagaatgaataccgatgggatgatctagtcttttttgtttggttggtagtatgaatatcggattgtaccaccccttcccacagttgttgagcttatgattaattatccatccatttgacagtgacacaagcaaattgcggtcatatcagaaacgaaattatgcaccgaggttggtgatcttatgacttattatccatccatttgacagtgacacaagcttcacattccagtcaatgaacatattagaaacatgttaaataagaaatcatccatttaacacaaggttcacagtcacagacaccctttttttttttttaccaaccatcgattcgtctacaagactacagcaacaaatgcaaccaatccttctcccatctatccattataccatccatccacgaaccaagtcagggccgcaaagggataatcgattaccttgggcggtcgtggggagaattttcagaatataacacccaatacgcactgcttataggatttgtcacctaattcatactactttcagaatacaccactagagtacgaattttcttcgttccgtaacactccgtccatccaaagacgcccgtcgtcagttcatccatctctcgccgtttgcccgcacgaatctggccgccggcgagctcgtcctcccccacgccggcgagctcgtcctccccacactagcgagctcctcctcccgcacgcatctggcgagctagctcgtgtcgtccccgagctcagccgccgccgcaccgggctgccgccaccgcgccccgagccggcgccggtccaacctccgccgccggagctcgaagccctctgccctccaccgctgctcccctctcctccggccctccaccgcgtgcgccgatggcggcgacggacgagcgacggcggggccgacgcgggtgacgacggacgagcaacggcggggctgacgcgggcagcgacggaccggcgacgccggagctgacacgggcacgagcggcggtggactgacaacggtggcgccgggaggacggaggactgacgctaggggacggagtgtcacggaacgaagaaaattcgcactctagtggtgtattctgaaagtagtgtgaattgggtgacaaatcctggaagcagtgtgtattgggtgttatattctgaaaattctcggtcgtgggagagcgaaggagggttcgccggcggccggagatgcgtcctccgatgccggcgcgcggaggtgcggcgtcgggcaggcggtgagtgaggacgatggccgggcgcgcctattggatctatcatctacgccgccgttttttccgaccttctccggcgagccgacgagataatgacagctctgctccattggtcaacgagtcaacggatttcggttgtgacttgtgagtactactatggtccatccataaaaaaaaatttggtatattttgactttccaatttaagctttgactaataattaaccgcaagtataatggcatactagtataaattaactataagcacacatagatgagataagaaaagaataaaaaagaaagtgggctgcagatttctatccagctacaatttcaaaatgttgtgtgtataagaggtgagaccatatattaataatatagtatatatttatatgcaactattgtatgaatgcgctattaaattagctatagatgattctcttagttaacgctatcgaaatttaaaataatgttaggatcgttcgttttatttaaaaaatttatgtaattaaaatatattttattggtagttgtttaatcataaaaatagtttaagcatgatttatatttcatatatttaaaaaataattgaataaaatgaataggcaaacgtgtatttaaaagtcaacagcgttaattattaaaataaaaaacggagggagtatttaggttttatcattattattggattcatgttagaaattacgttcttgtgactgattttgtaaatgtaggcaaaattaaaatacatcaaagcttttttacggtcaaatctttttacatcagaatacaaactatattaatgataagctttgttttctaaaagtcaaaatatgccctatatctttgaacagaaggagtacctccctttacaatatttgcacaagtactgcctatttatgaaatttgaccactcatcttctttataaaatattttataatcaactaaaagcgcagcattagagaagtgtgtttatatcgtaagtattataggttgcaataccctacccgcaccacaaccaacaccccaaagccatcgtccacgacatcgtcgtcctcgccgccgccaccatcatcgacatgcaccacctcgtcgtcctcctcttcctctctgcactcgtttttgtcgtcgatgtcgaccacctccccatcgtcttcgtcgtcatcatatacctcaacctcttctctgtcgtcgttgtgcacatggttaaggcggccaacatcatcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatatatatatatatatatatatatatatatatacatatatatatacatacatatatatatacatacatatatatatacatacatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacanaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtatattaggctaaggctgaaaaatataggtactactatcaactttcagaaactaaattttggttacttataaggccacacgacgagagcaagattgtgatcaggaatacccagaagcatgtcaagagtagtatctttattgagaagcaaaagcaagcggcaaaaccattacacactgcttgctgggcaccgtcccatggccgaacgtgaaaaacatagcccaagagagtagtacaatttacagcagcagtagcatatctccctcaattatacactcaccactcatcgtcacagcacaagcactaggtttttggtcatgctaaggaatgaaatttctccagagctagcacctaaaacctttttccgtttcggaggaaatcagctcaggttttctgacgtggcatggttacaacaaggtttcttgcttgtttctgcaagagaaaccagtcatggtcctcatggagttcaccaaatttacaatgacaggcttggaggcgacgagaagatgtcggtgaaggcttttttttactggatgatcattgttcacagttcatggcgcggattgctgatgcgaagagatcaatcttccatcttctctttgctcaagcagtgtttgattctgcaagcttcaatggcccgaggtgcaatggcggctgctcacatgaaaccatcgtcggcattgtccaagcagtgttcaagcaccatgcgtactgtaagctgcacaagggacaccttgggatgttagtttaagcccaaaccaaggtttgtaaggttcaagaacatatgccgacaaatgctaaccaactaccagacatgtttgtcatcttgcattatttttgttttttggttttaatcaacatctttatatataaacccatttgaggccatcgagtgcttgtgtgcttagaattttgcaggagtagattttaactatttgttttcctatagagtatttcaatatgtgtaaatttgctaatgtcaaatgcttgttcatagcaaaggtaaaatgacattttctttgcccaatcaagaatatacaatttagtgggcaacatcaggctaggctagataaagctacgacccgagcaacaaaagtactcatgcatgttaatgtgacaggagcagcaaggatgggtggaccataaatatctaacagcagcaatgaagtaatcatgacgctgatacccaatcgtgtgttttttcgagctcaataaataaaagaacaaagaggtaccttgcaatccaagcagggatc

SEQ ID NO: 73811 - DNA, 739 bp, Oryza sativa
catggcggagatgattgaagcactcggctttgaagtaatctagttcaagaaaagattatctttacgactgtgaaggtctcaggggctactgtgagattatgggtaccccatacccacacggcatggttatccgattagtcataggggatagcttatatctatggaatatgtaaccgatcatgacttgggtattacgtttccttttatattatggagcggcctaaagtcctgatttgataatattgtaaaatagatttaggaaaccgataccgtattggttaaggtttctatcttgtaatcccgcccccatcctatataaggtgggcaggaagccctctagggggcatgagacaactagatcgtcagatctatacatactcgacggattcaaatccccaaacaggagtagggtattacctctcattgagagggcctgaacctgtcttaatcctttgtctccgcatccatccacttttaggtctcgtgcgctacccctttttaagacttacggcttgcgtcttgttccctcacccgcatgagcctcaaatgctgacgggctaacctggatactcatcatatacaaaaagttaattatttcatggagtatgatagaagtaaattatatatcataaataagaaaggagcgcaccactcggttgcagtgattacagtagattctttgatccttgatatacccatcaactttcctctgtgatgaactactgcaggaacgcacacc

SEQ ID NO: 73812 - DNA, 1778 bp, Oryza sativa
atttattaaaaatacccacaagccaatttgacataaatcttggtgaattttagttgttggaggctcttttaggcttttaaaatttctagaaatgcattacagcacgatttaaatttagggcaatttttagggcgttacaatatccgtgtgcttgtagattttatctgtgatcgtaaaaaataccaacacccacctctcatccgccgcatataaccccaaataatgatatcccgtaatctagacaccacgcctaaactatcagatactactctaatatcatcgtcctgacatagagtaattgcatatgcaaacattatacccgcaccgaagcatctcccagataagctagcagtataatcagtataacatgaacataatgtaaagttggcattcatatactcggaaagtatttcaataccataaatgtataaagaagagtattctaaataaagtacatagcttacaaaagagaagagaagagttactatagccatacccgaactcttccgaaggcttccggactcctgatttctactctattcctattccactagcttaagaacattaaactaacttgagagaatataagagagctcttgcttgaggtgtgtgttgaagtgaagagagtgaagtccttatatagaggtagttatgacggttgtggaagcagaattatccgaagtgccctccaaccgtcattgggatgcaatcctggacgtccacgccgaaccctgcatccaacagcatcaggatgggttcggccaaaccatgggctgggccatcccggcccatcttcggctggtggcctcctctattgctcctttatgcagacttgtgaattttggcccaattcatcgtgtcaattctgagttcttagcccattcatgcataagtctgattctcgacatcgtccgaatgatttatcgtcttagttgatgccgattctcctccatttaatgatcattctctgcaaaaggttagtgaacctaatactggcggaatattattattctaacatgtatatgcattgatgcattgcaagcataattagttctcctctattttggtaatattgatggtcgaaactgatcgataacgaccgtcaaaaaacccccccaagcttgaacctttgctcatcccgagtgaaggacgaaaggaaacaaaaacttgattgttgatcaggagttgctactatgctgtatatcttaaaggtacaagtgcaaggtatatgtactctctctcagattaaaaaatctttggcacagtggcttatccttatctctgattcccacgagacaccggttctccttgccttgggcggttgaaagacaacatcaattatagcaccaatcacccaatctttattcgactcttatttcggaggttttcaaatgattttgcaaaagaaagccaagttcctcaaatgattcacttagtctctctaagtgtatcaatatgaatttcttaccatttttgcctttttgattcctactctaaggtttgatatgtttagctcggtagggatcaaacatggcatacttgcattcagatttattactaagttaaaaacgtagactaaaatagataactaaacatactcaatatcaagatcgtgcaaagtgtgtgatatattgtggaaatggtatataaagaaaaataaagaaaatgcttctcctttgtgcttactttcttctcccataaatcattcttttattaattaggagagggcatagctacacatttctcttttttttttctttttttttcatgctcatgct

SEQ ID NO: 73813 - DNA, 869 bp, Oryza sativa
  unsure (1)..(869): unsure at all n locations
tcgtctgtatgtagggagtattcagattattgggttgtttnctatcacctcctatcactccgacctttcttatattagtgagatttcgcggactcttatataaatccnntnttccnnnnnnnnnnaagagttagattttgcattgcagtaccacntctcactataccgcgaattcgagctcggtacccaaatagtacttgcggtaaataataccgcgctgcgtgcacataacacaaggttgttgttctgtctatattggctgattgcataaagaaacataaatctggctgaggtgaataattgatcattcggagccctctatatttattgatattgaagccacaaccatctaataactggctggtataggtgaagattatcgcctggaatgtatatttacatagggaatcacatatacccagataacaggttaggacctaatattggcataacatctaattgctttagtcttttatcctgaaaattgaacacttgttcttactgaaaacagaactttgatggatgtctttattgcagaacacttgctcgaccaagttcctccacgaagccagaagaagctctgcatggatgacaggctaagtgaccttcctgatacaattctacaccatattatgtctctcttatcagcacaggaggttgcacgtacgtgtatcctgtccaagagaaggaaagaaccttttgcctcagcaccatgccttgatatctgggtacataaacttggaatggacagggtgcggttcagggagtttgcagcacaattggctgctattccgggctcctaaatcacttaatacatttcgtcattactttttttaaaatcaaccatgcccactcttggatcaaccgtg

SEQ ID NO: 73814 - DNA, 725 bp, Oryza sativa
atcgaaccactttggtctattgtgacaacatcattgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataa

SEQ ID NO: 73815 - DNA, 20196 bp, Oryza sativa
cctcatcttccagaagtggctcgggagattcgtgagggggaactgctgtaactgtaacacccaagaaaaccacataagcctgggatgccactaaacaaccacacataagtgccaaaacaagaaaattttggcaacaactaccttagacaagaaaacatcgcggaagcatcaacatatagattaaggttatgatacaacaatggactgacatgtagggataggcttgaaaaggtagctcattaatggtcaacacttctagtgtttaattaacccattatgtctaaacacaagtaatcctatcagcatattacaataatcatgactaagtgagatcatgtcgtgcaacagtgtagctaatcccatcccttcacgcaaacatatcaacagcaagtacctgaaaagactataaggggatgagaataaatctcagcaagcaaacggctttaacaagctacttaaaccacaggtggattatatagttaattaaatactaagttatgattcacataaagacaagttgaatatccatagactaaaaatatcatgacgtcaccaatcaaatccatatactcacaaatcccagagaagaaaacacttctcaaagatatcttcgatcgatatttcacgtaacatcctgcaatatgtacatatgcaatgcaatgatatgtactcctgctttcacacccaacagggtgaataaatgcatatgcaatgcaatgatatgtactcctgccttcacacccaacaaggtgtgaagctgcatcgtattacggcaatatacgatgttgtaccggtacggtcgcaaccataggttcacgacataacttcaaatgcaatgcaagtgatgcaaatgcagtatgaaatccagagtataacatcggaaccaaattccttcgatggagatcagtataagggtattataaccaagagcataaagtataaccatatacagtgtaaaatcaataagtgtgattcagataggtaaatcctctgggcaacaaataataatatatcggttgatgatatataattttcaaagtgaaggtagaataaaataacaggttaaagctgtagcaaaccaccgctacgttcacttgccttcactgatgatgagatgaactctagttgcattccgaagtggcatcacctgaataaacaccggctcagactcaaataacatgcataatcattcaagaatcacacatacgcttcctacgctgggatcccaccccaaacaacattaaacaaatcaccgataatcttcctataaaagcagcatagattaacaattcgatacctccaattctacatcacataacacagcaaaatatatcatttctgacatctacagaacaagagttacaactttcatttagataacaaaattgaattcttccatttagctggcctaaaacatggcacaaaacagagaagtgcatctgcccagaaaactgtgcaacaaccattcaaaagagcactgacaacaaactacaagataaaatctaacaatttttatgtaggaggtagatcacaacatatgctacaacttttgtaaaaacaagtttctctgattccatctttaaaatcctctaaaatccctctgaacctcgactacagaaaaatgcatcgatatttagacagccaacttcagaaattgatacctcctaaaccacttgatataaactcatgccatttggtcagaagatagatctacacgtttctacaacttttgtatagagacttttcgcaggaaatcccattatgttggccgaaaaggcagccaaggtagaactgtgcagggtggcagatcagaaaaaaaacccggttgaggaataaatcggtggatccccaaacttactcgcttccaacacttgatctaaaccctaatagaaaaccaaaacagagggacgaaatcatgcattgatacctaagcctccatgggcagcgggtaatcaaaccccacatttccatcttcacctcgatttcctccgcttccttctttccctttcttctccttcccttcttcttcccagatctgcagcagggcaggcatgggggaggtcgaccagaaggggaggtgggcgccccaaggtaccaaatgacggctagggggaggtggggagggggacctcctagggttttggggtgtggaggggcagctgggccttgggctggctgaaagctagcccagctagcgaataactattgtttttcttctaatttcaaacaccaaaaccttacggacttccaatatatcctctacggtattctatttttttctagggcattacagtaacctcctccgctaactcaatctctgagagagagtcggtcaaggcgaaccttgcccgcgagaatggaactgagaattcattccctcccaaagttatcttgaggctatctaatcggagcgtgtttatgaggagttgctcaatggaaagcccgattagaatgacaatatctcggatttcaaagacgtggaaatccaagaccgcctccctgtcttcaaagtagacaggcacatcttgcacaatcccaaatccttcgatgatatttccgttcgggtgtttgaagaatttgtttgtcagggttactggcttatcgctcagataagcgaatgcaaatgactcaaagatgagattaacctcgatagttggactgtaaagaataccaatgtcgttcccctccagatgacaaggaatgattcagggagcggtatttatccgaattacttcgtatgaaagctctgcctcccttagccattcgtcgctcattatggatgttagctcccgaacagtttcccgtaggaacccaagttccataagatcaggaggcggcaaagggacgagtggtttctttttactaaaatagtttagggtgttgccatagtcttcgtcaaaaccgtcccttaacagaattgcggcatggtccgaagtctgaatttcttcattcgcaacggatggctgcaaaggaactttctcatcaatcgagccagtggaagtggaaggttcagattgtgactcgattgttgaaggttcctctatcttggacacggatacctccggagggggttcatcagactgtgccatgaaggaggtactttctagaatgcggtctagaattatttttccttccaacggcgttttgtgcatgaatgatcctccggcggttatgttcagatagaatgtagattccttatccaaacccatatggaaatgttgcaagagcatatattcgggtaaggacaaggttggtccggactgcagtaaattagtgaatctagaccaagctgcaccgattgattcgtttttgatctgctggaaactgatgatctctactcgaagggtagtaatacgagtatctgggaagaaggaaagacataatctgtctcgcaactttttcccaactaacatttacacatccaacggtagaggtgtaccattgcttcgctctctcttgaagagagaacggaaacaattttcaccatatggtttcttatctcatgccacgaatattaaggcatgagcagacatgctcaaagtctcgtagatgatggtagggattttctagatcaaagccagaaaaagtattttccctaaccatgttgattagtttggagcgaatttcatagccagttgtataagttgggtccaatgaaggaggtggctcatagaattcgcccctaggagcagacagctcgaaaagaggttgctccatagttgagaagagtttgacaggaatacttctctgggtagcaggggtaaaggtagaataaaaagtgaaaaagagatacgatgatgaactgggttcggaaatgattagcaaccgttccccggcaacggcgccaaaaatgcttgttggtaattcttatggtcacagatagaaatccgcaagcgcacggatataccgatgtagcacttcccctatggagtattctaagggtatcgaatccaagggaacttgtggtttcagatcttcattcggttcatccaaggacaccaacaaaggatatgccaggatagacatgattttctgttgataaacagtgtctagggaaagcttaagttcaatcctaacgcaatacttcaggcactagcaacccgctgttcccagatgtcgctctactacatacctggatagggaggacttaagtaatcttgagggctgtcaccacctctacacctacctcaaacgtactgtgggatacgcagcaattactggataacaatcacctaaaaaccacgtctaagcaattaatatctactttagtgtttataactcaccaaagcaatcactatattttagttaattatagtgagcaataatcccgtatgctatttaggaactaaccaggagacaattctcataagataaatctaaattactcaagaaaaatattgtattgaaatcagagtaataaacagaataaaagaaataagagaagattactgacaactccggaattcttccgatttcttctactctactctcttcgtattctagtatacaatatagtgcaatagaacctcttataattcagctcaagcttggaagtgtgtgtgaagtgaaggagtgaagctacttttatagggcagttatgacggttgtgagaaggggaaatgtctgaactgccccgcaaccgtcattaggagagcatctggagcatccacgccaaaccccaggatcaatggcgatcagaggggttcggccgaactagggggttcagccgaacttgggctgggccctcccggcctggccttcggcctgtggactcccctgactctcctctgtccatttctcggagttttgggctgagtctttgatatttttatgactagtgagcgtgcacgtgcaaggcatgtcagtatactgaatagagaaaataaaagaaaaatacatccatcactgatgcacatcgacatatatcgatacattaaaacttacattcaccgaatgaaatagcataaagcatgtacgtcagaaaccggaataacctggtttagagtcatggatgctgatgttagcccaaatgaaatagcatcattgcgctctactgtattaagattttccattgaatcctggattttctaatttgttttgcttccctcaaacaaatgtttctgatatatcatagtttgaacgtgatacacagctatagataagatgcagtgccaaatttggacatcttcagctatatagttgggtgttctaagtagacaggtgtatcaatcaaagagctgcagtatgctccccatgtgatctcaaaagaaaaaataattggctacagtgtgaggtaccttgcaatgctacagaaataattaagaaacaaaatcaacctttagatgccacgaggagaaataatgtaatttcagtgttcaacaaaccaaatgctaagaatggcatcaaatcctggagacagagctgctcccccttggccacgcaagtatgtcgatgatatatgccactaactcctagggtccaaccattgctatagcattactgcattaggtttagaaaataaaattttcagaaaaagttcagtgcttgtatgaaaagtaggaagtggtatatttgaccaaaattcttcagaatttgaatgagatgcagagctcaacgatccattgatcgaaccacatgcagagttagtaactgaggcgaaacacaaaaacctcttcacatcaggtcagccttacgctaccatggtctgttgctttagagaacacatatagtaaatctacacgaatttcgtaagagagaacatataaagaaagcgctaaacgtttaaaagcatgacagttttcacagtgagaattagcatggctcttagactcttacaataagaaccattgtacctgagacttcggttgtaagaagattgtcacaagaggaaaacaatgcatcttagtaactatgtttctggcaaaaattcatcttgtgatagccaaagcagaaactgacagcaactcttagctctgagttgaatcaataaactactaataaaccattgctcagcagtttttttttcgccgggccggcgaatagccggccgatgtatattaagagaaagaaaaggaatgtacaaggttgcgcggtgcgtcagagcaccaccattaccgacacaaaagaaaagaaaaggctaaaatctcacagcaaaatttgctacagggtggcaaaaggggctaacaagacctgcagccatccaggtctcccattcatcccccatggccgagcagagctcgggaaccgttgccgcgattctatcgaacaccctcgcgtttcgctctttccaaatcaaccaagttacaagtataacccccgcatcgaatgttttgcagtcaaccttagcaacagatttctgtgctgtaagccaccaatcaatgaaatccgccaatggcgaagagcacgaaaggcccagacgcgtgtgcacccgaccccaaatctgctgggtgtaagcgcagtccatgaagatgtgctaacaggtttccccatcgttggagcacaaatggcacacccgggcaaggctcaatccgcggcgttgtagattgtcggcggtgaggcaagcgttgcgcattgcgagaaacataaagaacttgcatctcgccggtgcacgggatttccaaataatcttgccaagtgggcacttcatcctgcctgccgaaaacagggaataggttgagcgcacagagaacacaccatccggagctgccttccatatcatctcatcccgactagcagggtcaagagagattccagcgatcacatcccacagatctagatattcgcccaatgcttgaaccgagaggccgtctctgatatctgagacccaggaattattacggagagcagccgccacagtcattccactattcttaacgaaagataaagaggataggtcctctgttttccactgaaccaccatccggcaaccaattatctttccaaaatagagcatcttatccattccccaggaccaccttgcagccgataggaaaacaatgcagtctcttcttatccgccggcggcgcgaaacgcgcccacggtcgctccggctgcgttcggtggaactagatccacctagcacggagagcaatgcccatcagacgaagatttctgatcctcagtccaccatactcgaacggacgacggagtttatcccagactacaaggctacacgacccagccgcctcttcatcacctttccaaaggaatccccggcatttcttctctatttcgttgatcgccaagacagggacttccaaaactgacatgaagtaaagagagttccaaaactgacatgaagtaaagaggtagggccattaggacatgtttgatcagcgttaggcgggcatcaggggataaaagcttgggtttccagccagccaagctttttgcaagcctatccatcattggttgaatctgctcctttgttggttttctgacggagagtggcaacccaaggtaaacaattggcagcaacttgactgggcaggacaacacatctgttacttcatcaacttgcgcatcagagcagtgaattggtgttaacgaacttttaagcagattagagaccaaacccgatgcttcacccatcagcttgagcacaaaattgattgtcagcgcatcgtgtctggaggggtggaagaagatcaccgcgtcgttgtcacatcccaatttttattaattttaaaatttacctatttccaaaatttaaataaatatcgcctttcgcttttgttcctaaaacaagcttaattacttttattaaattaattaatgatgatgttaatttttattgtgtgtttattctaattggagttatttggatttaattagattttggtttgcgagctcaaattattctaactccctttatttcctaaaataaccactcaaaaaaaatatcatttgtgcagaaagccttccttttccttcctttttcgcttcctattgtttcttttcatttctccctctcttttttcacgtacggactgaaacaatattttctgtttcttcctctccaacacctggatccagctcctatcccaaatattgttgctttaatcccatgaaccagcagttataaaaaaagaagagatgaagagcaaatcaaccacccagactttacatcttcctatcaatgcaaacatttgacatttaatcctctgttgattgctctctccatccactatgagtttaatcacctatgggtcatcaatcaggatacgttagcaagccaagagccaaataattcccctgcattatcttcaattgaatcaccagataactcctccactcaacattgattccttctctcactgtataaacagacttccaccatttttctgcgttctcaaactctcaaaggctcatagagccaattcccacacttggtctgcaccgcttgctcacctagggccggcgtcgttgtggtaagacactctccttcctcctatctcagcgatggcgctgcatctccctcctcaacaacgttgacaatcggaggtcatgttcaccggcgacgatcaccggaggcattcgccagtgtcaccacattcttgtgtcggcaagtgctgttagcgaagctgctgtcttgctggtcaccatcattagttcatttgtgcctctgcacaagcacgtgatgtgtcctgtgaaatcacaggagctttttgttcttttctccttgccactaactggtagttctccttcaaaatgtcagaaaccacaaccaaatataaatccctgctttaattcctatactgatcgtccagtcccaaaataatcccagatcttttttttttgaccaagggcattaagcccccatttccattactagaaatgagaagactacaaaagttcaggttcagatacagagcaatcccagacaagctatcaagatagctggttttgtagatgacaccaaacataacagaatagcagcacatagctctaaaatttaaagccctgaaacataaccaactggtgattcagaaatacagcaatcaccacccaaaaccctaaattttgtagttgcagctgacatccagaccaatagagagagaacaatcttcagcatccaatccttcttgtagcggccctccatccatccttggagttgaaaatttcacttgccacctgtcttatgagtttggctcctaagagcaactttctttgatcttcctccagtctctgcaatggaatccaagattccaaccaatgacaaaccgaaaaaatcacatcagttgggtcattagggagtttattctcaaaacaggctttgtttctagatttccaaatggcccaaagcacagcagccacaccagtgacaacaagttttttaagtttctttccaaaagcagaaatccaggagctaaacagttgattgctatcaaaaacaggtttcaaatccaaagcacaggagataatgttctagatcagccttgccatagcacaatcaaaaaagagaagctgaatggattcttgttgatcacagaattgacacttagtgtcacctttcctccaccccctcttaaacaagttgtctttagtcaagattttaccctttagcatgagccagataaagattttgatcttcaggggtattttaaacttccaaattttcttgaaaggagtaggtgtctgttgaatacagagagcattgtaaaaagatttgacagaaaatgtcccttgcttattcagattccagctgagcctatccttacagcctagctgaaagtgtagatttgcaaagttttgtttaataagattccaatctgtcagtttttcatcaaccaaggtccttctaaatttgatcacactccaacctttttcttttatcttagctaaggaaataagttttgtcaaagtgatattataaagagcagggaactgagggacaagtgggcggccacccatccagctatcctcccaaaacattatagatctcccatctcccactttttttgaacatagactataaaattgttcttttacttccagcagcccctgccaaaagtaagagtctccaggttttgctttcagtacagacaagggtttcttcgtcaagtatttattcctaagaaaatcttgccaccatccctcttcattttcaagttgccaaatccatttccctagtagagccttgttcataagatcaagatctaacactcccaaccccccctgttccttaggagtgcagataactggccattgaacaaggtggtgcttcctaatgccctgatcctcttgccagaggagccttcttctaaagaaatccattctctccctcacccctttaggaattctataaaaggacggcatgtagagagggacattacttaaactggaattgatcaaaatcaaccttccaccaattgattgaaatctcccttgccaacaccccagcttgtgctccattttattttcagctgttttccaatcctttttcagaattctttttttatcaatagggaccccagatatctcataggcaaatcacctatgttacaagtaaagagttggctatataaattttgtctatcctctatcagccctatgcagaaaatttcacttttattgaagttaattttgaggcctgataattgttcaaacaaacacagaatatatttcaagtttctggcataatctagattgtcaggaatcagaagaatagtgtcatcagcatattgcaacacagcaactttgttttcatcattgacacctaatccttctagcagggaattgttttatgctctatgaatcaacaaagtaagggcttcagcagctaaattaaaaagcaaagttgacaggggatcaccctgtttgagacctttgtgggtttggaaataaggaccaacttcatcatttactttgacagctaccttccctcctctgatgactttcatcatccaatcacaccattgagttgagaaattctttgcaattagcattctataaataaaaaacccaatctattttaacataagctttttcgaaatcaatcttaaaaagaatgccactttgtttcttttggtgaatagaattcagaatttcatgaaggattaccaccccctccaggataaacctatttttgagaaaagctgtttggtttctggagataatgtaagacatcacacaatcaatcctgttcatcaacacttttgttagtattttgaaactcacattcaggagacaaataggtctaaacttttgaatttgagcagcatccttagttttaggaaccagagtgataatgccaaagttaagtctctctacatccacatccagagttcctttatgaaattcattcaaaagctttaagagatcaaactttatcaggtcccagaatttggcataaaactccccagggaacccatctggaaaataatcccagatctaatccacccattttattttctataaatctatttaatttgagctctctatttttctgttctgtttattacttgtttgcccatcgtttatttgcttctgttttttttatcgtgcacgagtagacgtcgctgccgaggaaggagcaggtgcagaagaagtttgggttggagattctactggtgaaggcaagtgtactcctttgatcaagttgatcccagtgtgtaaatattattgtcttcaaattatatgcatgttttatttaaaaattagcgctttgggtaattactgtcctaattgctataaataaattcctgccatgttatacattgctacctgtaaattctttgtcgccacgtattttgggaagtgagctactggaatgaaaagctctgataggtagttgagcttagccatgcgcataatggtttttaagcaaaaataatattaaacttgactaatcatatactcaacattgtttttataacgaccatgtggctgtgtgccgtcttttggtggcatgtgatgcatcgtatgataaacatatggtggaaaaattgttttagactggggtgatggtggatctgtctgaacctaggggggaagccttctgtgtgcgtgcttcccatcgacctgtgtggtccttgagctgtgtgctccttttgctgtgtgcttgaggtctttagtttaggcaagtcgccccggtcaattgaggactttacttcgtgcgccattgatctaagccctatcgtgcaaccacacgttctcgtgggaaggatctagcttagtacgcttcctagtccggacactggcgtcccaggtggttagatgctaggattttggatcgtatcgtgggacctttcacctgtgtggcaaagggaggactgcccatgagggaggccggtgttagggcgaggtaggggaaacgctttgttactctttagagtttggccgcaccgaagggtatcgtgtgagtaaagttgtacaacctctgcagagtgtaaatctattcgaatagccgtgtcctcggttatggacatgctcggtgatttcacatgaggggtagattttcgaaaattttactttggagcgagctgtgtgcaagataaattaatatgtttagttttgtgggattatatttgcatttcagcatttacattctgtacttattttcttttccggtatttaaattctgtttttactgccccctgtatacttttgtactaataaaatgccatttaagcaaaataacccctaacctttctttgttagccttgtaacatataatgcatgtttccgtacacttgttgagtacttgttgagtgctttatgtgctcacccctggtgctatctcaccagttgcagaggaggcttatcctttgtttccagaggaggttgtggcagtggatgatgactaggctcgcgtctcggtcgattgcctgtggcagtttgatgaatttcacttcgctgtttatcttttccgctgtgtttcccttcgcttttggggccctgcgcggccgaataaatatgtaaaccatgttacttatgcactggttatatattatatgcgtgatgcggttgtgatgttatttctgtatcctgtatatgctagcatgatcctggtctagcattttatacagagagatcctattcggggtctcgacagtcattggtgtagagcgaggcacgcagcggtagatgtacattggcaagaggagaaagctctcctcgctgcacagccgttgcgcatagggccgccagagcttccgtgacgatgacgaacaacagtggagagaggggatccctttgacgcaacccacgagcaagcctgatccgttgcgtatctctaccgttgatgatgacagaagtagaggcggtgaagagcaaggccgcgatgcaatccctccatcggaccccaaaacccaggtgccggagcagatccagaaggaattcccaggaaacagtatcaaacgcctttgcaatatcaatcttcaagagcatggctggcgttttagaacgatggaggtttttgaccaccccctgcacatacagaaaattctcctatatccttcggcgcctgatgaaagcagactgtgccggcccaattagctcatccatcctcgacgcaagtcgcaaagccaaaatcttgttgagaatcttggcgaagctgtgaatcaaactaatcggccgaaaatctgacagttgattcggttcctccttctttggcagcaggacaattgaggctgtgttaacaaggtgaagatgctgggcattggatctccatgctaagttaagagctgccaccagatcattcttgataatttcccaacatttcttgtagaaggtggcactaaagccatccggcccggtgccttgtcgctcgacatttccaagatcgccttcttcgcctcgtcttcagtaatgtcgcgctccaaatcagagaaatcatgcaccgccaagccgatcgcatcgaaggcaagggatgccgacggggggcaaggcatgccaagaattttgagaaaataatcatacgcagcctgaagcttgtcctcttcagttgttgcaatgatgctgtcctaacaaatagaggaaattgtcttcttccttcgacgagcattgattttgaggcagaagaattgagccgtggtgcctctatgtttcaggaaaagcaagcgggcatgctgtttgagccgaatgcgctccagggaggcgagcgcgaggcagcgacctttcagagatgcccgcaatgatctttcaccagccgacagaagacgatcatcctgggtctttgtccaattggaaaactacttcatgggcgatcgcgagttgctgacggagctcactgatacgcctggctccccaggaccgtaaggcagcagcagttgcacgcagcttgaaatgaaggctgctgagtgcattggagccagccggcgctgcctcccacgcctgacagaccacatcctcgaaatcctccaatttggcccaataggattcgaacttgaacttcctcggcctatgcatcatctgatcgcaggccagcaacaggggacagtgatcagaggcagaggagctgagcgcttgcaggtgagcatcacggaaaatttcctcccaatccccatttactagcaccttgtcgatttttgttagagtcggtcgttcttgctcattgctccatgtatagcgacgcccaaacagatacacctcgcgcagctcaagggcatcaatggtgtgcctaaacttgctgatcaaccgtcgatttacattcccattgtttttatcaccgtccgtggccaagaggttgaaatctccgaccacgcaccaggccccgaccactagctgcctaaccagcagcaattcctccaggaacaacaatttgtcgctgtccaattgggggccataaacattggtgagagtccaacttgccccaccttccaggttggagaaacaaagagaaagcgaccaccgtcccttgtgaagacaggaaacagagaagcgatcatgccgccaagccgtaaacagcccccccttgttccatcagcaggaatgaaatcaacaccatccagggcatgtccacacgactgaatcgacagggaccgatctagaacatctaatttagactcctaacaacaaaaaatagaagcactagaggttctaacaacttccgctacaagggacctcttgccagggtggtttagaccccttacattccagaccaaaagagtacaagacatgagaaacgaccagcttcaacattgcagcacatgcggcagttttaggctgccgctgacaccgccacactgcagagcgccgccagcgcctgtacatgagatggcgctaggggagccttgaacagctcgaggtaccggaggatatcccgctcgtccgccttgttctcatcctcgatgatgccgagtctcttcatcaccacccgctgtgctctggtgatcatgtggatatgtttcccactattctgggcggcaaggcgctcgctcctccttggagtgtacgaggacgggcggtgtcggtgccgaggctggtggggacgcttcccgaaaagtgacaaaggcggtggtcccaccagatcagccaaggcagggagcgatcgtgggtcagcccactcctctagccccggcctataaagaggaaaggcccgcgggccagtgagctccctgcggcggcggtagacagccaatgggccagggacgagcaaagccagcccaaaagagggagcgaggcgtggtcccggcaagttgaaaaaatctccatcccgctcagcgggcaccaggaccgacgaagcatcaacgtcagggcgcaccggtgatgacgaagtaggtgtcaacattaatggctcctcaggaaaaagctctctttggagacccatctccctggtagacggggccacaaccatgcatgccggggctgacgaggggtgagtaatgacgcgtggagacggtgggcccagagccgccaagcctagggaagaaagctgaggcagagccggtgacaacgggcagcgcaccggcgaaggcgttgaaggcgaggcatcccaggaggtgggggctgccagcactggagaagcaccccccggactcgacatccgcggcaggaaaggcgcagctgggggcggtggcgtcgtagccggaggcgatgccgtcgcagctaggagcggagtcgtcgacttagctggggatgaagcctcaagcgctagcacagagactccctccagaatgcaccgaggcatgctagctggcatcaccgccgcccgagcggggagctgcagatgggacgcaggcaaaacgggtacgcgctacaactgccgttgaaaaccccccgccgaaccagaacccatgtctgccaccaagcgccggccccagccccgttgcatcgatgcgaccgaggaaggtgttatgggtgcggcggtgaggaggtacgaagtcatcgtctgaagaagagccttcccgaggctcctggagcgggtcgaccacctccatgatgtgaaggagtaggtcgaacttgagacaatgcttctcagacggtggagccggcggcccttcggctaagagcacctcgaaatatccggatcgtcggtctctggctcgttccaccattcttgcgtcggctcaggaatgtcgagggcaaattccttgggaatggcggaagggttcaccgcccaaggcagcacttccgtcatgcaggcatcattcggcgggaatgattcgatgaactggcagtccaccttgttcaatagctgcttgagctcttctggctcggccgcatggggagggaggccctcaattgccagccgaacgatgtgtctcattttggtgcttcgggcatgaatggcacggtgccagcgacgaaaggtgatcctcgcgccagcaactgccaaacggcctgagagatcaagaaccgccatgcagtcttcctcgcgcgtgaaggatatgagaaaatcggagggtctagtcacttcgacgcgcacattgtcatagagcacaccacaggaacgacggagctcttccaccaccatggccggcgagacctcctgccgcccagaaagaacgacaacgagagcacggcccctcagattctgctccctcagattctgctcgatggccgacatccgctgggtctaggagaggaccccccctccccacgcccgggcggagaagagggtcgccagcgcctagctcatccatgacttttgccgacgaagcagaatcgggcgccgacactgtgacggggagcgcctgacgagggggaggggcaccgggacaggaaccgccgagagcgtaggcgcctggacgacggacgcagttgacggagcggtcacgtggataggagcagcagctgatgcttctttcacggtcggggtacgtgccgcatgggcggtgtgcgcaggagcggttgggcgccgcggacgagcgacggctggcggcgcctggataggtggctcgtcttcgtcttcttggtggaaggtatagtggcgctcaaggtggctcggataccagcagtggtagcaccttggcgtagccgtgcagccgtctttaaggtggcccagacctaggcagcggaagcacctcccatggagccaccgagggatggggcgagcagggcgagtaaagatggtggttggacggccggcggatggccctcctttactcctcctctggaccacacaccaacctgcatcaaatgtcttgctgcgatagggtagggggagcacgggagtcaacccgtggggcccggacgacgtcagcccaggaagcggcggaggacgagggcgtagaggcgacggctttgtctggacggtgaccgtcggagcggccagtcgccggaaggggtgggtgggaggacgacaacacggctctcactctctctctctcatggcgctggtcttcctcagcaggttaccaaatatatatatgatcaattaccaaatatatatatgatcaaatatagtgtatcaatagttagctgaacaagggcgtgtacctgtgcttcttctgaaactgaacgaatggatggctgcttccactgcttggagtggcggcggcgggctcgcacgaggcgagcggctccctcgtcgacgacgatggctccggcgggatgtccactacttggagtggcggcggcgggctcgcacctggcgagcggctccggcggaggcggtggtggcgggaagcagcgggcgcgtaggaggcggcggcggcgatactgcccgctccctcggcgacgacgacggctccggcgggaggcggtggccataggcaatccgaggcagcggcggggtaggggaatcgggagcgcagcccagcgagcggagtgaaggcggcgggctcgcacgagaggcggtggtaggggacgacgccggcgacgaatatggctccgacgggaggtccactgcttggagtggcggcggcgggctcgcacgaggcaagcggctctggcagaggcggggagcgacgggcgcgtaggaggcggcggcggcgatgtggcccgctccccggtgaggcggtgagtggagtggcggcggcggcgcccaggggggcgacgcgtgagggatttttttttctttttcttttgtcttgaccgatcgctaatttctgtaaccgctgctttcctcctcgaggtgggatcactaattgcaggggtgatccaacttttgatataagccgttggatgaatagatataagccgttggtcaggaaaaataggtgtttgatgaaatcgtgctttttatagtagtatagatgtttacgacccatccttgtatggatacttgtttctcctgactttattctagatttcctcccaacttcggggtttaacacctatacaccaacacttgtggaataagtgagattaaacacctatcactatgttggatgttttattatctgaacttttatgcagatgttggcggtatagaatcggcatttaataaccgccaacacctaccacctgggtaaaaccttaagcaacaagtctagctttatttctcacaatcaaaccatcctcattttgtttattttagaaaacccacttggttccaatagtattatgtccaaaaggtggttcaactaaagtccaaactttgtttctctcaaaattttcaagttcttcatgcatggcgttaaaccacgattcatcagttaatgcatgagtaacatctttgggttcaaaagaagcaacaaatgtagaatttgcacaaacatcatgagtcgttaccttagaccttgtagtctgctcacgtatattaccaataatttgttctggcagatgtcgtcgttgaatatgcaaaggagcaacgacttctgaagttgtttcacgttctgtaccctcactggtcgaagttgtagcctttggaggaccatctcgatcagcatcaacagaatcggaacccgacgaccatggccggtctgactgcacctcctgtgccagtctgaccggaggcgttccggcgatctgaccggcctggcgcccggtctgatcggccgagccgacctcatcatcgtcgttgtcgctgttgtcttcaaaaaatacgaccatcctccccctgaacctgtgacaaagtacctgcaatttcggatctagtacctggactagcctcatcaaaagaaacttcgcaagtctcaacaattttgttagtttccaaaacaagtacatgatagccacgtgaatgtgcggggtaaccaaaaaacattccatcggtaaagcgtgcctcaaacttatccaaatttccagatttcaagacaaagcatttgcaaccaaaaacacgcaaacgtgaaactttgggttgatgtccaaatcgaagctcataagaagtttttccaagttttgaccttaagaaaacataccactttcctccaacagattgcactctagctggaccaacagtgtccatgtgtaatagctatcccggtgcatccgtcatcacagaaacaataggggcatgtgaagaagaaaccatcttagcatgacgacacggtgtacaaaccaaatcaagatctttcttaagtttaggcaaaccacgaacaagatccaaaccacttaatctagtgagatgatcaaaaccaacatgtccaagtctacggtgccaaaacatcacatccttattaaacttagcaaccaaatatgttatcacatgtgaaaccggattttcaaaatcagctttaaacactcttccatagcgagaaatattcaacatagaatcaccacaagaatcaaatactttacttccagttttcttaaagtgaacctcaaaattttcatcaacaatttgtgaaactgaaagcaaacttatactgg

SEQ ID NO: 73816 - DNA, 8038 bp, Oryza sativa
tgtaccccttcaggttgataatccttatcgttttggacgagggcacattcttaaaaaaaaacgacagtgaccattatttttcattataatatgtataaaatgttaacaaatatatgatttttattaaattattttttaagactaatatatacatgtagtcaccatatttgaaagataaatattttaaaaatgattcataatcaaagattctaaagtttgacatcactcttgtctaaaacgataaatattatcagtccggggaagtatttaaagagtgacaacaataatattattttctagatctgctactgaaagtctcccgatcgaaggagtctggagtgtgatcggtccataaaggttggtctcatatatacattgcacaggaacttaagatcgtcctcaagatagaagctgctcataggcttatggtccggtcaaagaaaataacacaataaccaaatgaatctatacgtctgattacgatgctttgtacgtttatggataactcagttgcaagaacaggtcttagatgatctgtctagcactctcatgttttttttttctttttggaagtggcattgtgtgacttgtgtctcagtttactcgggttaatctaccactaacttgaaattgactagcaaaatactcactaggatattggataacaaatgtacctttgagcaattaacaactcataccacgtggaaagttcaagagttcttttgctctggatgcatcacttggaaagtgacatgatggtcatcagttgtcaaaattactattgcatttataatttcgtgattatgcaaatttttctatctcaatcaactgatcctgatcgggaaaatggggccagaaattagttcggtcacatcatattctaacgagaccaatgtattaattaaattcacgctggcacaaattgaacgacaattttttttctgcggtgcatgacaaagacgtaaaaattggccaactaaaggaaaaaaaaagtaaaaaaaggaacagcggaaatatatacgtggctaaaatacgcacctttggagaatttttcagggtttatgtcaactccgatgattcgagatgctcctctcaatctggcaccttcggcaacctaaaagaattttaaaataatcaaaatttattttcttttgtttgccttttcgcatcctaattattacaaacatatattttgttgccaaatgaaatgtacgttataaaaacgctagaaaacacatatttgtagaaaaaatattttattgcctgagtatttctcagtaactaatttacttaccgcaagaccaatggcaccaagcccaaatattgccactgtggaccccttggagacgtttgcagtgttccatgcagctcccactcctaattaacagcaaaatcataaacaatttttaattcattatctaaatgaacgattgctaattaaattcaaaacattaaactctcacattaaactttcaagaaatctacacttccatatatatgcagtatcaatcaaactttaaggctttcattttcacacatcgatatcacaatgatagaagcaaatgcccaccattatcatctaaattaataaacagggataagtacccaaaaaaatcaaatggagggccatgctgcagagaccaatctctgtagcattgtgggctggacatggagcttggttttgttcagtttcagagttggacagagtaaccaatctactggcatccgtatccaaggtgtcccatgctggactgttggatttcaaataaaatcaaaggaaacatcgatatctagtcggcacttgacaagtccatgagtgtccagatgcatgctagccagtttgtccatgtgtcatgttaatccagctagctgaatttccatgtattgacagacagcatctcaacaaattttctgttcaagatcatgggtgcccctgcctgtttctcctttatggtttatatatacttttatgttggcttgttaactactacctccgtcccaaaatatagcaatttttagctatgaatctagacacacatgtgtccgtagctaaaatggttacattttgggacgaagggagtagtgtatagtttataaaacagtggttgtaacttctaggttataagttcaaggagatatagtcgtaactcctgtctcaaaaaattaacttggctcatcagtgtaagagcaattcatgtcattttaaaaaaaaaatcctaatacaaaactaaaatgcctattattgagtatatactatctccatcctagaataattacatttttagagaaataaagacatattagcaaccaacacaatttaccactattaataatcacactatatgtacacattccatacatacacttgattaaaaagaaagttaaaaaccatttttaaatttgattaaaaggaaggttgatcagtcccaccacagcataaatacatttttttaacaaaatttgaatggtagaaatacaattattctggaacggagataggacaatattttcttcactatataggaccaagtcacggttgcttacctgtggagaccccacagctgaggagactcatcttctccaagggagccttagggttgatcttgacagcgcaagcggagtcaatcacagtgtactcagcaaaggtggaagtgttgagaaaatggtagaccgggttgcgtgcaccggaggagcggtcgatcatggtgaacctcgtgccaccatcggtgaccatggtgctcttgaatgggttgacacggtaggttttgcataggttgctcttgctggactcgcagtaggtgcacgcaccacactcgccggtgaagatggggacaacatgatctccaggggcaagatcctccacaccctctcccacgctctccaccaccctgtttttttagttgcatattgctatcaggtgttgtataaaaatggtaacgtctttaatgtgccaaaaatatactctttaggatgagtgcttttactatgacaagatgtattcagttttgtgaaaacatgcaaatattcattccattaaacatgagaaatggagagtaaagttgattctagcgcaaccatgtaaaaacattgttaaaattaatgatgagctcatttgcgctaaataaaaaaaaggataaaggttttacatttcccataaacatcacttgtatgtagactagatttatatgccaaagtgatccgaaattttttattaaaatgaaatggaacacaattgatgaaaatatgtgaggctggtacaaagaataatcaagcatatgaggtatcgtctaatcccatgtgagctaagctggattgttggacctatgcttttggggagccggcgttctatatatcgtcttcatctgccaactaacaataattaattgtatttgtatttattaacaactggttatctgtcacatgatcgatctaatcgccatacatcgatcctactttatgtcagacaaaaaagatatctctagcttgttggcatgcaccaattgtaattaagatcgaaagcacgaccagtttctgatcaagcaactctaataaatccacttattagcacgtgtctggtgtaaccctggttatgtagacatcatatcggatttttttttatttgcttaataattcttggtttcttaaaaaccatcttttggagtatcttgacggtgatctctaatgtagtaccattaggacgtccaagatgacttttcttaagatgaagttgaccatcatttcaccattagcttttttgcaagcaaagtcaaaaatgcaacatcactttatacaaaagaaaaaaattcaattgcaacagaaatttcagactagccttttggtctttcctatatatattaattctctactgaactaaagctaaaaatcctatttcaaccacttttatctttcagccagtttaattaattgttacatatatacttacatagtacctaattaattttcctcaagaaccttttttttgcatttgcttgttcaaaacgaacatgcatgtaaattaaagcaacagatgaattttcaagagcttagttattataaagagaggaaaaaacacagagaaaaataacttttaactagagaaaaaaggaggataaaaattaaaagagggtgaaagatcaaaggtgtagtactcaccctgctgcctcatgacccaatatgcgaggaaactttcgctgaagctcgttctatcatcatcatcatcatcacgccagccaaaacagcagcatcacatgaacagacagattgaaggacaaggcaagaatcaatcaattaacaatgctcgagaaataattcaattgtgtacatctttgatatagaagacagaattgtgtatgctttccttcatacaaaagaagttaagtaacttaattagcaaaatttcatgaacacgattactgcatattcgtctatctttttatatacatctctctatatatgtatttgtatgtgtatatatatgtgtagaaagatatatacctctcctttccaggcgctgaggtcggtatggcagatagaggtgaagagcaccttgaggcgcacctccatcctcgccggcggcgccacctccacctcctccatcaccagcgcctcgccggggccgtgcgccaccgccgctgcacacgcatgatcgtcgtcgtcgatcgtcatctcatcatcatcgatcacaccggccggccggcaagaaaagcttgccggccgacgatggccggagaggaggacgaagctagatatagaaggcgatcgatgtcgttttaattctcacctttgcatttgatcggcttccctttggtgtcggcgccggcgccattggagtgcagggcgccgttgccgatggcagtggcatccatggtgtttcttgcctttgactttccgaggagaaatgtggatttcttgattgtagcttcaagtgaggcaagttgatgggtttatatagagatggcatgaggagagagattagctggatatatatatatatatatatatatatatatatatatatatatatatatatatatatatatatatatatatatatatatatatatatatatatatatatatatatatatcttgtagatatgatagggaggagaccaacaagggattaaatattttgttttcttgaagctataggttgagattttaatttggtttctcttttattttctcaaaagaggtgcatcaatccaaccagccaccgctttaactcctggcacacacaattatgcatagctggaagtatatctgtttcaaattacttgtggttctagcaaatctcatacaaatcaaaaggatatcgaagattacatagttgccccattaaatacatctcaattttttttgttttcaaagcatataaaccaatgggagttattgggagtttatgactgtattaatgcatgactatattgatgaaaaggtggagataagatcacctctaaaaaggctttgaattgtgagaaccatataagtaatttgataaaaaaaatgaaatgctagaatggtaagtaatatatatgaaactgagggagtactgatttttttgaagaagttaggatttatacttagctaacgactattaagcgtgttcaaacacggtgtactagagagtttgtgattaaggtgatgtgtttgtcggtatatcttgctgtgaaaaaacaaggtatggttcatgttcgccaaacacaattttactataaaaattaatttctaattgtataaaggtaaagctccaagtaactccatttttcactcaaacaattaaacaacgcccgcacccaactaaaatcagcttttttaaaaaaaaaaaccatatccaacaagataacctatgtaaaagaaaatttattttttcatggtaatttgtatatgattttaaatattggtgttctaaaccaatcttacgtcctatgcaaataataattaaattaaacatcctgaaaaactcgaagtataatgttactatcattcactccacaaatttcaccttaaaaaaacgccttttcactaaaaaaaattcaccttaaaataagactcgtgtaatgcgaagcgagaaaattattgaaaaataatattatacagaaaagcgaacaatttcatgcatggtgttgatataataattagtactgtggcaaaatagtttaaactaggaaagtggtatttttccaataaatcctaccatttaacctacataaagttggattaattgacaggggttaagcatgctattataccgatcgacacatacacgctccaccattgacttttgaaagaaaaaaatggaaaaattaggccaagaccactaacattaattaggtgtaaagaagaggtatgaacacccgaagctcatgagtggaggatgctgtaaattatatatactcacagagttgtaaatttacaggtttgatcttttgattacgacatgaactgtagtttaattgcaattgatggcatcgtattaaagagacagcaaactcttctatttgtattgagtgttttagcaggagactaaatcgatctacttattatcagtccatttgtgaatagcaagtaagcacatgaacaagcactgcaatcaatgatcaatttaacatgtggcgtaagaaataaatgtgaaaataaatcgtgggtagatactagggatgaaaactgaacggatagttttcatctgctccagagaaattaaaacgaatatagatacctttcgaaacggataatatagatacctttcgaaacagatagttcggatacgaatacggatatagtatcggggtttccgatatatatggataataatacggatatccggtgaacaccctatttcttaataactctataaccttcaatctacctttttagattttaatagtaacacatatcttaacactagtccacattattattattagacttttacataatttttataaattatactatattttatataaaatgagctaattatgtacgatgatatttgtttctattagaaattgaggtggtttccgtgttccgagaaaaaaatgtttccatattcatgtccgatcatatttgatccttattcatattcaagataatttgtatttgtttccatatccgtgctattcgtatttgttttcgtatccggcaaaaaaatatgaaaacggatatcgtatgagcattacacattcgtatccgctccgttttcatcccaatagatacatcttgccactggaccagtttctctttaaaaaatttaatgatatatatgtatgtatgtatgtatgtatgtatgtatgtatgtatgtatgtatgtatgtatgtatgtatgtatgtatgtgtgtgtgtgtatatatatatatagtgaatctattctacacccctcccctagaataactattctacacccccccctcccatgggtcaaacccacctcccccaccctccctagggcccaaaacccctcctcctacctcggtcaaagcgtcctcccaccggtcaaacccgcccaccactttgctgctctcgtattgtaggaatcgtgcagtaacaggacggtcatcctgcagtaacaagacagcattatcgcagtaacaacgtcaaaaagtagccatgatggatctagtttcgttaagtgtttttttatgaactttatggtgcaaacggattggaaatacaagatatgatgtgagagatattgctctctaaagattgtgatttacctcttttttagttctcgtctcactggaacagcgtagtaacacgatggccaatatgcagtaacacgtttgcttttcgcagtaacaacgttaaaaaatagttatgatggtttcagtttcgttaagcacttttttttttacgaacaccatgatgcaaatgggttagaaaaataagacatgatgtgtacgttagtactctctaaagattgagatttaaaatactctagatctaaaaaaacattactactatagggccactgttacgatgcatgttctctgttactgcaaatttcgtcatattgttactgccaaaagtgcagtaa

SEQ ID NO: 73817 - DNA, 21637 bp, Oryza sativa
  unsure (1)..(21637): unsure at all n locations
atccagaagtgaccgagttcaatgaggatgcggcatggcaaattatcatggcaaattatccctataagaactttatgttttccttttatctttaggaaagtttcttttttgtcctaaaagaactagtatctccccatgggtataaatatgtacacccggggtcattataatttagctctcgatcaataatactctcggcgcatcgccaccctcttttctgaggtttttacttatcaaccgacgaaatttggcacctgacgcggggctgcatctgttcagttcgatctccggcgaatgggtaactcctacgttccgccggtgcaggcaattgtcttgtttacgttggtgtcgtttaaggctgcatcagtacattcgacctcttggattgctccggtttggatgatatatttgtctgcctatttatcatatgtcttagttagtctaggcttagtatctcaatttagctctatcgattgtctctcgctttagggtttctgtcggtatcggctaaattgttttacaagattagattagctaaggcatctaccaccctaaaaatcagtcaagggcttaattttctagatatgatgtttcttttcatacttagtgttgcatcagttaagtttgatctactaagtcgtgtttagaaccataatccctagcctgctttttgactgccaataagggtttcatcgggatttcagccgatgagttatctggatgttgcatcggcttacaaggattacatacaagttggatttagctgatggcaacaaaaatttcactgtttaatctaatattgtggatttatgacattggacctccagccgatgtatgctttaaccttcggatcagtgcttattctatcatgtcattgttagccgattggtttctactagattatattattgatatattatattatcatcagtcgattgtctttatatcattatccacattgggtatatagcagattgctcaaaaccatatcgctagcggctggtatcggcatcggctggaattattcctttggtttgacaaccgatcggctcattggtctactatttgtatatcttgtcagttgcagcaacaaactgactggcacgcccgcatctcatcaacctttggacctgcactggagctaagcacatctcccaggccagtgtgtgtttttcgcatcaacacctcccctccctaggaggtcttctatttatacccatagatgtccccttgtccaagtagaagtagagagacaagtatggatataatccgagtagtccatatagtttccatgtagaactctgcttgtccttccttatccggaactccttctatatacgaggtatgattccgtataaggcttcgtacaaggtgggccccgctgaccttaatcgactaatattgggtatgtgttatccataaccatgacaatattgatccttcgtttcacaattggtggtgtgctttcagaaatgatattcttctacatatgtgtaggacaaataaaattcttaaacaactagtttttgattggttgcacagcatttaatttcttttctggaggtgtttacctcttgtaacattcgctgtaaatatagttttttctcttttacaaaattacactactggggaaatgtctggtagcattcaatttcaaaaaaaaaagaaatacataacatctgatccatttgatatagacccaaccaacatgattctatgtaagccacataatcatctatccaccaatttcactcgtttaatgggcgccaaattctggtacttttggggtcatgatgctaagaagtatactcattggtctacttctattttgttgtgaaggtagatagcaaagttattaaatttgtcaattcccctttgaacattatgtatagtacatagctagttatcaaatgtagatcacttcaaaattgtttgtggagaacaaaagcaaattcggccacactacatacagtcaaatacctcgatacaaattcagccattgggaagttaattcagccaccggaatctaagtctccatagactacatagaacagaacttaacacaacagaaatcaaatgaagggtgttgtgtccctgatgttgcagagcaagatgcagggtgccgagagcccgagacgcgatgggggaggagactgcggcagcagcgacacagtcacgcgcatcatgggaaatggcgtggggcttggggggtggacaggttcggtagtgttggtcgcaacaccgtagccacagagcaagtacgcacagcagggaggataggctgcggtggtggctataggtgcaggcggcgacaatgacacatgcgaggtgaggaaaccacattgccgcaagggaaggagggtgcccctatcatacccccgatgattgaacggtcagatttcatttgatacatgcttgtacaaagtacctggaggtactaactgctggaccggaacaaaacacattttagatggaggtagtaaatttcaagcacccaagtttaatcccaaaattagtgcacttttaaattactactctctccatcctaaaattagcaacatagtatgcaatgagacatcctagtattatagatgtggacatagcagtatctcatcttatctcatctcatacaaagttgctatattttgagatggaaggagtatatgccccatcagttgaagcatgggtactggtcggcgttgctctcagtccgcacgggtggcaatgccactcaccatgccgtgcctcccttcctcccctccgtcgctgtccaagctagcaatcggatatctgtgcagcggcaaggtcaaaggcggtgggggctgcttaccagctccgcaatggttgaaggcaagcagtagctatcagatctgggtctccgctcctaggtctagatgtgtggtggagtggtgacagggatcctctccggttcatcaacaatgatgcccctggcttgcggatggtgccgatatgggggctttccccagttcgtggatggcggtgcaattagggcttctccccggtttgctgatggtgatggtggggctccattcctgagggtggtgacagggtgcttgaccatgggactaggcgaggaggtgatagggtggtatggcaacggtcacgattgtgggaggcgacgatagtagttgaggccagtcagccaggcggttcacctggatctggcgggggtggcacgcaagtggtggtggactagcggctctaattgctggttagcttggtgttctccggtgaagcggtcttggacatggccaactaatgttggttgctaagaagactgggctaagcaggggagcatcgaggtagcgagcggccgggtgagcgagccgggtgagcgcctagatccggtcgcgtggtgccaagggcagcggtcatggtggttgtgcttttggtgtggatggcaaagatggccctagggcagtggctaccagaattgttctttcttgtccagattggtcgagtggattgaaggcaagtgttgacagtccttaaatcataatatctaaccgtcaatgcctacatataatgaaataaaatatggtatccaaactagtgttagggatattactaatcatttccgctagtgttggtgaaatatatgtatgcatgtattttaaggagaaaacacatctgtcctgtgacaaaatacacctccggataatcaggacacgtttacatggattggacggcggaaatgctactgggcgggcgagcgccctcgctcgcccagagcgatcggttccccctcccccctccccctccctctctccacctggtttccttttttggcaccgcattactttcctattttagtaaatttatgcacctaaagtttatacacctcaagtttacacatttaaagtttagagaccaaaagtttataaatcaaaaagtttatatatccgattcaaatttgaatttgaattcaaataatttttatatatatagtatttctatacatctaaagtttatacacctaaagtttatatatccgattcaaatttgaatttgaattatgtccgattcaaatttgaatttgaattcaaatatttttcatatatagtatttctatacatctaaagtttatacacctaaagtttatacacctaaagtttatagacctaaagtttatatacccgattcaaatttgaatttgaattcaaataattcaaatattttctatatatagtatttctatacatctaaagtttatacacctaaagtttatagatccaaagtttataaatcaaaagtttacgtacccgattcaaatttgaatttgaattcaaattttttatacataaatttttctaactttttgttttttttaaatttttttgtggtgtactgtaataggaaaagaaggggaggaggaaggggagaaaggagggggggccgatcgctggatcgctcgcttagcgagcgatcgcccatcaagcgcccccattggagggcccatatgtcaatcaaaaccacttagaattgggccaaatcatagcataggatgttgggggcccattaagcaacctcccggccgaaagagaggtcgggacgagggtttttgggtatgtccgaaccaccaatttggccgaacccatcctgaggccgttgattgccatatttcacgtgtacgctcctgatctctttccaatgacggttggagggcatttaggacatttcccatagctataaccgtcatttggagcctataaaaggaggagctcacttcatttcaacacacacaactttgagctgaattacaagaggcacagggtgagggaaagctctggaggagtgcccggaagtttggcgctctctccgatttctacctcaacgagtgtagctttttaggaggaattctggaagagtatcggagttgtcggtacactgctttgggttcggagaaacttcttttataaagtaagcattcgggatcatttcttatgttatttaattatttattctaagtaagatttccatctttgtgggttcattgtttagtattcgtactaagtgcaccagttctagtactctggataaaaaagaaagttcctgcgcaagtattagagtagtaattaataacttagacgtggtgtctagattagagcactacaataatctatgacgaaaaaaattcgtcatggatcactgaaaattcgtcatagtaatttgactgtgacgattctacgtatcgtcatctattgagcatcacagattaaatctgccgacgttttctccgaaattgtcacggatcagcacaatctatgacgttttttaaccgccataaaacgcttttgggctcgtgtagtccagccagtcccaacctttgtgatgaaattaaacgtcacggatggttgccacgtggcggccaaaatggccagtggcgtggtcgttgacacatgtgtgatgacgtgtcactgatgatgtggtagttaatgtcagcaaatatttttaaatgacccattatttttttaacggcccattatttttttatggcccattatttttttaacagcccattaattttctactgcagcccattattttgttgagaactgacccattttaaaataggcccattttagaactaggcccatttcagaactagcccattttatcaaccaactatcatatcaaagcccactaaacaggcccattaaatttgagaccaccaaattcaatccaatttctcataccatctcagatacaaacataatggcagataccatctcagattcaactaaaaacagatacaatccaaatacaacaacattcaaacaatagttcatctcagattcaacctaataacaaatagtctcagatactctgcttgcagaatcaaacaatagttccacagcaagcaacaaaaatttgtgtagcagaaccaagctaccaacttgtccaagttcaagaatcacacaacattcaagcatacacagttttggttcaacaaacacctgaaaacactttcagcacaaaaaaaattgaaggtccaggttcaggttccctccacaccagcaggacggcaccaaaaatgaaccttagtaaattgcagccatgttgatctgtgcacatactagtactaggtgttggggttatattactgaatatgcatccttagttcaataagcaagacataattttcatgagtgattggccaagatagtatcatctaaaatttaatggactcttaataggataattcaagtatagatcagccatctcagtgcatagttgatagcaagaattatcttggatgatctacaagtgcatttgagttaagcattatatctgtatatagttcagtaaagccatcatagaatgaattttgaatgcatgcatagttagaaataatcattgttctatttaacctcaagaggttaagataactagataatatcactattgtgctactatttctagttaaataggcagagcctaaatgggtagacagtaatctatttctcagtatagacactaaataaagcatctaggatccattggcagaatcataggtatcaatattaggtcagctagaagagcagagcatatttagagaaaagaatgacatctattaggtcttgttcagttactagggattaaatccccaaggggaagcaaaccagggagggattgagtgaatcccaccatgtcacttaaaccctgtggggatataaattcctttctcctaatccctctattaatggaaaccctgtgttcggttatcaatttttttttttttgctactgatcaataggaacagccgaacaaccaccctacaatgcttatgtgcattaaaatgtgacagacatgtgtgacgaatgatcttgaaccaaaacaaaatgtaattttttaatggccgatgatcaagagcatcaatgcatatatcaactacatttgaatgctcatttcaactgcacgtttcgatatccgtaaaatcttttgctgatgagcaactgcggaatacatacaaatcttcatccaaaaattcgacacaaactggctgtcaacacgaactggctgtccaggttgtactgaaattctaaacaaatgagcatagaaacaaatgagcattgtactaatacccaaccaacagtgacccctccttccctgtgctgtgcacactgctcaaagaaaattaatgatcctactagtatctcacagatcattcgaaatgcaaatgcatgcatacatgttaatttaacctgtccttttcgttttcttgatcaatgctggggcaaaacatatttacaggtgcaggcttgcagctagcatgcatggggcaaaacagatttacagtgcaacactgtgatgagtcgcgattaaacagtcagatcagatgacaaactatgccaatttatgaaacaccaacttatattacctttttttagataattaacaccaacttttatattacttgtaacaatgaaagcaaagaatgccatgaaatataactgaagaaatcaagaaatccaccaatgtgcagcaatcaatcgatcactagagattagctagctaagctcagtaattaagagaaaggaattcatataagagccttcgcggagaactctatcagtttctatttggttaccgaagctaaatggacccgagctgttgatgaccgaatagaaaggtttattttcaatggcatgtcctagatgatgtaggctttgcttcctcagcattaaaccaatcttcaggattctcaagcgtttcagctatttctagatcaaccaaaagctcataacttggtttattcttcggttaccatatctttgaatgacaaagtgcccgggaagaaagatctagatctctatcatcatctatctctatatctaaatatggaagaaccctcgaagcctgtccccgacgacgatgccccctgggtgaaaggaaaggggccgccattctctttctttcctcaatcgttccgatcatttctctcattcccttttgtttgtttggtggggccccgggttggttcgtttattcttttccatgtattagattatccgtccgagccatatcaaattaaaaatatctaaaatcaaattcaatatagaaattggaatagattctattagaaaacatatatatatcgatcaaggatgctgaagacatcccagcgtattgaagtacctaattatctactggcccatccaagaaccaagggaggaggaaatctaggtgacacatcaatgggaaagaagacaaattcaagaatgccgctgtttacacccaaatttggcacctagggataaaataggaaaaattgccaaagtttggaaatctgccggtttcctccgagtgggccggtttgaccgccatgtgttggccggtcagaccgccggtcgaaggccagtcagaccggcggtatgtggccggtctgaccggtagagcccgagttcgggtctgtttcgccgggtctcgaggtttccttgctcgggaaggcatgtttcgggtttcctttgaattctatcctgagttggacgtggaggaggcctgtagagggcaagaccaactcctatataagggacatggccggttcaattataactaaccaatctacaatcaatcaatcgaatcgttttttatattgcttttagttttctcttagtttgtccatctttgtcgatttgtgccgtaaatcgtccgccgccgctgcgagagtgcgacacctctttgtaggtttgtcctgaaaaccttccgttttgcccacgagacgggtagttatctagaatcggctctgctagccggttttgttatcaaaacccatcttggtttagcttttgctagatcgaggtggttggtgactctaggatcaccgcaaggcatttaggtgctgcgatcgtgcttgtcaacttgtcacaaaaagttgccaacacgatttttggcgactccactggggacatctgctcaacgtcaactcaacttcgacctcaccatgacgaagccgccgtcatccaaggcggaggtggagctggccaatgtgataccaatcatatttgatgatttcgaaggggaagatcgcaagtccatggaggagtacattaaggagatcacacaggaggcgctgatgagggcgtgcaccaggactcgtcaaggcgtgatcatcaagcctaagccacgtcctaagcctacttacgatgtggtaagtaatgaggaggtaacacaatttatccaacaacacattgcatctacaatagattcatctatgattactttgaataataagttaaatgcatctattcagaatcatgttgaaggatttttgaggactagattcggccctctcgtggccgattttatgttcaaagacaaagcctctaccagtgctagccaagccactatagatcagataagtagtataaccaacggggcgaaaacacaacagcacggcgaggggtgggcggcgcacacagccagtctaaccgggcctggtggccggttagatcgcgatgtcgctgtcggtcagaccggccagacggccggtcagaccgggtattaccccggcggtcagaccggaactcaggccggtctgaccgcgccactggacgtcggtcaaaccgggtcttgggccggtcagaccggcacaatcatcccaattcagggggtagatccaatgacaaataatgcttatttgtatcatcttagaacatttgattcccctgtatctactgccactacttgtccccaaattctcctacatgttcctaatgcttataatgatgtttctagggggtatcctcccgatactaggcaaggccaatataattatattgcgccgcaaccacaacctattaggccaccaaacccaccaccaaaccaacataggcctgataatatggaggaattgattagtggaatcattagggataaattcaggattgaagctaggaatcgtgctaaggtttaccaaaagccgtatcctgactattatgacaacataccatatcctcgtggttatagggttcccgaatttaccaagtttaatggtgaggatagtaggaccacatgggagcatgtaggtcaattcttagcacaatgtggagaggctagtagttccgatacttttaaattgcgcttgttttctttatctttgtatggtactgcttttacatggtttacttctttaccggcaaattctatacatacttgggctcaattagaacaaaggtttcaagattatttccatactggtgaaactgagtttaggttatctgatttaacatcagttaagcaaaagtataatgaatctgtcataggtttagggatgttaaaagctgatattatagtttaaacataactgatagagatttgtctgatcttgcttttaatggtttaattgctcctattaaagaaagattagatgttggccaacaatttcttgatgttagtcaactcgtgcaaaaggcactagctcaggaaagccgggttaaggatagcaaaaaatttgttagaccatatgagaagaagcctaatgttaattcaattgattaccatgaggctagtgatagtgaaggtgagggtgatcatgatatgtatgttgcctgccgccgagccgtgtgcgccgctgccgattcctccacccgattcgctcgattctctgagccgtttcttgaattagttgaggggatttgtttcccttatcctcctctatctcttcccccaaaaaaccgactttatccctttgaattcgacgcgaatttggattcgttttcgagtttatgtctccaccaaaccctaggttttcccggcgcgattccttgcgttccaagcctgatctctctctcccgtcgctataaatagagtcccctccctctcctctttcggccgccacctctccctctctatgccatcgcttgtagcgccgtccccgtgttcgccttctctctccgccaccggcagctgctccagccgccgtttgccgccgcctcagctgatgccctcctgtgccgccacctctctcggctctgcaaggtcaagagcaagcccggcagccgattcccttgcaccgaagacccagggaagcccgtcgtcgccatcaacccgaagctcgccgtcgtgttttgatctccggcgaggctctgctgctcctcccgtcatcgccaagcttcgccgccgcctccattggattcgcagctgcgaagtgaagcctggccacccctgcattgtcgccgaaggtcgccgaaacactgtcgccgccgtggacagtacctcgccgccatcccgttctcgtcgccggccatcttccatcgctgtccgtcatcacgtaagtgttggtaagaatttccatcgccttctctacctcccggtgccctccgtttgcattattgtgtcgtggttcgccggcaaccgccgctcctatgtcgttcaccggtgtagtttatccctagggtcttaatccaatataatccaatccgtggttggtctagcattgtcatctccgtgtgttgctgccggaacgttgtcatcatcccttcctctccgatcgctttggttcggtgagacttctattcgttctctcttttcaatggcatattatttctttttaatatatgtcatctaccaaatataatctaatattttccgaaggttgttttaatcttttctctcagttataaatcatttataaatggtttaattaatttggaatagtcttttctttaataggtttaattggaattaaatcttgtaaaattcgtaattaatttatatgaaatcggaatgagaccgttcaagtctcataattcatctaaaatcatgatctacatatttgtttacttttatgtactgtttatttggtttttattagtctttttctttgttttgcgtgttagcttgtcgtttccgtcgttgcgaaggcaagtcacacagatcctaaacacaattcctttgagcttgttgatcctatatttaaattctctatttatttcaactgtgcatttattttcgaatgtcatcgggtggtgtgaacctattcctttgttatggccaatttgcattgaataccctattccttcataccttgggtaacaaattaattagcttgaaccttatatattggtttggttcagctaatagctatatatatatatgtatgtatatatatatatgtatatatatataaatgtatatatatatatatgtatatatatatatgtatatatatatatgtatatatatatatgtatatatatgtatatatgtatgtatatgtatatatgtatgtatgtgtatgtatatgtatgttgtgtgtgtgtgtatgtatgtatgtatgtatataataattgcttagccatgcttagaaacattagctcattaatgggatgaatcacactacattattacttatggttatatttaattgtagctcatgatggttaatcgtgttatgataattaactgataattaaaatttgattaatggtgggttgtgagcacatggttttgaaggtcgtgctcatgacaattaaggaccggtttgcgagctactgttgtgagacattaaccgtaccaactacaagccagcgtgggcaacggctttaccttttgtatagcatggttctttacggggtgctagactgagaagcggtgagaagtccgtgggggtcgctggggagtccatgcctctggttatatttatagagggggtgattatgatccaggaatggtgcattgtggtgagttgtgttgtgcagagggtattgtcacaacctctattcgggtactttccagtatcgcgacgcatggtagacatgatgttgaggctgtgtcttgtgggtatagtggtacacctctggccagagtaaaactattcgaatagctgtgcccgtggtcatgggcgggttgagcaatgtttttcgtgattagtctcacacctctcacaataattattgatgctataactggtaataatttgtttagctcctggtttggagttagatctgtacagccgggtatggttgttcagaatggttgggcctgagcagcatgggcgtgttgttcagtgttgattaaaattaatgattaaattagtttattgttttactactcttaaatgtttattaaatgctgcttttgcaaatgagcctatattatgccattctttggtatccttgtgcacttgcatatttgctatgtggcttgttgagttgtcatatgctcactttgcaataattaatcaacctcagttgaagaaaatgatccagaaggagaagacgtttggcttataccccagttgagctgcctatgggagtggagccggagcttcgctagaccattaattttgctgttgttttcttttcttttgtaagtatgtaacgatgttattatgatggatttgtatattaaattgtcagtttgtgtgcctcggctgattccgggacgagggttttatgcacaaataagttcggaaattgctagtgagtttccgggcgtgacaccaagtggtcatgggactaacaaaaacaagccttttgtttgttctaatttaatgccgactcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacgggcggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagacatggaggtcaacatggcgtgtatgttgcctatggagttttgtgctatggatgaagctgaggttgctcaattttcactaggtcctaaagatgcggtttttgagaagccgatgagtcaaaccgtcatatgaagcctctctatctcaaaggtcatatagatgggaagtcggtctctaggatgctagtggatggaggtgccgccgtgaatttgatgccgtactcgttgttcaagaagttgggcgtggagatgatgagttgaagaagaccaacatgattctcaatggcttcaatggtgaaccaacggaggcggagggtatcttttcggcagaacttaccgtggggaacaagacctaccaaccgctttcttcatcgtcgatgtgcaaggtaactacaatgtcattttgggtcgttgttggatccatgccaattgttgtgtgccttctaccttgcatcaatgtttaattcaataggacggcgatgatgttgagattgttcaagcggatacatcggccgaggttgcaatggctgatgctacttttgagtggcgccatgggaatattcaatgcttatcggggatggatctctttagttatgattttattagtatctccaatggcaaatttgtacccatctctgtaaagccggctagtttagcacggctaggccatattaatttatgcaatgactagagaagctaatttagggtggtagcaaaagagtgtgcaagaatattggtctacaaataacgatattggtgaaacttttgaagattttgatgaggtagagaagcttggacaagggtttacattggccgatccattggaaaaagtagacataggtgatggaactaagccaaggccgacttttgtaaacaaaaaatatgagatccggttataaggttaaagtaatcgagctacttatggagtatgtggattggttcgcatgggagtatcatgagatgccgggacttagccgtgatcttgttgagcatcggcttccaatcaaaccgagttttaggccttataaacaactacctcgtcgttttaatcctttgctatatgaccgagtcaaagaggagattgatcggttgttgaaggcggggtttattaggccatgtcgttatgcggagtgggtttctagcatagtcccggtggacaagaaggggagtggtaagattagagtttgcataaactttagagatttgaataaagcttctcccaaagatgaatatcctatgcctatagccgacatgatgatgaatgatgcctcgggtcataaggtgatttgctttttagatgataatgccggctacaatcaaatctttatggcggaggaggatatgtacaggacggcttttacgtgcccaggatttgttgggttgtttgagtgggttgtcatgacttttagattgaagaacgccggtgcaacatatcaaagggcaatgaatttaatcttccatgatttgctaggtattatcttagaaatctatattaatgatattgttgtcaaatcggatggtatggagggacatatagccgatttgaggttggcttttgagaggatgcgccggtatggtttgaagatgaacccacataaatgtgctttaggtgtgtcggtggggaggttcttaggattcatggtgcatgagagaggagttgagattgatcctaagaagattgaaaagattcgttatttcaaagcgccaacatgcaagaatgaagttcaaaagttgctaggtaaggtgaattatttgagaagatttatttctaacctagcgggtaaaatcgatgcttttgtccctatactgcgcttgaaaaaagaagccgattttacttgggggagggggcaaaacaacaagaggtgtttgaagagttgaagaaatatttgtctactccacttgtggtgcgggcgcctaaagccggaaagccttttcggttatatattgcctccgaagacaaagtcattggtgccgttttgacgcaagcggaagatggcaagggatatatcattacatatttgagccaacgtcttttggatgccgaaacgaggtatatctttatagagagactttatctatgcttatactatgcttgtaccaaattgaggcattatttgttatctagtacatgcatagttgcttgtcaagccgatgctattaaacacatgttgcaaaggccaattctaagtgggagaattggcaagtgggcatatgctttgattgaatatgatttggcttatgaaccgttgaaatctatgagaggccaaattatatgtgattttatagtagaccatcatgtagatattgcttatgaggaagaggtttgcttagtcgaagttataccttggaagatttattttgatggttcttcttgcaaagagggtcaagttataagggtagttttgttttcacctaatggcatgtgttatgaggcatcggttcgtttaatcaagccgaatacaatgctttattattcggcttacaagtgatggagttggttggagctaagcatgtggaagcttttggcatgaggcccaacaacgatattattgccaattttgataattttgctattagacatattgctaggcatgataattctagagcaaatgatttggcacaacaagcatctggctataatgtgaagaagggattatttctggtattagaagagccggtgcttgattttaagtctttgtgcgaaattggcaaaacttcagaccaggggcggtctgaccggcattgcacggccggtctgactggccacatgccaccggtctgacagtccaccccgagcggtctgaccagccttgcacggccggtctgactggttctggacagagcgctgggggcacgctgtaattgattcaaaggccgaattaattgtaaattcggacatttatgcccaggaaacagaggaagattggagaattcctttgattagatatatgaacgatcctacacgtaaggttaatcggaaaattcggcggcaggcgttcaaatacacattgcttgatgaagtcttattgaagtgtttagatgaagatcaatctaaagtggctatgggagaagtgcatgaaggaatttgtggaactcatcaatcggcccacaagatgaattggttgcttaggagagcggggttctattggtcgaggatgattgaagattgtttctaatactataggggatgcgaagcttgtcaatggttcggcaatgttcagttggcgctcgccgccgtgttgaatcctatcatcaaaccatgtccgttccgaggttgggttttggatttcattggtcaaatttatccttcgtcatcaaaggggcataggttcgtgctagttgctacggattacttcaccaagtgggccaaagccgtgccgctcaagaacatgactcatacggaggtaattgactttattttgaagcatattatccattgattcagtattccgcaaacattgactacggatcaaggagcttcttttatgtctaaggaagtgaagagctttgccgaatcttatggtgttaaattgttgagttcatctccttactacgctcaggctaatggacaagtcgagtcgagtaataagacattgttgaagctagtaaagaagaagattgaggaacacccaaagaagtggcatgaggtgcttttccgaagcattgtgggtgcataggatatctaaacatggtgccaccaaagtcactccttttgagttggtttatggtcaagaagccgttttaccgattgagataaatcttggttctctttgctatatcaagcaaaatgatttatcaagtgaagattacaagacgttgatgggagacaactttgatgagatcatcgacaagcgcttgaaggctttggaagaaatatagaaagagaagaagagcgtggccaaggcgtacaacaaaagggtgaaagcaaagttgttttaagttgaagacttggtttggaagacaattttgcctttgggtactcgatctagggagttcggtaagtggtctcctagttgggaaggtccttatcgagtatgcggcattgttcgaggaaacgcgtattttttggagacacttcaaggagagcgtttcagcgagcaagcaacgggaaatacatgaagaaatacttcctgagcgtttggtaggtactatggccggtaattggattatcgccctaagaccaaaaacatgttctatgcttttagattcacgttgatcatcaaaaaggcaggggggcatgtgtttataaccaaatttggcacctagtgataaaataggaaaaattgccaaagtttggaagtccgccggtttcctccgagtgggccggtttggccgccatgtgttggccggtcagaccgccagttgaaggccggtcaaacccgcggtatgtggccagtctgaccggcagagtccgagtcctggtctgtttcgccgggtctcgaggtttccttgctcgagaaggcatgtttcaggtttcctttggattctatcccgagttagacgtggaggagggcctgtagagggcaagaccaacccctatataagggacatggccggttcaattgtaactaaccaatctacaatcaatcaatcaaatcgtttttcatattgcttttagttttctcttagtttgtccatctttgtcgatttgcgccataaatcgtccgctgccgctgcgagagtgcgacacctctttgtaggtttgtcctgaaaaccttccgttttacccacgaaacgggtagttatttagaatcggctctgctagccggtttagttatcaaaacccatcttggtttagctttttctagattgaggtggttggcgactctaggatcactgcaaggcgtttaggtgctgcgatcgtgcttgtcaacttgtcacaaaaagttgccaacagccacctcaccagttcgtcgcctaccgccgccgccgtagcatagcgcgagcgagaaaccctaaccctataagaggaggggagaggggaagggaaagatctcaccaggcaaaaggtgaccaccggaagacagctgccggaggaaagagcgcccatcatcggacttggacgggacgaggcccgccgccgctggatctgggcgggacgaggcccacatcgccgcccactcgtcgtcgtcgtcgtcgaggtcggcgcctccttgtcgttgtcgcggtcggcgccgctgcggaggggcagcccgcggaggaggcagcccgagcgtcagggtcagcgcccactcgtcgtcgtcgtcggggccgcgtcaccggcggaggaggagaaggaggaggagtgggtggatgttatttatatggcggcgagccaacgacgaaggggacgggtggaggcttatctgaattggatcggctagggttagggaactagtggtgttgaagcaatcgctgatgcaattttacaaaagtacccatggtgtatctggagttagcactaaaattatgtggaaaaaatggtcatttcatgttgaaatttaggtcttcctcccgccgcactgaaagaaggggaaaatattaggggagggagaggtggaggaaagatgaaatattttgaagtggtgaggaggcaaaatttttattgcaaattttgaatcgaattttatggcactaaatcagctcgtatgaaaaagttgtaaaaaacaaagttgtagaactcatttagatctaccattttttttggtcatttcttcatccgagtttgattgaactatataaaatttgaatttcaaattatgacaacttcaaacaatatttttaaatactaaatgatttcaaatgaaaaagtcatcaacaacaaagttgtataaatcatcaatatctacaacttttgtttttgtcatttcaccatatgactttgtttcaataatttgaatttgaatttcaaatttagacaacttcaaacaacattttcaaatactaaatgatttcaactgaaaaagtcatcaataacaaagttgtataacttatcaagatttacaacttttgttttggtcacttttctatatgtatttgtttgaatagtatgaatttgaaattcaaattatgacaacttcaaacaacatttacaagtactaaatgatttcaactcaaaaagtcatcaacaacaaagtggtataactcatcaagatctacaacttttgttttggtcattttggtatatgactatgtgacaatgatgagaagtccaaattcaaattattacatcttgaagagacattccacaatgctgaaggagagctactgattaagtcatcaacagcactatgtgacgaaccatgaagatgtactaatttgaaattggtcattttggtatatgaccatagtccaatagttagaagtcgaattccaaagtattacatctggaagcgacattcttcaatgctgaatgagtccaactgagtaagncatcaacatcaaaggtgtatgtaactcgtcgatatctatagtgcttattttcgtcatttctgtgtccgataaagtgatagtgacatcgttccataaatttacatgtctcttatatgattttgaagtatttaaatcacgacgaaattgctataacgtcacaggttttgggccggtttaattagcaaaattagagactgtcacggttt

SEQ ID NO: 73818 - DNA, 10800 bp, Oryza sativa
atccatttttatgtcattgttgttaaattaatttgattattgattgttgagagcctcaccaggtaaaaaggagccataaaaagatgcttgcttcacttaaatttatggatagaaataaatccaaggtcccatagacaatacaagattttatggaccaaaagcaacttttcttagcagtatgttccattaacaatggggcatgtagagtcagactcttcggggcttgatagcatcatattgaactatgacataatatctatgatataatatctgttatatgtaaacggattggatagcctactaaaattatatatttatttcttatgtttgatctatgaattgtgttcagtttcaggaagaattcaatgcaaagtttaaactgaaggccccaaattgtataataaatttaaggtggtcttgatgaaggatcaacttcattttcgagatatatggaatgcatgcagatttataatacattctcattagttcgaaactcagtactatcagattttgtatttcttcgatatttcaaaatcccctgtgctttggttgcactatgagaatttctaatttctttcattgtcatttgtatagatattcaaatgatgatagatttcttccatttttccaatgatttatttctttcttacatggatccttgtgcaatgtactctgttcgcatacagtatagttttgttttcccccttttcagcctgaatataattttcaggaagttttgattcttcattcttctatggatcgaaatgaatcggtttggctatatattgagtctgcaaaatattagattgatggaatatatattgtgaaaaacgtgcattgcacgtgcacgattactagtatatatatgtgtgtgtatgtatatatacatgtatatatgtatatgtgtgtatatatatacatgtatacatgtatatatatgtgtgtgtgtaaatttttagtgtaaatttcgatatctctcaaaaccattttacactttaaaaatatgttaattgggaagctactttaaaaaataaacatggaagcactagggatgcaagtgggtagttccgctatcttcataaaaatccgcttgctagtttattttctatatggtagtataaaatttagaagaaaaaataaatcagaagtgagataagcgggcaatcgttcttccgttttagcagataaattgcgccacgatgcattttggacatgtcgatgtccataccgctcaatgttctagaggacgacaaacatagtatttttcaaggtacagttgcacgggagcttcaccagatgaattacgacactgaacaatttgcactggtttcacgcgatcttggggggacagatcagttaattacgcctcttaataatgatttaatcaagaccacttgcattaaacataagaaagagaaaaaaaatgtatcgaacggtccaatcgagttgtagcacgtcacaccctgtttgacccgccaaaccactcttacgcatgcacacgttctgtttacggtccaatctattggttattggttattgatgattcacgttgtattccatccatactcataaaaaaagtcattaaagacaatgtgtaagttaaaccttatgaatataaattataaataattctcaagttgttgagtttgaaaatgtaaaaaatatatgtatagatttatcttgaaaaatacttttataaaagtatacatatatcacttttcaataaatatttttatagaaataagaaatcaaagttgtgttttagagaccgtgttgctattctaaacgattagtatgagtatggagggagtaattaagaaccgtttactgtatattgaactgctagtaatcaggctttgggtagcaatggactggtttcggacgtcccacggtgacattcttgatattgtgacacatgtcgcattggaggttttctgttggttgcagtgtccttgtaataatgtcttcgtcggatcggattctctgcagagtgatgacatgatatgaccaaatgacttattatatatcaattgctctccgacaatatctttcattttggttcgacgttagtcgccagatgtaataggagcgaaatttgatcgatacaggaatgagccgttgattttgaagatttttttttctggtttgagaaagattaggattgtaaaatcgtttgattcttattctgtgatgaataattggcatctgagtttattggttttaatatttggagattattagtgaagtggttttggagatgattggagttacaggtgttaaacaaggagtgctggagatttggtccagtcagaccgggcatgggttgctggtcagaccggtgtgtatctagtagccagaccgggcagcccgcggtctgaccggccgactctgtgtcggttgcggtttcgggttgtttcattggatatcattagataatttgtgtttatggcttctagatggatactatgaatatgtaatactgttgtttgctaataataagtcaagttggaaatagcttggtgtcggaatatggtttctttgtttgattcatgtgtaggtgtcttagtgcctcaggagagtattgtcgatgatggatcgggagtcaatttggagataaggtgatatccggacggtcagatatcatacgagatacttaggctaaagatcaatgcgcgtggttggtgaagattccatatggcatatgatggagatattgtgtgcgtatgggatacagagtcgaatttggtacaattggaatttgtaaagttggtttactgtataggaagatttcctaaagggattaggacttcttgtatgagtttggttcgctacctacctcatatataaatagtgagggagggtggcctcccggtatcgctttagatagcattgagttgacagaatagttagggtttcgagtttagtcgagatttttgtgaggagtgatgttgttgcactttctaaacacagagagaagtaataaagttgtcatttactttgacagatcttcaatttttgtttgctcgggttcggcggtcgtacctgcgatcagatcagcggtggtgcggcggtcagaccggtgggtcagtggcggttagaccggcgacggcgacaggaggcagaagcaattttcgggtggttagaccgggcaatctacatcggtcagaccgacggctttggcttggtcagaccggctaatctacttcggtcagaccgtaattcatcgatttgagggtaacttttagttccactaaaagttttggttttggggtactacaaccattcacccatctatggttggcttagttatcgtcgttcgatcctacaaggattacatataactattaaaactgttgtaaaaaacaacagctatgcatactctagcccaaccacttatagaaatatgtctttaagtgatattttttgtttttaattaagctgtaatttttaatttttaattcagagatatttgcccttcaaattttataataatatgccaaaataaatttcatgatgtaaaatactcgtccagattcgtaatcatcctagttacaatatttagagccggagggagtaaaagagtttggagtaagaagagaacatataattacatttgaccaatcatcatattaaaaatacaactaattattttattgtgacttatttttatatatttttaaaaaataactaattattttttatatatttttaaaagttattaaggcgtgatcgtaaacgtaaaattaaagtcaactgcgttattggaaaaccgcaagaagtattgggcaaaagtataagatcgtacattaatactgcaaattaaattaataagtacccatccatatgttagttaatatatggggccgtgcagacgtggacgaatttcgcacgctactttcttttcttgcccccaatcacacgtggtaactacaatacgtgtagatacagacaaacagtcatagagagtgatgcaatcaggcaagcgacttctccatgtgtccgaacgtcgtcacggcagatatttccatgtgttacagtagcccacctgacaatgaccagaccatagagacatgacagcatgtagtacaagagagactttctttttatatgttgaatatatttttaagataaaaacagtataactcatcgaaaactattttccaaaagtaaacctattggtcatgttacaccaccgtaataattttcggcgaacaatatgttgcctggctacaatagtcgcgtggcagccaaaagatttaattttaagtcaacatagtaccacagattacaagcctaaacaaaagcttagccaaacagttttagctttaccctaaaataggagtggagctgggtagaacgctattgcaaaataaactagagaggtggagctaagtttaggctgctacacaactccactccagatccaactcctaaaactaaatttagaagttggaactctaccaaatagcccatatgtatctaaagttttctttaaacaaagttttggaaaacaaagaaattaaacctacaggagacagattgcaattaagatacatatataacatagcagacatgtgcaattctttttatccacttggttttgtcaaggaactacgtacatgttgactggagcaagtgtactggttggagttggcgtcggctttttttttttaacatagtgggaaatgttgtctgctaattagttcactttagcttaattttgcccaataatttggggctactccatgtgggagttgctcagatgtgtgctggatttcactatatttataagaaattcattcaattggactcgatccgggtcaagtcggcatgtgactacttgtacatatacaaatggcgcgtgcacgaaacacctttgtttaatgatatcattaatttcaatttgttatttatcagtgtctggcattttccgtgctacttaattaagtagaataaattactggaccacagcatgactcaaattttaactaatcacatctgcatttttttcgcgtatattgaaaatagccagtactcttttctagaaaagagaatgatatactgtcgttagaaaaatatagaatggagttccctttgaacgatttacctctcccaagattcttgctggatcgtcacgaagaccaaggtagacttgaaaaatgtagtcgcagttttagtcaatctaaaaacaatgactagatcacgacctggaatgcagtgcagaaaatacatgaattacccatactttttcttgactttttttgttttttttcctcttatcacatgcccccatgcctcacaaatggagttacctaagagcatctttagcagaagccctcattttaaagccccaaaaaaccaaatgagggctgcccccaatttcctaggaccctacaaatgccttcaactccaccagcagcccccattttttagaccatatttattattctcttttatattaatatagactataggtttacgtctaatttaacatctcaataattaaaagataaatattttacaagatcatctcgatgtaaaagttaattatcaggtgcattatacacgaacagcacaaactatagagtatatatttaaccaaactactgaaatattatcctatatgctgtttcaaagaaaaaaattgaatatataccactgtctctctccttaatcctgtatgtctcgacccaaagaaaaaaatattgtctttccactggaatcctctatgcctctgtaaaaaaaatgcaaagaaaaatctactccctgcattctgcgtgcagggacattgcaggggcaagcagacaggcagaagagggacaggcggatgaaaaagcaaggggatgggctggtgggcaggcgctagccctccggccggcagcgccgccagcgcgagcaggaggtgcgcgcgggttggcaggcaaaagagctaaaatcagtgcggtgattcaccggcgtgcgagcggatggcggacctatctggggtgatcttgccagcggtgaggggtcaacgactgaaatttttacaatttggtcctttttaaaaacttattttacaaatagactcctaggaaaacttaaaccagaaatggtcctttttgggacgccagagtggctggtacagtaccctaacatgcgggcgccagccacactggcgccgtgcccgtgccaccgtggcactagggctgtcgtggaggtgctgactaggcagaatgggggcgccagccacactggcgccgcccctcataccacggcgccagcatggctggcgcgccctcctctgtgggccgacccttaaaccccgtgggccccaccacctttctcctccccactcccattttcgccaagtcccagcccgagcagcagcgcaggagttcttcccctctctctccccctcacctctccacctcaaatccaatcaatttgaagccgtttttcacgggattttttgtggaaatcgaagagaaaggtagactccttcattcccccttttttttcgtttttattggttgaatttgtagatcggtgggtaaccctagaaccccttttttacccaaatttatgatttttagcatttgttcttaggattggcttgttgtagtgctatatgtttgcaatgtactcattggtgtcatgatttttttaaccatatatgtggtaatgttaatttttggatggtttggttggatggatggatgaaaaattatggttgaggcatgacggaggtttgggttgtatgacggagtatttgtaatatttcgatgtgtaatgcactagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcgtgtttactacggtggtagagtggtggaaccttatgttggtgcacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgtttagaagaattttgtgacatattattctcgtcgtggagggggtgcaagtaagagtgagttggtacgagaagacttggagggtgaaggagagaagaagagacctttgcttggaaatgatttatgggaggcaggaccatcaaagagatattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattacttttatgtcgaattgagtggtggtcacgattctgtctctgtagaagtcaatagagatgatgttgacgaggaggcaagtgttgagcaatatgatgttgaacttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgctagaaccattccaggtggatggtctcagaaagggtttagagttcccatccatggtcgcattgaagctatggctccaggagtacgccatcgtgcaccatcgtccataccgtgttgtcaattctgccgcaaataggaggtacactattaaatgtgaaaacccacggtgcaaatggaaggtccatgcaactaagaggtctagtggcacgtggaggatatcacgggtaggtaagaaacatagttgtgctactgccgaaggttcagggagccaccggcagctgacatcaaagttcatagcaaataggttattcaatgccataaaactgcaacctacactctctgcttctgcgttagctttgtatatatttgaggttttccagtatagggtgaagtatggcaaggcttggagggcacgagaggaggctatgaagctcatttacggtgaatggggtgaagcgtatgttcgtttgcccactttgctgcaagccattaagcagaggaatcccagtatgatctaccacatcgatactcatcctgacagggttgtcaacgttgatgttgtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggaaaaagagaattcacgagactggtgctagtttatcgatcttgtccgacgggttgtggttgggccgcatagggaggtttgtattatctcagatcgacatgctggtataatgaatgccatgacgactcctattccaggattgccaccggttcaccaccggtggtgcatgaggcacttcagtgctaatttccacaaggccggtgcggacaagtatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcataagcttccagtgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgttttgataagcagaaaaagacatacgaggtcacagagaggggtggtataacgcgtggcggtgttagattcggcgcaagagccttcaaagttgaaggtgaggggaactcatgttcttgccaaaggccattgctctaccatatgccttgctcacatcttatacacgtttatatgattcatgcaattgatgaggaatctcccaaccgaatgccgtatcagttctcttcaagagccgttgtgaacacatgggcaagtcgctttgagccatacctcgaccccacacagtggccaccgtacgatggtgaagaatttgttgctgacccaaatttgaagattaaaacaagagggaagaggagatcgaaacgattcaagaacgaaatggactcgggtctgggtggttctggaaggaaaccaccttcatgcgttcaacttgatgctgcgccggtgcaaaatgatgctcgttgtgtcaccaggagggtcacaagaaaactaagtgtcctacgcgtccaaaaaagaagaagtccaaaaaaaatataagtgttagggaggtaaatattttgttttcctactcatgctctcgcattcattttcttttaatatatgtcacattggtaactaacggtgaatttattactttttcatgtaggatggccaaggagggacaaccgccgacttacccagccttggaggcgtactacgaggcccgtcatcgcggggctgtgatcgaggcggggagggtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtagatcccgtacctaagggctgccgggttgctcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacaggggcatgccgtgacgggcaggacagagactcctggatggcatgcacaagtgcagcagctgtttggcattccactgaacattgagcaggggcaaggggggaagaagaagcagaatggaatacccttgtcttggctgagtcagaacttctcacatcttgacgacgatgctgagccatagcgtgttgagtgttatgcccgtgcatacatcttgcacttgttgggaggggttctgtttcctgatgctgggggtgacattgcttcggcgatatggattcctttggttgccaaccttggtgatctgggccgtttcagttggggctcagcagtgttggcgtggacatatagacagctctgtgaggcctgttgtcgtcaggcaccatcatccaacatgagtggttgtgtgctattgactcagatgtggatgtggttaagactaccggttggaaggcctaagtggagg

SEQ ID NO: 73819 - DNA, 19313 bp, Oryza sativa
  unsure (1)..(19313): unsure at all n locations
cgatatcgtgctcgggtcaccggtcaagatgtggaaatacgaaatcggattctttgaaccggatgtcataagccaagagacccaaaacaaaagtggtagatatggatgaaaaaaacaattttgttgtagangactttttcagttgaaatcatttattacataaaaatgttatttgaagttgtcataatttgaaaatttaaattttatataggttaatcaaactcaaatggaaaaataaccaaaataagataggtatatctcaataagttatacaactttgtttttgacaattgtttcaaaaaagttcatttattatgataaaattcgattcgaaggttactggccagcccttttgctcatccctctccgagaagtccatttttcctccctcctttcaattaatttcaaaatgttaaaccttcgaatcaaattttatcttactaaatgaacttatgtgaaaaggttgtcagaaacaaagttgtataacttattgagatctaccaattttattttggttatttctccatctgagtttagttgacctatataaaattttaatttcaaattaggacaacttcaaacaacattttcaaataataaacgatttcaactgaaaaagtcatcaacaacaaaattgtataaatcatcaatatctacaacttttgttttggtcattttgctatatgactctgtttcaatgattcgaatttgaatttcaaattatgacaagtgcaaacaacattttcaaatactaaataatttcaactgaaaaagtcatcaacaacaaagttatataaatcatcaatatttacaacttttgttttggtcattttgctatatgactctatttcaataatttgaatttgaatttcaaattataacaacttcaaacaacattttcaaatactaaatgatttcaactgaaaaagtcatcaacaacaaagttgtacaaaccatcaatatctacaacttttattttggtcattttggtatatgactatgtttcaataatttgaatttgaatttcaaattataacaactgcaaacaacattttcaaatactaaatgatttcaactgaataagtcatcaacatcaaagttgtatataactcatcaatatctataatttttattttggtcatttcttcatccgataaagtgatagtaacattgttcataaaatttacatctctcttatatgattttgaagtatttaaatcacgacgaaattgctataacgtcacaggttttgggccggtttaattagcaaaattagagactgtcacggattatgggccttgtatccatagttgcatatccgtgatgatctctaaaaacatcacgaaaattttgtcacggattaaatatattcttgtagtggagattacctttgtttgttgtgtatcccactaatttgttagaggtagacggtagctggtgacaaccctgaatcccgtcctagtaatcctccacgtttgggtacatcatagagctatagcaggaaccatgctggcagaccagtaggggtctgtgcccgaagcaatagataggaaattacctttaacttagcttagataattaaaacatatagaaaatcctttctagcctagccagcctaccaacagttgttatccttggactgccttagccttagatagattagacatgttccctgagttcgatatccttttggggtcaccgaaggtgatgtgctacagcagtattccgtgcgcttgtggatttatctatggtcataagaaataccaacgacaagttcattggcgatgcttttacagtggcggtgcatgctacaactgggatggctcaattggaccttatggccagatttcagtgtcctagtgagcaaggtgaagagcatatgaagtgatcgttggagaggtgctagtaatagcgatggttggagcgcaacactggatttggggcctgagtgtcattggatcaaatgtgtgtgtgctgggagttgttcgtgcaaagacaaatgacgttggtttttctatgcttcctttggacggtgtcggcgagcaaaggaactaaggtcgagagataccgcatctgttgaattggggtggcgaaggattcaattgtaagtggatggaattctaatgaagggtttcaagaattcgggctgctctcaggatcgtcatagtgcggttttgtgaagctaaagcaagatgaaaatacttttgaagcttaatcttctagttttgtgtattcgtgtattcacttcgttgttcctcaatcatgagggttggattctaagtatttctataacttttggttgtgtatatccacttatggatacatatgctagatttcgatctattatctaaaaaatgtctcatcaatcacttctaattcaaatttctccctatcttacccccaaccgtcctcctactattaaccatcccttatttaatttgggggggcatttatgtcatttatttttcatagtattttatcttgtatatattgtagaaatgcacttatttagaaatggatgtagtaaatacatttaatttgcatggaaagtttaaaacgcacacacacttgaggtaacctagtcgaaatgtctaacgactagcaatgtcccctttattttaccataagattgcccatgctttcgatcgttttaattcacaaaacagcattttccttgctccatgaagggacccagactatgctgcttttggggaggaaatggcacgcctccacgtccccaggcttggcatgctgctcctgcaagaacgggtgttttgggctccactgcgtcatgtccaggtggcacacggacaccacctccatagtcgctggttccgcactgccactgacctagctgaccagcaccaccatgtaggccctggtggccgggccagccatgtggcagtagaatactacgtacgggtatgtcatatcatggcaggtcaccatctctgatgactcaccgtcgccactggatccggtggggacgatcctatgcagggctgttatggcatacctcctacgtggctcctcggagacggcagcagcctctaccggcatgttggcagagaaagcctgtacgtgacgtgtcccgaggagggaggaggggagcttgaccaggtcctccatggaggtggcgcatccggctgtattcctgttcttctcaccggtgagcggtagccatgggttgctgtagcatttctctagcacccaccgtatctcatcggcgatggcgagggagactggcacgaacatgttgagaatgttaccaagtcgatcgatggagaacggttaaccatggctaggattagacttttattgggcaagagtaaaattgatgccccatggccaccgccgactcaagtaagttacttggcatccttattgtgtgatattggaaaaacacccacagtaaggtattgggctgagtggaaaccttggcctccacctcaagaaattggcactacacatattcgagtgaatcaatgggcaagtgcaaaattatggaccttcctcacttggacatcccctgttgcagagaaatgggcagctgaactgaaagaaaaaggcataagattggaagatgttgaatttgattggaaaactcttgatccagatgtgcaagaggtcgattacattacatgggtttgcagttaggattcttcgtaggatcgaaacacaaaaactaagccaaccagagggggggtgaatggttggtatacccaaaaaccgaaaacttttagcgaaaataaaagttaccctcgaaatcgatggatcgtggtctgaccgaagtggatgcgccggtctgaccgcctgattaacgtcggtctgacagatgtagatcgatcggtcgaaccgtcgaaatcgcctgccgccgcctgactgcgccgtcggtctgaccgccttagctctgccggtctgaccactgcctattgccggtctgaccgccggtgcgccaccggttggacagccgaaccccggtgaaacacaaatcgaagaactctcaaagtagatgacaacattattgcttctctctctgtttacaaagtgcaccaacagcactccttataaaaatctcgactaaactcgaaaccctaactaaactagcaactcaattgctctcaaaagcgataccggaaaacctcacgctccccccctatttatacatgaggtaggcatcctaaagccacgaaccaaactcatactaagagtcctaaacaccttaggaaacccctctagtacaagacacaaactttacataaccaatcgtaccaaatttggactccttccaaattcgactccgcatcccatacgcacacaatacctccatcgtatgccatatggaatcttcaccaaccacgtgcatcaactctagccttagtatcccgcataatatctgaccaccacggacatcgtcttacctccaagccgactcccggtccatcaccgaaaatactgtctcaaggcatcaagtcacctacacatgaaacaaacaaagaaaccatattccgagaccaagctatccccaacttgactcattgttagcaaacaatagtattacatacgtatagtatccatctagaagccataaccatgaaacaatcacggatatccaaagaaacaacccaaaaccgaaaccgacacagcgtcggccggtcagaccgtgggccggccggtctgaccgcacacatagcaccggtctgaccggcaacatccgctcggtcggaccggacacataaaataacagtgaatccgatcatcacctgaaaattgattatctgcaaaaccacttcgacgataatctccaaatatcaaaaccaataatcacatatgccaattgttcatcacaaattaagaatcaaaacacacattgatcttacaatctcccccttgatgaacacattggcaaacccatcaaaaatgttttggtgtttggaaaaataaaaaaaagcgataaaaagcacacttcgtataaatgtacacattggtctcaaaaatccaaaagaaaacttctccccctttttaaaataaagaaattctcaattgaaccaaaaacattgctcttctcaaaaactcttctcagctcccaaaagtccaattttttttatattccttctcccccttttgacaatgatttcatcaagcataggaattatgttcactaatgtataagagcttagcatacatatagcatatcatgtcatgtgttgcaacaaaaagaagataaacccatctataatataacaagcatgcattaaagtataaccatgaatcaaagattttacaattaagcttgaatcaacaatcgaaattcatgatttcatacaatttataatggaacatcttaacaagcacataggttaaagaataaacactaaacacatatacctattgcatttatcactctttctcaaataaactttagcacaaaataaccaagagaattttttgaactttttcttttcctgagcctgtttgctcatatttttctcttttatttcgggtacgcccctgtcgtcaagactgtttccagggattcggcacctattattttgctcacatcgaatacgtccttgtcgtcaagactgttttcgaggattcggtattcatttttttcatatttttattctctttttcacaatgagcaattaaatctatttgaggaataacaagtcaataaagcatatatatagagcatttataaatcaaaccatatgctagcatcaatattgcacattttcttaattcaagtgaaatttaagtgtcatgcatcatctcccttaaaaacaaaatctaaatctcatgaaaagactagaacacatacaagctatgctagagacaaataaaccttcaaagtattgctagcatgcacaagaaaataccatatgtatagaacaaagctctcttttctcaattttttctcattgtcatattattgcttgataaaaccatgaggtaaaaactcctcctcaaaacatgccaaaaggatttacgaataagcactaactccccctcaaaataacctccaattctctccgaacaaaaatcaagaagaaatcaaagattttgaaaaagacatccaattgccaatgatatcacaaagattctcatgaattgacatgtatacaatagtattaaccaaaactacaacctcaaacactagcatatgaaaagctaataattaagaatgtagaaccaaatatctgtcaatccaaaagtaaattgatgttaccttgaaaagcaatcgtcatcttaaaattgaatactcatggggagtatgacgccaaaatacctatgaacgagaagatatcgaggcctccgtgttggggttagaaataagaaattttggaatccaacactgagtcacacgaccagtagaaccagtgggtacatatgtactgaaaaaatcagaatcagacttaccagaaaacttacctttttgcttcagaaaagtccgatttgaatttcgcacaaatttgccccgaggccggtctgaccgccgcagtgcctgcggtctgaccgggcctggcaaccggtctgaccgccagttcaactgcggtctgaccgctggccggtctgaccgactggtcagtgtcggtctaaccgtggtcctcgaattaaaacccgatttttgccaacgttgtattacaaaagcaatttctctttcctttttctgtttatgggcaagtctaaaacaaaaaccaaccaaatgtccatcttttccaaaaaagaacaagtgtacttctcacgacaagtttgtgaagtaaatggttttgaaattgatggttttgcaacaacataaggttttgcattcacaacatttgatttcgaagaagatccattcaaagaagacatgatgccagcagatttaaacacagtgttcttaggctcagtttcaatcaaaatttcacctctcctagcaacacccaaaacagtaggaggatgtctagtatgatgagcataaggatcaaaacctaaaccatgattgtgtgtgctaaccttagattgatcaagaatcatgttgaggttctttttaccatcagacaatctttgcaacgaacttttcaaataagaaacctcctgagtaagaatagcacaatttttgcaagcatccaaaagacctttttattttctacaagttgagcaagaaagcacctcatcttgtttaacaacctcttccatgtgtttaacacgctctagagcatctttcaactttaactcattcaaaacacactttgaacaatcttgtgaaatcacaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagatgattccaactttttagatttttcaatctcaaattccaattttttgcaattaacagaattgacatctcgcaaagcattaatttcagaaaacaaaacttcacaagatttacattcatcatcattaggaatcaagattttaatctagcaatttcagcatttagaatctcaatagtatgatccttctcatcaagcgcagcatattctaattgatcataactaagcttttcttcattattatcatcagattcatcaacatcagaacatgcattacaagcaataaaagctagatcaataacttgcttacctttgccctcatcttcatcttccggttcatcaaaaacttttatgagttcttggattaaccactgcatgcaatgcttcttcttctccttctccttcatgttcttcttcttgttcacgtcatcatctttgactctctcatcatctaccttcttgcctctcccaagcttagaaaaatgcgagcgaagatgatcaagtgcaccacactcaaaacaacgattcggttctccttttttactgttcctaacatttttcatagctcgagaaaatttgttagataacaaaaccaagtcgtcgtcctcgaactgttcgagttgttcatcggaaatggcattaaataaagcaaaaacagaagacttcgatgaagaagcaccaacatccaaagaagtcgaggaagaaatcaaagcactagacttataatcaactttacgagcaagaatattcatctcatgagtttttagttttgtgtaaagcgaatccaaagtcaaagtagacatatcaacagactcctgaattaatgtaactttcatctcccaaatagacatgtcaagaccattcaaaaagtgaagagaaatctcatattgtgaataattagcatcataagaagaatcaacagatctaagatcactcaaaattttattaaaccgagaaagatagtcatccaaagcttctccaggtttcatctcaaatttaatgtactcctttttgaaaagatcacgatgaagttctttaatattatttgttccttgatgaaaattactcaaagcagtccaaatctcatgagcagtttgaagatgagcaacacgatcataatccgaatgagaaatcccactcaaaagaatattacgagctttgcaattttgttcaaactcagtttttgtagcagcagtattaataacttcaggaattacataaggatgagaaacttttctccaaatatcataatcttcagccataacataagattgcatcctactacaccaatgagaaaaatccattccatcgaaaacatgaggcttagttgaaaacctaacaggagtagccatggcaaaaactctagatcgattaaaatccaaagaagcaaacaaggctctgaaactacttgtaggatcgaaacacaagaactaagccaaccagagggggggtgaatggttgatatacccaaaaaccgaaaacttttagcggaaataaaagttaccctcgaaatcgatggatcgcggtctgaccgaagtagatgcgctggtctgaccgcctgatgaacgtcggtctgaccgatgtagatcgatcggtcgaaccgtcgaaatcgcctgccgctgcctgactgcatcgccggtctaaccgccttagctctgccggtctgaccgccgccttttgccagtctgaccgctggtgcgccgccggttggaccgccgaaccctggtgaaacacaaatcgaagaactctcaaagtagataaaaactttattgcttctctctgtgtttacaaagtgcaccaacagcactccttacaaaaatcttgactaaacttgaaaccctatctaaactatcaactcaattgctctcaaaagcgataccgaaaagcgataccgggaagcctcacgctccccctctatttatacatgaggtaggcagcctaaagccacgaaccaaactcatactaagagtcctaaacaccttaggaaaccctctagtacaagatacaaactttacataaccaatcgtaccaaatttggactccttccaaattcgactccgcatcccatacgtacacaatacctccatcgtatgccatatggaatcttcaccaaccacgtgcatcaactctagccttagtatatatcccgcatgatatctgaccaccacggacatcgtcttatctccaagccgactcccggtctatcaccgcatatactgtctcgaggcatcgagtcacttacacatgaaacaaacaaagaaaccatattccgagaccaagctatccccaacttgactcattattagcaaacaacagtattacatacgtatagtatccatctagaagccataaccatgaaacaatcacggatatccaaagaaacaacccgaaaccgaaaccgacacagcatcggccggtcaaaccacgggccggccggtctgaccgcacacatagcaccggtctgaccggcaacctctgctcggtcggaccggatacataaaataacagtgaatccgatcatcacctgaaaattgattatctccaaaaccacttcaacgataatctccaaatatcaaaaccaataatcacagatgccaattgttcatcacagaataagaatcaatacacacattgatcttacattcttatgcttgcattggtcagaagtgctatgttcagcacatcctatttatgcacaataattggttttctagtggtatgcttgatttgaactctaaacaatacatgtgtagaatgctacttactttacatggcaccaagtcaatgattcactttgcaaataggaaatattttcttcaaggcaaggcattcacaattatggacccaatggaactcatgcaagcccaattagtgcagttagtgtgggatctagatgctcagatggttcagattatcaatttaatacctagatgagggaagaatgcactaaatcatgtgattgtgagatcgtcactgccaaagaacaccatgttgttgatgctacttttctgctgtttggcacggttcaacatcctaaagagaagagctcacaagttctcaatcatgtactacatctgcatggtgatttgttggcttgttggttctctcaaatgggctgatgaagcaatggattttgataaagtgcttcttctcttgcttactgctacatggaaggttaatagttatgcaattccaactagagggactaccgagatggttgtttcttctgtgcaaaattcgtaaggtgttatattcaagctcagtcaaacaggggctgagcatgataacaagctgaacacatttctagctcatgggagtttggcctactcagtaaccaacaattatctaatggaaagtatcaatttatgtactcaagctgcctttttgatttccaaagttcatctcagcaactgcaagctagaggaacaatggtgaatgtttttttgtattttggacatcccgaagaattctcagaactaaaggtgccatgggatctaggagtttattgcattggcttggagacaagccaaaaattaagggaacgggttgttaggagccgatgggcttcctaaggtgcagccgccccacactattgatgcagcccaagaccatgttccatgtaaagcctaagggcctgttcggctgctttgtaccgccgctgtgttgccacagccgaaagaaacaacacactgtgctggttggctgcagcacagtaaaaataatggcagccgaacagagcctaagaagaagagaatataaaagcagcagtactacgggaaggaggagagggagagaatcccaaaacggaagcttggcctggacggtgcgggcgaatggcggcagtggcggcgacttaggtctaggcttggattctcgtcgagtacctgttttcttcttccacctctccatttcctagctactagaacttttctatccacttgtatccttgccatctccatctccaccctccattgttgcagtggatattgtcgtttggaaatattgtgaattgggttgttgacaaaaatttattacaatctaaccagaaagatcaaaaccgtggatttattccctgccaattctttttcatagaactacagcttgaagatgaattagaagtctccttttgctaagcctaagcttacctttgagcttctttcgactttacagaggtaagaggcaaacaatagcacaaatataaagtaagttttgtatttttatcgtagtttaccaaacccaaacgtaagcatgccacagcttactggtaaaagaccacttttccgatcggtcagatccttctccagggtttcaactatcgatataaaaaaaatatcaaaggtaccgataaacaggattatcggaaatatcggaattttatcagcgatacgagaaaaattttggacaaaatttattaaaatttggctgaatttgtgcatgaaatcaagtagattgtatctagatcatttggtataaaaaataacatatgttggcgtagccaggaatttttttctggtagtactatttcagaagttcatattacatataaaaatttttgaacaccgtaaatcatatatagatgtaaaaatttagtaaaaaggcgatacaaacatagaaataatatcatttaacatcaataattggctaatttataacaagcaagttcaaaacgtgcgaatactatcatatagatatttaaaataaaaaagatcttagacatggaaagaaaattacttgccgataccttaatctacgcttattcatagccatgaaagtttttattatgtcttcctcgcctatattgctcaatatatgtgactaagccattttaaaatcacctgatcaacttactaattattttgtgcaagccatttcaaaagctgaaggaaattccctctatttgctagatttatcactttcattatgcccacgaaatgccaatccttgttttcaaagaaatcttacatctaagtataaacctagccttagaactaattttgttctcgtattaaaccttcacaatgacattatcaaggtgcgtctttaaagaaaaatatatttctcttgaacttttgtgtgcacttcatgttttgcaaatccaatatacaaactacaatatagcaaatcagcagaacgttctgatattcacattcactattcactgattcgcaaatcacatattcacattgactgattacaaatcgttaatttacttcacctgagcacaagatttgaagaggggctagtaggaaggcagggatatcaacaagggccagggtactaggggacccgggctcttagcgtggctgcccgacaccatgggggggacacgaattgggtggggagccgcacttgcccacgccgaggcgccgctcagctctacccaccgtgaatcgatgcatgcagagagtggcggtgtctagacggcgacgtgacgagaaaaggaaccacagcggcggaggcggcgcggcggaagcggcgcggcgaggcgagaaacggtagctacggcacggcgaggcgagaaacggcagcgacggcgtggctgaggtgaggaacggcggcacaacgaaaagaggagacggggagtggacagaagggaagaacggcggcgtcacgggttgtttctctcacgcgtgcaaagaaccacgtagcaatggtcaaacattggtacggaaagatagggtttgtcttttttttgggacggaggggagggagtatgtagtctgtaaataaccagtactctctgagtgcaaagcatcatataagcaatcgaagagcacaatatcaagcatgcatggcgacgggagggaggagaggccgcgctgtgccgctgtccaagagcttctcgaggaggctaaggcacggccgcacgggttttggaggaagcggacacgcgagggggatgatgcagctccatgtggcgtccgcgccatccagatgtatggcgacggcggcggcagttctcgcctctcaactctcgaacaacaggacaaggcggcgcactggggctcaatgaatggcgacggcggcggcagatagatgcatggcgacggcgccggccggcggcatatcgatgtatggccacgtcggcggcagctctcgtctcgcctctttctcgactctcgaacaggaggaggcggcgcacggggttgggagtggatggggtcacgggattggaacttggaagtgggctctaggactttgactgggctagggcgcgtccgcgcgtgggccaaaattttgggaggctgtggaccgggaaaagaaaaagtacaccaaaggtccctcaacttgccatcgggatacaaaagcgtcctcgaatcgcaaaaccagatatatggggtcccttaattatacaaaactggtcaaaatagatccctcggcggccctcggcggttttgatgcaggttttgccctacgtgtctgcttagacccacgtgggccccacatgtcagcctatccagtcagcctctctttctttcccctcttctctcccttccccttctctctctcactcttctctctgggggctctgggcaggccggcgctgctggccgacaggtggggaagagaccgatggtgcgaggtgggagaggaggtccggcggccggcgatatggcggcagtgatgacggagacgacgcgggagcaggggagcaaggcggcggcggcggcggcgagatgtccatggtgaggtactggaggcggagctccgtcggggcggggagcgggtcgacggcggtggatggcgggcacgggatagcgtcgcggcccaacgccggcgccagcgccggcatcgcccgcccgcgcgcgatctcccccaccgccgtcatgaactgcaacgcgccgagggccgagggccaatgcggcggcgacggcgtcaccgatggctgccatcgaggcggttcgggagaggcagcagaggaaggggagatcgaggatgacggcgccgtatcggcgggcgtggcacagcagtcggtgtgctacgacggcgacaagcagtggacggtgtcagtgttgtgggggttcgcggtggtggtgacgcgcggggtgctgtcgccgcggagatggagatgcccatgcgcacgttcctcaattggtaccgctgtgccgactacacggcgtacgtcttcaacacgcggcccctggcgtgccaaccatgccaaatgccgcaggtgtactacatgcggcagtcccgcctcgaccgccgccgcaacaccaccgtcaccgagtacgagcgccaccgcgtcgcgcccgtcaattgcggctggcgcatccctgaccttgccactctgctcgaccgcgtcatcgtcctcaagaagcccgaccctgacctctggaaaagggtaatcaaacacacaccgtagttaaaaaactgaattgatttgtacaacaaaaaaccttgatttttttaatgttgctcttaaaccgacgcgcgtgcagtctccaaggaggaattgctgcagggtgatgtcgtcacccaagcaagggaaggaccggaagatgaccaacgatgttggcgtctgcagagcgggaggtcaaagtgagtgtgtgagccgggaggccgctgggcgccggccggacgcgccgaagcgggacggagagggcgtggccgcgcgggcgccggcatggcgcgcgaaggcagcaggaggcgcgcgctgccgccacctgcacgcccgcaccgttcccgcctcgctaccgcctccccgggcccatctttggccgccgaggagctccgccgggccgccgccggggtctccgtcctcgacctcgcccacgtggcgacgccctcccctcccttatcaccggcgacgccgacgccctccctttttccccgtcgcggcccccgccactgccgccgctgccagccatcgccgtggacgtgctaaccccgcctcgccgtggtgccatggacgcgctaccgccgccgctgccgacgcgctaccgcctgggtgtgtgactgtgtgtagaagagaggaagagaggaggaagggggaggctgacatggattgcctgacatgtggggtctacgtgggtcccacgctgactcagccgccacatcggacaaaaccggggtcaaaaccaccgagggacctaaagcgaatggttttattagttgagggatgtctggtatctggttttgcgattgggggacgattttgtatctcgatgacaagttgagggaccttgggtgtactttttccgccggaaaaatgccgcggcaaattcaaaaggggccgaaatttttggccaatactgttttcttgggtgcccaccgataaacccgattttcagaaattctggaccctgtttcggcgaaattttgaaccctgtccttctccaccttccccaagctgcaacgcaccccgaccacctcctccacgaagcccgtggccgccggagcgccatcctcgccatcgtcccatgtcagccgccaccatctcgtcgccatcgcaagcttccgccgccgcctctcccgtcacccacgcttgatgagcaccagaatccttttcctctttccctctgtcacatgtcgtgcatgctgctgcatcgaacagtcaccgccggaccgtgcgctgccactccccagccggttggctagtgagccctcgcccctttgttgtggtcgtccgatcaccgtcacatcggtgctgcatgggttccgcgtcggcgccacatgtgcaccatgtggtgcgctcgcccggccacgtgtgtccgtccctcttagacagcgatgcgtgggacgcgcctgtcggcgccacgtgcgcaccatgtggtgcgcccgcccggccacatgtgcccgtccctcttagacaacgatgcgtcggacgcgcctgtcggtgtaaggttttccccccccccccttggctggcatcataaatcaagtttattgcgcaataaatcatatttaacttagttaaatatgatttaatgaagtataactacagtgtaactgcactgtaactaattacagtataatttctatataagttaggtataaagttgcatatattattttaataattatatacaaattatattttagttatagtggattatattacaattatagggggtgtttagatctaggggtgtaaagttttgacgtgccacatcaaatattatatagggtgtcgcatagagtgttcgggcactataaaaaaaaactaattacagaatccatcagtaaaccgcgagatgaatttattaagcctaattaatttgttattaacaaatatttactgtagcaccaaattatcaaatcatagagtaattaggcttaaaagatccgtctcgcaaattagtcctaatacgtgcaattagttatttttttaagcctatatttaatacttcatgcaggtgttcaaacgttcgatatgacaaggtaaaaaattttagggtgagatctaaacagggccatagttagatttgaaatttttttattaaaaacttactacagttttttagatagtctgttaaataaaagcacttgtgtatgtacccatattgaagacacaatatccatattaattatgaacatgcacacgcacaaatatgcagcacacatgtggttcacacgatgacaaactgaattattcactttttacatactatataagtagatagctcgatcgaccgttgctgcaaattacgcacaaaccacgccaaattgttcactttaggttgtagagcttgtttacatcatcgatgatgattaagctgctgcgcgtgggcccccctgctcgtggcgtgggacccagacgatgctgagcttggtgaggaagtggcacacggacacctcccccggcttgacgccgtgcgccacgaagaacgggttgtccgccctccaccgcgacgtgtccaggtggcacacggcgagcgcctccatcttcgccggcgaggccgcctcgccttcgccgtcgccgtccccggtggtcgccgccaccagcgtcaccgcgtacgcggcggtcggcttggtactgtggcagtagaacacggcgtacgggtacgtcaggtcgtggcacgccacgacggcagccggcgccggctccgacgacgacgacgaaccggaaccagccatcgccgagagctcccgcacggacgtcacgttgtacctcccgcgccgcgccggcgtggtcgcggcgtcggtgggaaggtcggcggcggagaacgcgcggacgtcgcgcgtcccgaggagcgacgcggcgaggtcggcgagcgactcgagggaggtggcgcagccggccttctcgcccgggagcagcgccgccgcccgctggccgcaggtgtcgagcgcccaccgtatctcgcgcgccatggcgagggacgccggcgcgaacatggcgaggacgtcggcaaagcggtcggcggagaacgggatggcgtcggcgacgtggcgagggaggaaggccggcagcgaggtcgtcggcgggatggtcggcgtgatgacggagcccggccgaagggcgtcgcgaaagaagaagacgtcggccagttgctgcatcttgttgccgtgtgcgtgaacatggcgtccatgatccattcctgcgaatgaaccaacaacgtagaatagctagaggtatgtatatcgcctcaaagagtttgagaaagaactggcagtacaacttgtgagataaattttggtagttccgttaaggaaatgcatttcttaagtggttaagaggtaaaaatttgaaattcaaagatagctacattttaacatggaaagagtatgtattaagatctgccaatgcttgaaatttctagaccggtgaaccatgtttattttagggtgaatatgatccctatagtttcgcttcgagctcagtttagtccttgaggtttcaaatcgttcaaataagtctttcaaattaatcatttgggttaatatagtccttggacccacaaaaggtgctacgtgagcatgccaagtcatcctcgcatgcagcgaacagcggtatgaataaaataatcattctatccttatataccatatagaaaagaaagaaaaaaaaagaaaattaatgtttcacacatgtatgtatatgtctcagagagtttgaaaaagaattgaaagtataacttgtgagataaattttggtagctcccttaggccttgattggttaatccctgtgagggacggattgggggagatttattccacacatattgtggtgtggaattattcctcctcaatcccctccaatcctctttaatcccctctaaaccgaataagatcttaaggaaatgcatttcttaagtggttaagaggtaaaaatttgaaatacaaagatagatatatattttgacaaggaaagagtatatattaagatccgccaatggttgaaatttctagattggtgaaccatgtttattttattattattacaattatccactttgtatctttgagttacaagcatagtgaactatatatatatatatatatatatatatatatatatatatatatatatatatatatatatcatatatcgataggctatacaagattaagaaagtcatcaaaatgagaaattttacactcctggatgatggagagaggtgacaaatatatttttaacataaaatttagtgtctcttggtaaccgagatatgtgatagcatcgctctatcaaaatgtgcgtgcttagacaattttaagggaaacacaaaaggttgaaaggaaaacaacttacagtatgaataccctaattgcttttctagacgcattcataagttatatgaaagtataacagacaaacttgctattttcaaatattctcaccttcgaatgtgtgttgataattcttatgtgcgaatctcgtagggaacatattgcttagatttacttcatgggcatatgacacttgaaactttttgagttcctctatacgtgacagctatgtacaga

SEQ ID NO: 73820 - DNA, 20236 bp, Oryza sativa
cttagatctcatagttattgctgacgttgcatataataaataattctgaatttctaatgtcaatggttgataatcgtaatatggatgacatcgtgaatgagaaaaatcttgtcagtctgatatttcgcatgctccagaagatgctaaataatccaacttttcatgaaaacgccacgagttgaaaattattttaggcgtgcacgccttccttttgttcactgtcagaagcaacaagtgacaaataagttcatacaagatctgtccatttttcttgttgaaaataggagaaaggacgtaccatgtctcgttcattgctgcggaatttggcgtgttcgttttccaatagtttttcagtcaaagtatgtcccatggaggcattatttatctttgacaaaattcaagttcatttctctatcaaccgaaaggacagaaaaaaagttgctccagctgggagttctctgtttacaaggtcttcacaaatcttcaacaaaattctctgcttaaatttatcaacaaaatagcaatctctgttttgaaaaagttgcactagatgcaatagtaggagttagaagtcccattttgcagtaaaaaaaatcatgaatttcttaggttgcatctaagcatgggcggcctgaaatgtttgtgcaggcaaagagatgggcatcactgacttcatcaactcgaaggcatctggcaagcctgtccacgaggtacaaataatttggccgcttacataaccacactgaacttcgttttcctatgttggcaatttaaacatttttcaaaacattgtcctgatattttatatttaggttatcatggagatgacagatggcggtgtcgactacagcttcgagtgcaccggcatcaccgatgttctacgggaggccttcgtttccacacatgatgtaagcggtgaaaatatccggtgtttttaccgctctttgaaaaactatacaaatagttatgaaaaaatttgcgttgtttcattaaaactaaacctgtattctgaatgaaatggaattcagggatggggcctgaccgttgtgctggggatccatgcaacgcccaggatgctgccgctgcatccaatggagttatttgacggccgtcggatcactggctgcgtttttggtgacttcaagggaaagtcccagctgcctgaaatcgtggagaagtgcatgcagggtgtaagtaccgaaattgttttgaccaatttcattgagtcagattaatgcaaatgtttaatggatggtaattttgattctgtaacaggagattaacataaattttgatgggttcataacacaagagttgcccttcgccgacatcaacaaagctttccagctgctggaagaggggaagtcactcagatgtctgctccatgtctgatgaaacttgtggattgtaaatttgaatacacaataaatgaatcataaatgttttcgcggtttcaaggtgtataattttcatatgcatgtatgttttgtacataaaatgggttgaacttcgttaaagaaaagacaaattgttaattagtagaatgcagtattaatatttgtaacaggtgagtgtgggtgtgcagtcgcgagaattgagcacacgattggttacatacatgctcgagttgctagtcagtagggccacacaccatttttatctattacatacgagttacagtctaattttattatagttacatataaatgttctctaccaaaaaaactgtctgaatgttgatatttgtaatagagttagcacaggtttcttctgtatactattatcatggtttcctacacaataattgtaaaatgttcttttgaatttagggatctccattgcttgtgtccgttttacatttgcaaagatctcaaatatggatgagaactttcaaaccgaacaacaatttcagtttgaaagaaataaaacatgtagtagtagaaattacaatacagcgtccaattgcagaaacgattccaaagtgcacagagcgtctgtgcacataggccggtttaggccgctagcgctacactgtcaactgcagcttgggcctcctagggctgggccttcgtacttttctgatcttagactgttggaagaagtccactttaagtccctcaaataagggtatggtttaaatctcatcctccaaccgtaaaatcaaatatatttcataccttcaatttttaaaactagtataaataaattgagtcattattcgatagttttgaatggcagtattgatcgacatggtgcttacatgatgtattgatccgaacatcattgtaagtggcacttattttgggatgagtctataggtcgggcgtccgatcggtttggagaaaaatcggacactgacgtcagcataacgtcaacgcccgatttatatgcaaaactattttaaactgatttttctcttaaattacttatccaaatcatgatccgattgcaccattaaattcgttgcaattaaatcttcaaaacaggaccacatatggatatattccgatgaaatttttttagcttattattgagttatttttaaatattgcatgatgttccaccaggtatatcggaattgtttcactaagtagatcgaaaatgtttcacttgtttaaatcgggtgttgtttcaccttatataaaaacaatgttttagcaaataggaaaaaaatgtttcagttcaatgcaacatttgatccatacatagtgaaatattttttggtggaacaaaaaataaaacgaattcccttaatagggggtttccaaaatatgtgggttttttttgttgcaatggaatatttcagttcattgcaacattagatctatacatagtgaaacattatgagtacactaggtgaaacatttttagtggaacaaaaaataaaccaaattatcttaatagagggtttctaaaatatgtgggttatttgttgcaatggaatatctggtggagacacgtggcaggtgggaacagagatcttggtggggcctaggatactgcatgcacgtgcgtgggaggcggggccatggggggagcgcccaattttttgcaacccccgtcggtcgaccgacgaagagcattatcgcttattttgtgcaaaaataaaattgagaccgacgtgtcattagtatttccttctttgtcccccataagtggtgaagcaggatctagacatgggggactaacttatgaggtactacctccatatgttaatgtatgacgctgttgttttttttttaacgtttgaccattcgttttattcaaaaaaaattatatgattgttagttattttattgtgacttgattcattatcaaatgttctttaaacttgacataaatatttttatatttatataaattttttaaataaaacgaatggtcaaacgttggtcacaaagtcaactgcgtcatgcattaaaatacgaagggagtattacttaaataaatatatcaagacaatccacaaaaatttaggactgattgtgtattagagtaatttttttcttgtgcaactttcacgatgttggcatgatatttttagaataaggtagcaatatttctatacgtatctcttctttcttctttctatatatagttggtacccactagctataaagctgctctgaggatgagccacgtcaccctaattagctgagaccgttagatcttaaatcaacgcttcaagactgcacatggcaccaccatctacaccaattaggcccatgtaagcaggttcacctaaacagccttccactttcccgtcgttggcccactgttattaaaatccagcacgtttgaatctctactttgcatcatcaaaaccacttgaaagagcaattacaacaaaaaaaaacccgtcatcactgacatgaagatcaaaggtcgtccttaattccatttattgatccccaatctcctcctaagcttctctcaattcatcattaccgtccacctcgacggatgcaatacgtagattaccaatctattaagtctgtcctaaaataattttagtgggcctcatactaactcctatgataattatgttcatgcacatatcgttgctttaatttgccttcctaacattcgtcttaatcaagtttatgccttaattagcactaccaataaaatgaaccgttacacatattcatcgattgaaattttttccgtgacttctcctttcatcttcccttttgatgtccccatttatatttctgtccataacatataaaatgtcttagccatcccagaacaattcatcgtgaaaccttttgctagccagcaatgcaatagctggtgaccttttctactttgttttcgcgatgtattgttctttctactaaattaagttaccatcacaggcttcaaatgtattgttctttctactaaagttaccatcacaggcttcaaatcactgatggttttgttgatatcattcgctcactgccaattaatgccaggctaccgtgtttgctcctcatatggtgcgtaaattatggttacaactccattcaaatactcatgctactgttttgtcccctcctcatgtgttctttgtttctttcctctcaccatgatatgacacacttaaatttttctaatgcattactctttctagcattcttcatatgcttattcactactaccaataaaatgaattttttagttatttatcgagtattaattataattcctattttttctaaaaggcttgaaaggcctaagtttataagcattgaagtgatgaatttcatcaatcttcctttctaatgatctggcccaaaccaacagcacttggaaacatgaatttttctaagttttttgaaaaagttgaaagatgtatttaaatcaagttgcatctaacgctgaagtgatgcacaaattttagaacaatatatatttacgtatatatataagcagtcaaatgcatcttgcacctaacattttctatttatcatagagaaagtcccgcagcaacgcgcgcggagtctctcactagtatagcagatgagctaggcataaaacaacaatccgttttcccctcttcatcatagtctattatattggcaggcaaaagttctagaatttccatggtttttctttcacacatttaatttagaaattcgtaaaaaacgtagtaactactacctccgtttaggttataagactttgcccacattcatatagatgttaatgaatctagatacacatatatatatttctagattcattgacatatatataaataaatatgggtaatgctagaaattaagtcctataatataaaatataaaatagaggaagtatatacgtctcaatctcatcatcactaacgctgcatgataatcatcgttggagggggccgggccgcttcgcccctgctgtctcccatctcctatctctgtcggtgacggtggcagaggttgcggaggagaagcgcgcggacatgctgaggcagatgaccaccccgggcagaatctcctcgttgctcgatcgcctccggccgctgcatcagccagcccccgcacccgtatctttaccgaggccatcaagtgctctctaacatcatgctcttcatcaattatacagtatatatcgctgcatcacctgaagctagaaaacgaagctgaagcagcagtcagcagagatgaagtactcgctcacctgaagctgaggctgagcccgtaggacagagagcgaattgaagaagcgagcacgagaatggaggaaaggaaaagaaaggaaaggaagaagtaggaattgcacgagaagcccaagcaacaagaattgaaattgaagtgcctagtaaataggaattgcatttgctcaaaaggaatgcatatttatgcatttagattgaaccaatccatttccatataagacagcctagtgctatgctaaagtagtacaaataaataaataaagggaatatatccatacatacacaaaaaaaagggattaagtgctgacctagttgtgttgcttaactaaacacaataaatttgaatctttaaaatctggcctccttatttgttcgacctacacaaaggggaccaaccgattagctcaccaacatactatcacaaaaatgttcaggataagtaagaacttaactgggtttgcaagataaacactggtcattgattcatggcgtaagtcaagaagtaattaacatattttttatttagaacccacaatcgataaactgtgaaatggaagagaaaaaattatgcattccctgtaaaatcaaaggtgtttttgattattattctgtgatgaactaaaatcaaatgtgtttttgattattattctgtgatgaacaattggtgtcggagattattggttttgttatttggaatttattcacgaagtggtttcggagatgattggatttacaagtgaattacaggtactgttattttatgtgaccggtcagaccgggcatgtgctgccggtcagaccggcgtgtattgcgcggtcagaccggtgcaacctgtggtctgaccggccgactctgtgtcggtttcggtttcgggttgtttgtttggatgtccgtaattatttcatgattatggcttctagatggatactatacgtatgtaatactgttgtttgctactaatgagtcaagttggagataggttggtctcggaatatggtttctttgtttatttcatgtgtaggtgactcaatgcctcgggagagtatttgcggtgatggaccgggagtcagcttggggataagacgacgtccgtggtggtcagagatcatgtgggatacttaggctagagttgatgcacgtggttgatggagattccatatggcacacgatggaggtattgtgtgcgtatgggatgcggagtcgaatttggaaggagtccaaatttggtatgattggttatgcaaagtttgtgtcttgtactagagagtttcctaaggtgtttaggactcctagtatgagtttggttcgtggctttaagctgcctacctttgtataaatagagggggagcgtgaggcttcccggtatcgctttagagagcaattgagttgagttttgagtttagtcgaaattttttgtaaggagtgctgttggtgcactttgtaaacatagagagaatcaataaagtcgtcatctactttaagagttcttcgatttgtgtttaccgggtttcggcggtctaaccggcgatctaccggcggtcagaccggcgggaacacggcagtcagacctgcggcggcgacaggcgcggcaggtgacatcgatggtcagaccggagattcaacaccggtcagaccggcggctacgcttcggtcagaccggctaatctactccggtcagactgatctccatcgatttcgagggtaacttttatttccgctaaaagtttttggtttttgggtataccaaccattcatcctccttctggttggcttagttcttgtgtttcgattctacgctccccatactcttggcctcttcggatcaaatggcgttggctctgttcagctacatgcatatgattagtgaaaaatctggaagaattaagagagattttggaggagaataaatggcattaaccatggcccatggcctctcatctccttattcttagcgacggtttcttaggctgctaccatcgtatatttctacagagggaggtttttgcactgttcgatatctcacccggagatcttctcatccaatgttcatatgcgatctcatccactgatcaaacagctgataattaatgatgacgtggaacactgaggtttcagctttgggtcccaactttacagaaagaagggattggcatattacaaacttcatgtctaaatacttggactgcacactaagaatatgaactgtgcataaagcagtggtgataactaatacggctgaattatgcattctttgtcctcatgtttcctgatgctgcatgcacttcgtgatcaccgatcaactgctttcctgagcaattgaaccccagattctagactgaccaaatgggggtagtactataaacatgtgtacatcgcctggtcttattccttcccctgccttgcagcaacaagattggaataatcttaaccagctgctgctgcaaattcctttacaaaagcaactaactcacaaacctctttaattattccaagtggtgcatggcccaagcaaaggtgatcacctcctcctcacacagtttaacattctgcagtccgtaagacctataaaaaggccccttctataacacagctaagcccacacaagatcaagagctggtagtagtactcttaccctcttgcattagccttttccttcatcatacaatttatcttgagaaatcaagctgtacctccacaagttgacatgtcgacggtgacctcgtgcaccttcctgagcatccgccccacggtgagctctgctggcagtctcttatccaagaaaccggcagcgtttgtttcccttgcgtcggagaggaaatctaggcctctttcgccgtgcttcgcaattagctccaacaaaccaggggacccaaaaatagatgtgtcgccattcagcatttcacccgttggtgagttatttgtcacattgtcattgcaccatgaatggcacacttttatttatttatgcctttcgaaagaattacgtttacacactatataccattacttcctatgtctgcaaatataatatatgtttagtttttgtgttatgaggtttataaagttattggaatgcatggtattttctcaccctgaaaaaacttaatgccgttatgacatggaatgatcttcaaggacaatattcaaatagttatttctgataaatcggcagaaaacatttagtaagaattatcactagtttatttatttgaagtgatatctgtagtcttattacaacaaaaaaaatgtgttataagtttccctcaatagtttaccttgttgggttgaatatgattttttaaattaaagaaaatatgtattttagactatgttttaagatacttaaaacaaaaaaagctaagatatggaggcataaaaatacaaatatctaataagaactgcaactaagaacccataaaaattggaactgctgttttaggctaggatgcatggcactattgtgtaagtttggattcatggccaactcatagatgtattaattagaaagtccattaaccagttcacaaatcaattaatgacaaaactatatatatttgctgtaaacaacacatacgcaacacatgaagggaaaaaagggaatgaattatccattaatttggttatttgatttccaaatgcatgtgaagttctggtgaacccggtgccggtggacggcgagcggtggcaggtggcggagaacaaagatgaagtgagcctgtggttcgacgtgccggggctttctccggcagatctgatcgtcgagatcgacgaggacgtgctcgtcatcaagaagaagaagaaggcgagcccaaagagcaactacaatactcctacttccggtgccattgcagatcatcaggaggccaccgccgacgagttcagcggcggcgggatctacgcgcggctgctcctcccggcggggtacagtagagagggtgtccaggcaaagctcacctccggcgagctgaagctcaccattggcaaggtcaaggagagtgtccgcaggaagatcaatgtcgatatctctgtcaagtagaattcagtgagcttccatggaattcatatatggtcatctgtgatgaaggatcggagcaacggtgcaagttatatcttgcctaagattctagctcatatatatcaataactggtccatgatctgatctctctctctctatgtatacatcctttgctgttttcctaaggttgagtatgcttatgtatgcaagctttattccggctgcatccaaataaataaaatgatcatctttgttgtgctttcacttgtgcctgcatgcatgtgtgatgtattccctggtagatattctaaaaaaaaaattctatgaacatctctggtatacatctccttagaataactactctacacccccctctcccataggtcaatcccatcgcccccacccttcctagggtccaaatccccccttccacctcagtcaaagaatagtcaaagcctcctcccgctggtcaaacccgagacaaacccgcccattgactccctcccccgcctaccactttgtgttacgtctcgcaggaattccgcagtaacataacggtcatcgtttagtaacaggacaactttctcgtagtaacaacatcgaaaaatagtcatgatagatctagttttgttaagcactttttttcaaacatcatggtgcagatggattagaaaaattatatataacatgagagatattgctctctaaagattgaggtttactttttttaagttctcgtctcgctggaacggcgtagtaacgcgacggccaatgtgtagtaacacgactactttctacagtaacagcgttataaaatagtcatggtggatctagtttcgttaagtattttttgtctcaatcattgtgtagtaacaggactattgtctcgttgtaatgtcgttttaaagcattatggtgaaagcgattctaaaaataatatgcgatgtgagagatattattggttaaagattagaattccaaaagtatacttatactaagcttgctattatgtatctttgtatggacaaagagaagtactttttaacacttgtatttttcataagattgagatttaaaaatttagctatacacaagtagtggtactatagtattaccgttaatatcatatgttctctgttactacaatttcatctcaatgctactgcaaaacgtacagtaacgacctataaatttcacagtaatgacctatacatttcacagtaacatatcgtgttactgcacttctgcgataatgttactaccgaatcatagtaaaaaagtatgattcctacagtaacataacgggtttgtgttcacaaaatttgaacaaatatataaagaaagcaaacaatgatctcaaatcacatagtgtcatagaggtgaataggttagtagagtttgttatgaaccatgagatcatgggttctagtcttgaattcatcaatttatttttaatttttctataaaatagaagggaaaatggttctagtcttgaattcatcaatttatttttaatttttctataaaatagaaggaaaaatggcagatgggagagaaaaaacgaataaaagaaaaaagaaagtagaggagtgcgctaggagaagaaaaagcgaataaaagaaaaaaaagtagaggagtgcgccaggagaagaaaaggcgaaaaaaaaagagggaggaggggggcaatggagagagagagatcggggaggaggaggaggagtaggggaaggcggggccgtgcccgggagggcgggatgggcttagtagttgggctgggaaggaggggtgggggtgtagaatatatatatccgtggagccccccccccccccccgcgccccagctccatgcccttttgctgcggccgccgcaggtaacgccatccaacgagctccatgcctctcccctacagcccagtcaggtgcttgagactgatccctcataccataagcttcatgaggagagctgcggtggagctccgctgtctaagctcgagctccactggcctccgcatttgcctcagcctaattctagactggaaaaggcagcagacaatggcaaccaagcggtgaagatggtgcagctttgagcaagctcgagttggatgcggagatgacacggacaatgacaaactcgaagtggtggaggcccagcggcctcggctcttccatcgagcttgtcgtgggctcgaggcctcgccaccggcactcatcttcttcgaccttggcaagggggcggcaggtgctgggtctagggtggtggcggagctagggacagtagaggccttgtggaggagagaatcgaagagccgcaccttggtctcgtactctcgtagatgttggggaggagagactcccaaatttcaaccagccgccactagacccagatgcagtggggtttgtccacgtccatcaatccttgatagagcttgttggtgaaccttcttttctgtgctcgatgacccctcttctctaacctcgccactcatcgctagtccccctcttctctgacctcagccaatggggcaggctctgcgtcgagctagccgccaacctcgtgcttctcccgagcacgacaaagggggtgagctccgcatcaatctcgacgccgaccttgtcatggccgccgccccctcttctctcaagcatgcgagatctccatggccgcctcaagctcggcgagggtgaaggaggaagaaaacaccatgacaggcagggaccgctgacatggcatcctggggtgtaccaaaaccagggtaaaaaccactctggggtgtaaagtgaatgttattgaaagtcatagtatgtgaaatatccaattttagagttttgggtgtattttagacaaaacgaagaattgaagggtgtaaaatggacttatccctatttataacaaggtgcaatttctttcgcacttattgtggcacattgcatatatggacattacattgatgagtttacgagttagcctaatatcaaaagattattccaagtcatctaaggacaatcatattttggtttattgtgaactactaaatgccttttcttttgttcgccctttctttttcagcatatcatttcaaaaccgtaatctgtgtaataccatcctgcagtaagacgtgggaccggcatcatctagttagatacatataacacttccacctagacattactcaggtatctaaatagaaattctagtgttggctactttagatatgttgaaacttgatttatttttgcacaacttaatttcaactatatataaagatagaacttaattaattaacttggtcaagacaacttcgtgctagttaattaagttaacttggtcaagacaacttcgtggcaactataattaaggaataagccaaacggacatatttgctaacgaaaaataatttgtgaataaaacttttatatacgtatttttagagatctaaaagaaaatgctggaaaataaacttcaatgaaaaaaccccaaaatcaacttgaaatttaagattgaaaatttaaattttagctggtaagcataagcatatgtgaagagatgaggctagtagtttctctgtggggccgattgcattatattgccattagggcgcttgtgttatttgtcagtttaccatctcagttttcttattttcacagattccactggttttcttctagtgttgtcagttgtcaaaatgccactacgattccagtttcaacgccattaacaagggaacaatcttcgactgtatccgtgaccaaaaatacccctcaacaaaatattataaaagttttaaaaaaacattatcctatttgagttgtgaaacttgaagccggataagaggaaaacaaacagaaataagtattttgggagcccatgaattgtggaatcatcgagatgcactctcgagatctgataaacattaatttggttttggattaattggttcatcatgaccattacgacaattagtacctcagttttttaatcgagttacaatttcgactactaacgcagcatgatgatgagtagcatctcctcctcgtgaagaaaggaaaaagagtaaaagaaaaaaggagaaaaaaagaaacactcatggccgacactgatagaacacgtcaaactgttgctcgtacgtactacaaggcacagataatgcagcatccactgatccaccggagaataatgctttacgtaccaaagcagcttcccggcctggtatctacagcccttcgatctgaatttttcctctctttaattataccctgctaacccgaccaagcaaagtgcccaaaatgaccaacacttcagtcctagctgcttttcctttctctctatatataaactctcgcttattagcttccctgtactcagtattaatcagcaacaaatggcttcagatcactagaccagagtgaagagagaaggcatgtactacagctaacccattatacatttcgatctcctcctatacatatgatgatatatatatttgattcttgacttgttaattacttttctttctatgctatagcgcgtgtgtgttgattgtcgtaatgtcgatggttgtggcctcttacgctccggcgagccggtcgccggtgacgcgggcgtcctccggcgcacggcgggttagccatacacagtcatggaggccgccgccgccgccgttcttcccggcttccgccgccgtcaagtgcaggcggcctactcttccggtggcacgttctgttggcccgccggagaaacatcgccctgtgctcaacattcctcccaccggtagtgactctccttcaattcacttctctgtttttttttgttcttctcagctttgattttctcttttctaactgtggctaatatacctagaaatcaaaatgaattcaacaaattaattgcaataaaacttaaggcccctttgattcaaagaaaatttataggaattttagaggattttatttctataagaacttttcctacatagccctttagccctttgaatcaaagaaattgatcctatggaatcctatgaaattcctatgtaatgtgtcttcttattcaaattttggagaaaatttaacatgaggtagaacctcatggaaaaaaatatttgagtctttatctctcctcaagttctcatattttcatgcagttcaatcaaacggttattcctaattaagtttttcgtgtgttttgtatttctctgttttacactattcctgtcagaattctatatttttcctattacttcgtttttttcattccagtgattcaaaggggtttttaatgtgataatatgtgatccaattcagctctactgtaccaagtcccgccaccggaggggaaagaacggtgggaaatcaaggatgacgagggcaacgtccagctgtggttgcaggtgcccggcctgacggaggacgacctggagatcaccaccaccgacgaattgctcgagatcaagcgtaaggccggtcgcggcgacccgcggcggctcgacgacgtccaaggcgttggctccttccatctccggttgctcctgaccaaggagtttgtcagcagccaggtgacagccgagctgaaggccggcatgctggaggtgaccatccccaagaacacaaacctgcgtcgcaccgtagtcaggatagggcagcaatcacagtctccagctgcagttagaactgcgcagccgaaggtcgtcgatcctcctcctgccaattcgccaccgaagaataataatcttgtgagaaacacaagtgtgcagtcgaggattgatcctcctgcgagagagtcgccgaagaatgatcttggagtaggtatcagtgttcaaccgaatgattctcctgcgagagagccacccaagaacaatcttgccggaggtagaaatgtgccaacgaaggatgatcctcctgcaagggagctaccgaagaataatttggccggaggtagaaatgtgccaccgaaggatgatcctcctgcgagagaaccaccaaagaataatcttgccggaggtagaaatgtggcacccaaggatgatcctcctgccaatgaggcaccaaggaataatcttgcaggaggtacaggtgtgccgacgaaggatcctcctagaaatgccaatgagccgccaaagaatcctcctggtacccgtgaagccaacctaggatgagcaaattaaccgtggtgggcatgtgagaataaagattagaatagattaaaccccatgagaggagagaagatatgtttatgtacatggttgtcatgctcagaggggcaattttcactgcacgcagttggttcactttaatttttatgaaataaagttatttgatcgatatgatttgctatggtcgaccatttaccgtttcagtgatggtgtaatgtcccagatatccacataataaccgttagagtgcgcaacctggcccaccaccgtgggccacccaagtcacattgggtctgctgctccactatatgcccaaccggagccataactttaggtcctgggcctacacaacccaaaagactagtctgataggtgagaaccgcccccaccttttaagtcgtgctcctccatcatcaattaccgatgtgggactaaacccaacaataactatagtgcaagaatatcaaaattcaaacatgaaaaccctgctaagatgaagaagagaaaatgacatagggcaaatgagtaggggtcccggagacaatccagatttacggaatcgaagagtggctcattgagtcatacgatctccatcgtgtaaaatcaaagtgtttttcattctttattttgtgatgaacaattggcatctgtgattattggttttgatattggagattattggcgaagtggttttggagatgattgatttttcaggtgatgaacagggttactgtttttgttgggtccggttaaactgggcaggtgctgccagtcagaccggcatgtatcgcgcggtcagaccggctcagcccgcggtctgactggccgactctgtgtcggtttcggtttcgggttgtttgtttggatatccgtgattgtttcatgtttatggcttctagatggatactatgcatatgtaatactgttctttgctagtaatgagtcaagttggagatagcttggcctcggaatatggtttctttgtttgattcatgtgtaggtgacttagatgcctcgggagagtattgtcggtgatggatcgggagttgacttggggataaggcaatgttcgtgacagtcagatatcatgtaagatacttaggctagaggtcaatgcatgtggttggtgaagattccatatggcatacgatggaggtattgtgtgcgtatgggatgcggagtcgaatttacaaggagtccaaatttggtatgattggagtttgtaaagtttgtttcttgtacgggaaggtttcctaggtggattaggacttctagtatgagtttggttcgtggcattaggctgcctacatcatgtataaatagagagagagcatgaggtttcccggtatcgcttttgagagcattgagttgaaagtttagttagggtttcgagtttaatcgagattttcatgaggagtgctgttgttacactttgtaaacataaagagaagtaataaagttgtcatctactttgagagttcttcgatttgtgttttctcgggttcggcggtctaaccggcgaaacaccggcggtcagaccggcggcattgtggtggtcagaccggcggcgtacttacggtctgaccgtcgacgacatcaggcgacttcaggaggcagggtttgatctcagcggttcgactgatattactacctcggttagaccgacgatctccaggcggtcagaccagtgcgactacttcggtcagaccgcgatgcgttgaatttgagggtaacatttaattccgcaaaaagtttgggtttttgggtataccaaccatttaaccccctctggttggcttagttcttgtgtttcgatcctacaagtgatatcagagccttgttttcttctttagattttaaccgatctagagtttttgccatggctaataagtttataactaagccccatgttttcgatggaacggattttccttattggtgtagtaagatgcaatcttacattatggctaaggatcttgatatttggaaaaaagtttctaatccttatgtgattcctgatcaaattaatactgctgctttaaaactgaatttgaaaataattgcaaagctcacaatattcttttgagtgggatttctcgttcggattttgatcgtgtttctcatcttcaaaccgccaatgagatttcgattgctttgagaaattttcatcaaggaactaccaatattaaagaacttcatcgagatcttttcaaaaaggagtacataaaatttgagatgaaacatgagaagctttggatgactatctttctaggttcaacaaaattttgagtgatcttagatctgttgattcttcttatgatataaattacacacaatctaaggtttctcgtcattttttgaatggtcttgacatgtctatttgggagatgaaagttacatcaattcaagagtctgttgatatgtctacgttgactttggattcgctttacacaaaactcaaaacacatgagatgaatattctttctcgtaaagttgattctaattctagtgctttggtttcttcttcgaattctttgaatgttggtgcttcttcgttgaattatactattctttctttaattaatgctatgttcgatgagcaactcaaatagttcaaggaggaggacttggctttggtcactaacaagtttgctcgagctatgaacaatgttaggtacaggagaagaggtggtccaaatcgttgctttgaatgtggtgctcttaatgaccttcgctcgcattgtcctaagctttgaataaaggcaagaagaaagacaatgatggtgagaagaccaaggagaacaagccaaagagcacgttcaaaggggagaagactaaggagaatctcaagaagatgtttgagaaagtctatgccgcttttgagcctttaagcaatatagatggagaaagtgaagatgaagataagggaaagaacatctccggtgtttgcttcatggcacgtggtgaatcggattcagagtgtgaagacaatgaggtgagttcttttgaagaagctattcttattttaagtgctaaaaataagaagtgtgagaagatgtataggaaacaggaatttattattaaatctcttaattctgaaattgctagattaaaatctcttattcccaatgatgatgattgtaaaaattgtgaggttttaatgaatgagatttcaaaaattagagatgtcaatgctgcacatgatttgaaaaatagatcttctcttgctcttggatttgccttgcatacacgcactttggatgagttgttttttactaaaaatttgttgaaaaaaatatcaaattgcttttcatgctagtttgatgtttaacatgatttgtgccaaaaagtttaaacaacaacatgatgttttggatagctcaacatgcacattaaataagatgaaactaaaagatgctttaggacgtgttgagtacatggaggatattgtgaaaaacaatgaagtgctttcttgccccaaattttgtaaaagcaaaggtgtcatggtagattgtgaaaattatgctaatttggaaaaggagctttcttatttgaaaagttctttgcaaagattttctgatggtaagaaacaacttaacatgattttggatcaatctaaagtgactagttacaatagaggagttggttttgatgttcatgaatatttcaccaaaaatcaaccaaacgttttgagtgtgactaaatatggtgaaattttgacaaaaccaagtgctaagaaaacagtttttaagtctgctggaatttggccttctctttctacaacactaagagaaacaaaaacaaatctttcaaaaccatcttctaaaaaaaagtgtacttgttctttttgtggtaaagatggacatattgttagattttgtttcagattagctcgtaaacagaaaaaggagagagaaattgcaattgcaaaatcaaagtggcaaaaatctggttttcccttgaggaaatcggttagaccgcagtgggtcccgccgtcataccggcgactggtcagaccggtggctgtgcatcggtcagaccagctactatacttcggtcagaccggccttggagagatttttctaaaaattctcaaactgtttttgcacgtgggtacatgcctattggatctactggtcgtgtgtctcagtactggatttctaaattcttattatctaaccccagtactgaggcttcgacatcttcttgtgtgtaggctttggtggtgaggaaggagaacatgtggatcgtggattccggttgttcgcgacacatgaccggtgataaaaattggttctcctccctcaaacagacatctaagactgaatcgatgatctttggtgatgtttctactagtgccgttctcgctacaggttagttcaaggtaaatgacaagtttgaattgaaaa

SEQ ID NO: 73821 - DNA, 4254 bp, Oryza sativa
aagctataattaattaattattacccgagatcagcataatagcaacaaagtcccgcgactttggaatagatggcattatattacctgtctatcagttggaagaccttgtcaaaaaccttctcctctttattcattgagtcgtatacagtgactctgcatgcgtccaagtcaaaaaagaactggacccagtggaatatggaatatgcgtgagatgagataaatatcagaatgtacatgttatatgtatgggaatgaaatttgttcgaacgacaataaaaactcactctgtgttgtacggcaatagtatgaacgtcttgaaatgctgttgcgttaggagatggacgagattgtcctctgtgtctttctcgtacttgtcgagcatttcggtgttgattttccgagggtcaatgaacccagtatcgtaaaccccccgccgtcaggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtccagatgataccgatcgaagacatccttgaaatggatccttagaacatcttctccttccaagaagtcggggtttctgatcctcgctccgaacatctctctacccttggcgctcatttccatgtaccgttcatggaatttgtacatttgtgttggtagggactgcagctgctcaggcctgacaagcggtttaccgagttcaaacttgtatgccacttccgccttcgggattggtgcgcctccaaccaactgagcaacagttagaccggtgtccgaaatgaaatacgttatgccaaagtcttcgccggtcgccaacggctcgaccacttggtttggttgttctccaagctgaggaactggtttggacttcttgtaataggctttcctaagtgttcggtcatagtccgttagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaactttggccttcttcgttgcccttgtgctggcaggaggtggagcttggcgagaccttgtcttgggaggtgcaggcggacacggtggaggtggaggtggaggaggcggaggagccggaggagatggtgcatgaggaggtggcggaggagccagaggagatggtgtaggaggacatggcggaggaaccggaggagatggtgcaggaggagacggcgaagccggaggagatggtgcacgagacgccgcttgtcgcccagggaggatgatgtaccgcttgcgctatagtataatggcgtgccttgtgtctcgtagatgcgtctcaccatctcctcctaggtagtccaactcgaggtcctcgtacacggcttccaccagctcaacttcgaccctcgagtatcctgctggaatcggcctgcagtggtaagtccctgaaatgtccgttgggatggccattcccgacgccaccttcacgtgatgagaggttatctattagtaatcaacctaagcagcaacttgcggaacgtacaagtcaaaaatcatatattacatcgaggataccttgattgataagttcttgaagggaatatgcagctcacatggtgtccgttgcgtgatctcatcaacggggcaggtggtttcatcatgggtttgcatggcgtccatgctatgtgatcctacctgccccgttgaggcgcagctgctacgattacctgattggctgaccattggaggaggtatgtacggctagggatcatgtgaccgatgtgctgccatgcgttcatccaccttccgggccacctaatcttgcatgctgagctcgtagctcgataccctgtactcaagatctgcaatcttcgcctcggtatctctcttgctcctcatccgactcctgtacgtgtggatgtcctccttgaatcaaatcttccagggaatcacgccttttactcgtgttcgtcttggatgctcgggaatctgtagggcgagtgacagctcgtccttctctctgtcgggtcggaacgtgcactgagaagaggcttccactatgtccgttagtcgactggcagcctcacgtatctgatcgctgaagaccagggagccatcaactgggttaagcgttccaccgtgagcatagtaccagaacttcgatcgatccggccatttagcggtggccggttcgatacccctctcaatcattcttgcctccatctcctcccacttcagtattgcgacgctatagccacctaaccccaagtggtgatggtacttcttcttggcagcgttttccttgtttttgaccatcatcgcttgcccttgttgccctgtcttgtcagcaacgaactcgtcctaatgatcccttagctttgggaatacgtcgaagttcggtgttagtaccttcaggatgtatttcttgtacagatgtcccttgaagctcttgaactgttctgccattttcttaagagtccactgtttcactatgttctccgtacccgcagggagcgtgaacgtctcgagcattgtggtccacagcttctctttctctgattccgggacaaagctgtcattatccccgcgtgcccttgttctgcgctagtacaccttcctgacaggcacgttatccctcacaacccaaccgctgtgtcgtacaaaattcttggctacttctgccgggacactaggtcggccgtctgcgtccacctcagttatgatgtgccgaccctctatcttcttcgcagcacctcgttgtccgcgtgccctcttctgtccagtggagggatgacttccactagccgcctcctcgttcccctccgcatccctctccacgttgccctcctcgttcccctccgcatccctctccacgttcccctcctcgttcccctctgcatccctctccacgttcccctccttgttcaagtactggttggatcctcgttcccctcttcttcgttccagtactggctgcttccctctgcgattgtatcgtacagtatctatttctcatcacgatcagccatctgttcatagaagaaatatttgctaagcgtaatattaaaactctactaatcttgtattaaaactcaaataatcatatatgctaagtctaagtgtcgtgtattagaaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacactcacatatgctaagtctaattaagttccgtatattaaacatctaataatcttatattaaatctctaacaatctctaacactcacatatgctaagtctaattaagtttcgtatattaaacctctaataatcttatattaaatctctaactatctctaacactcaaatatgctaagtctaataatctaataatcactaacactcacatatgctaactctaataatctaataatcttatattagaaatctaacaatcttatattatatctctaacaatcacatctttacatcacttgcctgcacgaattccttcgagggctagctaccacttcggcttgagggacgacgacgatgacgtcttctctgcaacatgcaaaaaaaatgtattagtctaaacgcaaaggaacatataatgtatttcacgttttcaagtatatataatcatatatatatatatatatatatatatatatatatatatgctaagttcaacaatagtttaattatctcgttcgtacacgtttcgctcgcgttcgttcgcgttcgttcacgttcgttcgcgtttcgttcacgttcgttcgtgttcgttcacgtttcgttcatgttcgttcacgtttcgttcgcgtttcaatcacgttcgtttacgtcgttcgcattcgttcacgtttcgttcgcgttcgttcgcgttcgttcaagttcgtttgcgttcgttcgcgttcgttcacgtttcattcacgttcccctccacatccctctccacgttcccctcctcgttcacgttcgggcggctgtgcgg

SEQ ID NO: 73822 - DNA, 1267 bp, Oryza sativa
ttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgtcaggcaagggacggcgctgaaccccactcaaggacaatccgtggcttagcttccaggcgaaggcacgggtcgagatccggtcaaggtagggtgggccccccccacccgagagaagagtagtagagtcggtgcatgtggtatcccttgaggtataaaaggaggaccttgcccaccgaaaagggggggaccaagagaaaaaacctgagctcaaggagaaaggaagtaagggcaatctccagggcttagggacctttgtaacttgtgcctaaatcccatacacagcagtagggtattacgctcctttgcggcccgaacctgtataatcttgttgtgtgcacactacctggtagtctagtgggcggatacgtgattttcagaggcgggccttttcccccggtcgaactcacgaaagggggatcccacgatctcccgctagagaggatcactcctcgacagaagcggaatcgaagataagggctgtcgcgaaaacagagtaagaatcgggtagagtctggatcggctacggtcaggatcggcagagttcgagtcagacagggctagccgatacaaccgattccaagaatacgactcggtgtacatcagcgggtg

SEQ ID NO: 73823 - DNA, 16174 bp, Oryza sativa
ctaaatgctgtacgatgcaccaactagcaaccttgctgtactgggggactggacgaatcatgccacattaggtcgcgccatgcaactcctaccatgcgccatagttgcatcggctgcataacccgtggtcactctggtcgcacataccatcgaacatcggatgcatgtcaaacatcgaccaccacataaatttcgacataccttgaaaggtataccggaatgaattcgcgcatgccacatgaattcacatacatatttagcccattaatggatcatccgatacatactgcacttatgaaaagcttcaattgtgtctaattgacactacgctcttgccaaatcgatcctgcaagatcatgcatgttggcatcagcacattaagaaaagcactaagtaccggacgtccacaagaataggactaaaaatgtccaccgcaccattattgaaattcctgccacttcaatggactcttagctccaaagacaacgaaatatcaataaccggactattcgaaatgtgttgtccacttaaaagaatactagtgttgactcgacacacgtgcatgtcccacaaccataagggctcccaccgaaaaaaaatggaaatttttaacagaggtacgaacttatcctaaattccttgacaataagaaggattattttcagtcgtttagggggagagaaataacccttaaaatgataaatgtcaggaaaaatggtcaaagaaaggatggatgcacatttaatcaagaaccagcgaatgaaagtatggaaagcacacataagaattggataactacctatcacttttgtgatctggagagcatgactaagttgcattacccgaatgtaatgcaccggaggagggtgaaataccgaagaatgcaaaggtatacctcatcttgtccagatgcctcaaaaaataaataggacaagaactccggctccttaaatctctaaagtaactggagacgtatggtgaaaatgggacgaaaggaactttcaagctcatagtcactaaaagtaaccccagaatttgagggggagcctgttcagagctggcaaatggtatggaacctcagaacatgtataccacatcttcctatcaaggaagaaaaccagcagttggagtgcacaccaatgccggtaaaatgaaaggatcatgcccatgtcaaagaatagaagcataagaaaattgcatatccccatatatcgatggatactcacataagtgtcacatacaaccaataggaattggtaatgagacctgctatgggaaatattctcttcatacagcaaatcattggcagtcaacctggagtttaaaatcaactaaaagatcaacccgcaaagctgacctgtagttgacaatgaatggttaaagaaattttggattgggcactcgcatacaagcattaaaagtcccaaaccaagttgatgatcttaatatcatcgcataaagaaagaaagctcactctttccgaacaagtttgagataaaataggtagaaacctacgtttctttggctcataaacctacaacacatgaagaagtgaaccatagaatatcagaatgtgagaatacataggttccttggatatagttcaccatttctagcaagtaacatggttcgagctttgcccaaaccccaaaatcattatcaagaagataatgatatgtgcgtcacaccaacactaatagattgtatgatctctacaagttatggaaaaatcatgcaagatttgaccattgaagcatcactcggactatcttttgaaaacataagagcaacgagttttgatggttcacacttaaaagagatgcaaaattcaaggggggaattctgccagtctattaacaaaagcatgaactaaagaatcaagtacccaaaaacgattaagaaaatcgatacaagaatttgggtaaattgtactctttttcccttagataagttttcttgcagtttcttatcaaggtttttaataaggcaatctatgtgacatacatgcgtatgctatgtactctttctgcaatttttcccactgggtttttatggagttttaacgaggcatagacatcacgcggtgagtgcccaagggggagtgttaagaaactttaggcttggccgatgaaggcctggcccaaatacacttaatgggcccatcaacgaacctttcatatattggaatgcactatataaagagaggagggggctaatcatttgtacagttgattggaggattgaatagtaaagagagtctcacccctaaactttgtgtctccaatattttctgtagaattacgggaccctcttgaactgctttgtgtagcaggagggttgcgtaatacccttgaccctaaaggttccacaaccctgaccagggtatcattattaagaagtagagaagaagatgaggcactggaaggctgttatatgtccaagaaacattagctgccaccatcactttgggatggagagaaaaaagattgaaacaactaccatgtcaaaggaactctgaccatggttgcattcacatgggattataggctatagtgtcaagagtcaaaacctcgagaaggagataggccacgacgagcgcaagaatgtggatgtgcgctgtagtgaagcgcttgcttgagttcaaccatgtttagtcacatgtttttcttccttttatactgagggattgtttggtttagggtgtattcgtttgggaggaatttcaaaggatttggatttctaaggatcctatgaatgtcattcggttcgtaggaatgtagatatagaaaatcaaagaaaattttctttttctacaagttgcagagagaagaaaggaaactttccatccacataaacctcatggaaaaattcttacggattgaagtatgcatgcttttctattcctccacttttcctaatcctatgagaagtttctactcacagaaataggaaaagtgaaggagtggaaatgtatgcacacaccaatccataggaaattttttcaagagtttagagtaaattaaatgaaaatttttctagttttctctctacaacttggaggaaaacaaaaaaatttctttggtttttctatacctcattcctacaaaccgaatggcacttgtagtagttaatcattaggaatctaaattctttgtttttcttcaaaccgaattggtttagatagatccttaatttgcagcccttagaggatgcaatttttctttttgctatattcaatgaatgaaatagcaccgtctttgtgtctattcatttaaaaaaaatgattacttttgactggatctctacacgatatgcattggtgcagtacaataatagagatcatcttgcttcttattatattcagcttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgttagtcaacgcttggcgctaactaccaatcaacgacagaccgtggtttagtttgcagatgatggcatgggtctaggtccggtcaaggaagggtgggctcctccccatcccagagaagaatagtagagtcaggtgcatgtggtttcccttgaggtataataaggaggaccttgcccaccgaaaagggggggaccaagagaaaaaacctgagctcaaggagaaaggaagtaagggcactctctggggcttaaggacctttgtaacttgagcctaaatcccatacacagcagtagggtattacgctccttagcagcacgaacctgtataatcttgttgtgtgcacattagctggtagtctaggggacggatacgtgatttccagaggcgggccttttcccccggccgaactcacgaaagggggatcccacgatctcccgctagagaggatcattcctcgacagctggcgcgccaggtagggggatttcgcgcgcttcgaagagaagtcgtttccttccgctccaagccttcctccggccccaacgatcatggtggaggttttagaggaagaggtggaggtgcagacccttactccttccaggagtgaaggtgccagcgggagtcgcaacccgcgtcaccgccgacgcggctcgcggactccgcccctctccgaccccctgcggagggaggttcacgcctgatcgggtggctcggccctctccccgcctctggatggggggaggccatggcacgtccgagcgcgccgctgcctgacctaccgcgacggcagctcgccccagggcgcgctttaggcagggggagccctcctgcggcaccccccggtgaacgtggagccggaggcccccgtccaacgatggttggacgacgtcgccaacttggtcaccactgcccagcggcggttggccgtaagtggccgttccaccgccacaggtacatcacgtacctccaccaccctctcctcgtcagcaaggaggagggcccgtcggatagccacagcctcaaggcgatctacggccccaacgtcgtcaggggcctcggaaagtcggaggcgtcacgatagcctatacggggagcaggacgctcgagtcaacattgagcgtcgacgagacgagcgccgcgctacccgcatgggagaaggcgcctcctcgtctggagtgccgcgtttctcctcgcgcggcggcccgcccctcacgtccaccccagggggaactggttacaaggccttcgtggcgagtctccggaacgtccggtggcccccaaagttttgcctcaacctcacagagaaatataatggcagcatcaatccctccgagttcctccagatctataccacaatcattgtggcggcgggaggggatgaccgggtcatggcgaattatttccccatggctcttaagggtcaggcgcgtggatggcttatgacctagccccccgactccatccactcctgggaggacctgtgccagcagtttatcacaaacttccagggcacatacccccgtctgggggaggaggcggacctacacgctgtgcagcaaaagtacgacgagtccctccgctcatacatacagcgcttctgctaggtccgcaacattattccatgcatcccagcccacgcggtcgtttatgcattttggaacggcgtgcggcacaaccgcaagctggagaagatcgcctccaaggagcctaagaccaccgctgagctcttcgagctagcggacaaggtggctcagaaggaggaggcgtgggcttggaactcccccagcaccggtgcggcggcagcggccgcccccgagactgccccccgctccaagcggcgggacagaaggggcaagcggaagccagcccgctctgatgacgagggccacgtccttgcggctgatgggccctcgcgggccccgcgcagggaaagggccaccgacggcaagacgagctataccgccccttctggtaagggtcggtccgcggacaagtggtgctcggtgcacaatacttatcggcacagtcttgccgactgccgctcggtcaagaacttggccgagcggtttcgaaaagccgatgaggagaagcggcagagtcgacgggagggcaaagccctcacgaccccagccaatgatcagcgagaggagtctaagaagaaggcccccgccgacgatggcgatgacagcgagggtctggagttccaggtacctcagggaactgtcgccactctcgatgggggggcttgcgctcacacatcccgtcgtcggtcacatctgatctgtgaccggcctgtcaccggtcacatttgactggacggacagatgtgcccccacgtcacatctacctccggcagagtggaggtaggtatgacccgtcccatcggaagggtcattcgaggtcctccccatgagaggacggccaccacaattcttcatccattaatgggggattgacaggggtgtcccccgtgttaggcaagggacggcgctgaaccccactcaaggacaaaccgtggcttagcttccaggcgaaggcacgggtcaagatccggtcaaggaagggtgggctcccccccacccgagagaagaatagtagagtcggtgcatgtggtttccccttgaggtataaaaggaggaccttcccaccgaaaagggggggaccaagggaaaaaacctgagctcaatgagaaaggaagtaagggcaatctccagggcttagggacctttgtaacttgtgcctaaatcccatacacagcagtagggtattacgctcctttgcggcccgaacctgtataatcttgttgtgtgcacactacctggtagtctagtgggcggatacgtgattttcagaggcgggccttttcccccggtcgaactcacgaaagggggatcccacgatctcccgctagagaggatcactcctcgacagaagcggaatcgaagataagggctgtcgcgaaaacagagtaagaatcgggtagagtctggatcggctacggtcaggatcggcagagttcgagtcagacagggctagccgatacaaccgattccaagaatacgactcggtgtacatcagcgggtggagttgatatgcttcaagatgattgccacgcatggataaagtcctgaaaaggcaattgtatctattaattaggatattttatgcaaagtccttagagataaatgtgggcaaaagtctgtcgcaaagacttgtggtatcttagagtttgttagagataatagtcgtgtccggtatggacatatcttgtaatactcgggtataaatagacccctagctccatgtaattaatctaacacacacattcaatacaattttggcgcatcgccacccttttactttcattttgtttcaacgagttcttgctttcgggttgagctgcatcggtttcaatcttcaacaagaggtaaaacttgttatggctgcttgtgttctcgggattagtgcttccatctctatgatactctaatcttgtttatgtaattcatcaagttatcatatatcttgtatattcttcggtaatatagtcatctaacctacaatcagctaacatctgttagtagaaggcagccgattaggttaaatagcggtgttagcttggattgtacaagatacttaccactctatgaaacatccagtggcttgattgtctagatattgttcttcttttcatacttaatgctgcatcagttaagtttgatctatcaagtcgtgcttagaatatcaatctctagcctgcttcctggttgccgattagtatagcatcggagtttcagccgatcttacctgatttaactatagttatcctatatgcttgattgacatgttaaatctgccctttatgttaagatcttgttgcatttaagtatattatgcttctgtctgatatattctatttgctttaatatcttaatatagagtggtatcggagtattagccgatatatgctagatctatctaatcggctacgctattaacgtatatagttttgttgttgatttatatttcgatctaagtgatttatactgtctcggcatggcgaccgatctatcccaatcacttgatttaagtatatatcgacataagaattatatattgttaatgtctacagccaatcgagtaggtttagttcttccttaattattcatgactgctgatcgatgcacacatgacatcggtctaaaataaatgatgtcatcagtacccagccgatcggctatcatttatagatttaattacggtttctttgtcttcattttttgttgattgtaggatcaaatcgactggcacgctcatatatccgaaggcgagttttggacctgcactggagttaagcagatcttccaggcctcgtgttttctgtcaacaccatataaattgttgatgcgtgcatgatacatttaaatttttctgtagataattaaatatcacaaattgaagaagggatataatcataataacagtagtaggggtttgaccaattttattcatttagggaaatgcttcgcatagtttattaatcaggcggtggcgttgagctttgcgatttcgtcatggaatgcatcgacgtggtgagctgtaacacacgctgacatcaccctagccccttgctctgttgccttgagcatgacgcagatcggcatagcctttaccatcatcgacatggagagcaccaccctctgcgggtaggtcatcaccctcgccgtcttcccgctgccgaagtcaacatcttcgaatccgatgtttcgccatgatgtcaagtagagcaggctctcatatccatccagacgatggtcatcggcgagctcccgtagcatcgtcatgtcgctgccgccggtcatcttgagctgctccggtatccgctccttggcgcgccgtatgatgtctacaatgtcgttgatgtcggcgttcgccaccgcgccgctcttcgccacggccacgtgcatcgtgctgcagtttccgtagtacccgtccttggctccgagatactttcgcgcattcaccgcgaagagcagtacggcgggggcctccggatttttcatcaccgcccgggtacggcactgccaaagcacggcggcgacagcctcgaacacggtgacgtcgtcgttggttcgtcgtcctcggaatcggatgtggtcgatcaagctcgacgggacggtgatgttgttgaaggtgtggtcgatggatgccttgtggctggagctggacataaactgataaacggccatggcgaagggaggtatggcctgggtggcgttgttgtcgtcgtctaacctgaccgggacgacggacggcgatggcaggccacgggtgagctcgccgacggcttgtatgaactgtgccatgccgaagccgtcagccaggccatggttccatgtcaccccgactacgaagcctccacaggagagtgtggtgacctgcatccacagcagacggtgatgaaggtcgtcgggcgtgcagttgaaggcgagctgctgcaccaccgccgtctcggcgtcgggaggctggtcgtcgacgcaacacatgagctcctccatggtgcagttggcggacgccgccacgaacgtgactccgagctcctcgccggtgcagtcgatgtagaaatcgccgtcgtcgtcgcaggaaaggcggccggcgataggatagtaggggacgagcgcttgagcgagacctctcttgatggtctccgccgtgcactctgattggatggtgggatggtcgaacgcaagtagcactgtggttggcatcatggaactaggcttgtccataggcgacagaacgatcttgctgccggaggtagtcttcaccggcggctgcgatggccggacgaccaccggcgccgacttgctcaccacaatgctcatactttctctatgtctaggctctagctcgctctgagaataagttaggacaagcaattacagatcatgtatacaaccatacaatccttaaacaaaagcatcatagcactggttacctctatggaattgacgagacaaaagtgatcgaagcaatgtcaagactgatgagctatgagcccttttaaggtcttcatatccatcctaaccgttaacatacaattatttcttaatttaaaatatgtttgcatatctgtcaatcaataaatgaatggctttaatggaaaagagtaatacacgtaagagcaagtttaatagtagagctaaatactagctataagctcatctgaaaataatattagtcaacttgtaaaatggcttagctataaggttttctttatttttatcatagtcctttcttttcttctcacttatctagtataggtagaggtaactcttacataagagttagtacctattatctctctcctccacatatgcacgccacgagccaaagaagactgtcaccggttcaccgagagatggatatccatatataagtacatgtgacacagaatgagtttgacgatatacacatagggtagggggcatatcgattttgttagaagataatggatgacaaatttagaatgtcattctaagtgggtagctgagttaacataggtcaaataagatagtgttagaaataatcttgttattagtgcataatcatgtttgcttaatttggtcgcatgtagcaaataaatgtataggtagcaggataggataaggtacccgaagaagctatagtagtagtacgcgagatccgtatacgagtaggcccaagagccgtgcgagacggccgggtatgtgagatgctgcaggagcacacaaatagtggctggttagtagagtcattagcataatagccgggccattaggatcttagttaattactaggtgtgcatatggatgatctagtcgtgtggctaagagtagcatgcggctgctagtggcgcacgttttggcctctaactttgtctatttaagcatgtacttagcatctttgttaattgagtaaaaaagagaaaaacgctgcgtttgtgcagcaccaaactccactgttctttgcctctaaatgtgtgtgtgtttatcaggagtgtgtgcgagtctatctagctaggaagtgattcccaacagatagcaaatcaggttggaagagacggaagtgacttggaagtatagctgagggaaagtacgttagatgctattatatggtgaattgtaaacttttgatgcaataaaactaaaatcgagaactttccttactatagattcaattttacatttaagtagaagcaccaagtttcttataacttcctctctacaaagtttctttagtaatcaaataatgcatgactagagactgtcccatcaaatattaattggtagtatgggctaggagagtgaccgtgcctgcaaggaataaacatcattcgttatatattggtttatgcttgagctctctaataagaaaacatgcacgttcttcacgcagacttgctatagctaactttcaaatagtttaattcttatctactagcgctccaatattaaatatggttttattataggtatacatattaacaccataacggtattacgtccaaattaattaataccctctctactgttgatgttaatcatcacgtacgtcgccacactatgagcatattatgtgcaacctgcaatggcaatcagagacgagtcgtcacaaggaaggtggatgccaccaaaggaacaaaagcatcatagcaatattaacccgccgtggctgtccgcagagagaacgtgaagcaacgtaaagacgaatgagccatgagcccttttatggtgctattttataactctaagggcttcaaaccgatcccaagagtaggtacaatagcaggctcttagccagctgtaaatatgttttaatgagataaacgatgagagagaagagtagcgggctacagatctatagccagctgcagcacagactccaagacacactgtgtgtacgataggtgagatcatatattaatagtatagtaagcaactattgtataaattgactattagattagctatagatgaattggagctattagtgggctatactattatactagctctaagggcatccacaatgtagcatttcagcaggtaataagcattaaatgccctcttcttacccggtagcaaccattgtgagactagtaagtagatgcagcccggtaacacgactacaaccgggtaacaggaattaaactatgcccagttttcctaacaaaagttatagaaagaagtcacggctagagactgccatccatgattttttctgaagctggccctaccttgtttcccactgatatgctgatacattgtagagtgcatgattgcttactgctgcctgtagccctggcccacactactgacacactactaccaagttgggcaagtaacattgctgttgccctaacggttgatatgtaattgttttttgtaacttaaaatatatttgtgtgtgttaattaatgaatggataacttgaatggaaaggagtaagaggctgacaacgaggtcggtgagaggatttcttgagcacttcgagtgtgacagcgaggtcggcgaaaaatcacgtcaggcccaatgccgtagtcaatgtgtgtatccatcgccgccagctcgatcagagagaggaatggtggtggaagaagatgactaaataagagtaacttgcatgtaggtcccacatcaatcttttaatttcgttgatgacctagttgccatgtggatgccatctacaaataccaccatcaatattgtcttgtgagttaaattacatgggttataacagttttttttttggggcgggggtgttccagatatccggtattgcagttgagggatacgaatcagataggacctatatttaaaggagtcaaattggcaggattatatataaggcatatctcctatatgtgggtttttgttgtatgttaataccaaacctaatattatacgggaagatgcccttggaaacagtaataaaattgatgattctggacggaaactgtcttcgctgggtggaaggctctaaagtcctattcaaaaaacacaaggttcccatggttaattttctatttagggtctccgagttctacttgtagaaaaattaaaagtcaatcatcggttctaattggaggaaaatcaattatcgatacaaatataaagcccttatgaggatagagatcattgaattacgagccataaccaccaaccacatcagtagacaatccagaggaaaccgaagccctatttgctgataagctctcgctaagtcatactcggcgagttctaatcgacggattgccttagctagtctattctcctcatttgtaatcattgtagtcttttcctagatatacgtataaactgtgttagagctattactctttttagagggtctgaaccagtataaacccttgtccttgtctagatacaatctcacatatatcctagtatcaacgtcctccgtactttataaataccgtaggtagataaagcccataaaaaagtggtcttatttcttttgtttggcatagctttgatcggtttgcccattaattttgcctggttgagtaggctattatatggtactccctactccctcggtttaatataactgtcaccattgatccatactattgtaaccgtaattttaaaatggttagagtcttcgcaaaaaaatgattagagcataatgataaaaaaattaatacttaagcatgtagtaatattcttggataatatgatatctacatatttatggatttagaatttctttcagaaaagacaaacgaacacaatttaaatatgaatagtgctcggtttaataaatataaacaaatggatagagtggctttcctatgaatttttttgttctggaaacacgttacgagcgttcatatacacacgcacgtactctcctttataaacgcacaaatacacatcctagtcctatagaaaccaccaacagactatgccacataggcatatctcaagagtggtcttgggaccaactaaaaaatacatagctaaaggttgatgtattcatgggttttctctactggtaatgggatacagggtctatgagggtcaagatctgaagagggaggtagacaatgaagagagctagaacatggtcgctcgctagagagaagcgcttgcttgagtttaaaccatatgaagatgtaaacttttttgtgctatattcaatgaatgggcaccgcctcgtgccgatttgttaaaagaataatagattacttgactggatcggatctctacacaatgtatcgatggaagtacaataatagaaaccatgtgccttcgtattattcagttatatgctttcttcacgattaatatttcttcatctttgtttgtactgctatggcatgtattaaaaaactagaaaagtgcccgtgcgttgcaacgggatgaaaatataataaattgaggaaatattgagaaatatttacattatgtaattaattaaaattcaaattcaccatcttctttatacgaagaaactatatgtgtgtgtgtctctgtaattgcattttcatccctgctaaataagaaaatcgcaattacagatatatatgatgttgaagaaaataattaaaaatgaattctaaactgacctggctatatgttaggtctagcgatgtgtttggtctaacatcactgtactatctagttttggagtggcttgataaagcagtcgtgcttggaacgttgggactgccatggaaggaaacacagaaacacagaaaacgtaggtctagcatcactgtactagcttgttttgtcgtgagactgccatggaaggacacacatgaacacacggtcaacagatagacgctgaatcaaaaacgcccggacgaacgattggagttgcatgtaatgttgcgtcttagttgcacatctcctttgaaaagagatgacatcattgagttcacagatctcaagaacgtattttcatcaagtcattttcattaaattgatctcattgacctctattttgaagagcagcgacaacagaaattttgaatgatgcatgattcttgtggggtataggatatatgtatgtatcgtcctaatccaaattgagaacgggatggactgtccaccttgatttttgtttaagagatttataaatcattttataaattatttgtagaatttatcctaaagttcaattaattttccggtgatgtaaatgtgggaaataaaatttcccaaataaaatatagctggatttaatttttattaaattctccataattaattacactatctgaaattctttcagaattttcagagttcaattgttaattttaataatacaaatatcatttcagcatttatttaaataaaaatctaaataaaaacccttctttttctctgggccacttttagcccatttcttctgtcaaactgcagttgagccggcacgctttcttcccttctcctcccctccgcctctggcccttaagcgcaccaagcctatcaagcaaccacaagtctaatagtcctcgcttcgctcctctcactgtcgcgtgggtcctagtgctacaggtttgtctcctacctccagctagactcccgcagcttcaagacgatgtctaaaatcgtctccaccatgaaatctggtggcatccttggagataatccaaaactgagattgaggggtttcgatttttatctcatactctttccattttctgaagaatcaaagcaaaacctcatcgtatcgtgcttggaatcgaggcctatcctaaataagcgaactctagaatttctcatctcagagtccgtttcactagaatttcccatcacgtatacgtatgataacgacgatggacgaaagtagtcgcgaaatccttatgtatttttttgagtaaagtgtacgggtggtctttaaacatgtaggggtatgtcatctaggtccctaaactctcaaaatgaatattcaagtcctagaacttatcatagtgtgtcatctaggtcccaaatcgccacaaccccttcaggatcctacgtggcgttgatgtggcatgccacacggacatgatatggctggcattattttgactgacaaatgggtcccatttaatttttttttcctttttcttttttcttctttttttccctttcttctccttt

SEQ ID NO: 73824 - DNA, 3374 bp, Oryza sativa
tttggacttcttgtaataggctttcctaagtgttcggtcatagtccgttagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttgactgcaactgtacggcggctccttgtttttggtggtgtcaactttgtccttcttcgttgcccttgtgctggcaggaggtggagcttggcgagaccgtgtcttgggaggtgcaggcggacacggtggaggtggaggcggaggaggcggaggagccggaggagatggtgcaggaggaggcggaggaggcggaggagccggaggagatggtgcaggaggtggtggcggaggagctggaggagatggtgcaggaggagacggtggagccggaggagatggtgcacgagacgccgcttgtcgcccagggaggatgatgtaccgtttgcgccatagtataatggcgtggcttgtgtctcgtagatgcgtctcaccgtctcctcctgggtagtccaactcgaggtcctcgtacacggcttccaccagctcaacttcgaccctcgagtatcctgctggaatcggcctgcagtggtaagtccctgaaatgtctgttgggatggccattcccgacgccaccttcacgtgatgagaggttatctattagtaatcaaactaaccagcaacttgcagaacgtacgagtcaaaaatcatatattacatcgagcataccttgattgataagttcttgaagggaatatgcagctcacatggtgtccgttgcgtgatctcatcaacggggcaggtggtgtcgtcatgggtttgcatggcgtccatgctatgtgatactacctgccccgttgaggcgcagctactacgattgcctgatgggctgaccattggaggaggtatgtacggctggggatcgtgtgaccgatgtgctgccatgcgttcatccactttccgggccacctcctcttgcatgctgagttcgtagctcgataccctgtactcaagatctgcaatcttcgcctcagtatctctcttgctcctcatccgactcctgtacgtgtggatgtcctccttgattcccatcttctagggaatcacgcctttccctcgtgttcgtcctagatgctcgagagtctgtagggcgagtgacagctcgtccttctctctgtcgggtcggaacgtgccctgagaagaggcttccactgcgtccgttagtcgattcgtagcctcgcgtatctgatcgctgaagaccaaggagccattaactgggttgagcgttccaccatgagaatagtaccagaacttcgatcgatcaggccatttagcggtggacggttcgatacccctctcaagcaagcttgcctccatctcctcccacttcggcatcgcgacgctatagccgcctgaccccaagtggtgatggtacttcttcttagcggcattttctttgtttctttccatcatcgcctgcccttgttgacctgtcttgtaagcaacgaactcgtcccagtgatcccttagcttcgggaatacatcgaagttcggtgtctgcccccttcaagatgtatttccggtacaaatctcccttgaaggtctagaactgttctgccattttcttaagagtccactgtttcactatgttctctgtacccgcagggagcgtgaacgtctcgagcattgtggtccacagcatctctttctctgattccgggacaaagctgtcatcatccccgcgtgcccttgttctgcgccagtacaccttgctaacaggcacgttatccctcacaacccaaccgctgtggcgtacaaaattcttggctacttgtgccggggcactaggtcggccgtctgcatccacctcagttatgatgtgccgaccctctatcttcttcgcagcacctcgttgtccgcgtgccctcttctgtccagcgtagggatgacttccactagcctcctcctcgttcccctccgcatccctctccacgttcccctcctcgttcccctctgcatccctctccgcgttcccctcctcgttcaagtactggtttggatcctcgttcccctcttcttcgttccagtactggctacttcccgatgcgattgtatcgtacagtatctgttcctcatcgcgatcagccatctgttcatagaagaaatatttgctaagcataatattaacactctactaatcttgtattaaaactcaaataatcatatatgctaagtctaagtgtcatgtatttgtatggtagataatcttatatgctaagtctaattaagtttcgaatattacatctctaataatcttatattaaatctctaacaatcaaatatgttttgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacgatagataatcatatatgctaagtctaactaagtttcgaatattacatctctaataatcttatattaaatctctaacactcacatatgctaagtctaattaagttttgtatattaaacctctaataatcttgtattaaatctctaactatctctaacactcaaatatgctagtctaataatctaataatatctaacactcacatatgctaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaacgcaaaggaacatataatgtatttcacgttttcaagtatatataatcatatatatatgctaagttcaacaatagtttaattatctcgttcgtacatgtttcgctcgcattcgttctaacacttttagttcaagtgcattcacgttcgttaacgtttcaatcacgtttgttcgcgtttcattcacgttcgtttacgttcgttcacgttcgttcactaacactcacgttcgttcacgtttcagtcacgttcgttcgcgttcgttcacgttcgttcatgtttcattcgcgttcacggcggtgggggcgcggtccggcgccgtgggccggcccggcagtgtgggggcgcggcggcggtgtggcggcagcggcgttgtctcgcgggggcggcgtctcccagcagtgggggcgcgg

SEQ ID NO: 73825 - DNA, 15702 bp, Oryza sativa
gtggaagagagaaaaaatcaaatggcgcatggataccaaggatcgaaccagcgatcgacgtgcaaaacgctagagcatgtgttcactaccaagatttgtaaatttttctattttacaataataattacatctttcttgtactgcagttatatacgagttacgaatgtaattacactgctattatactataattacatttgccagaaattttagggggattttctatcgaatgttagatagacagtctctattttttaatctaaatgacaacgatatgccgttagaaatatatgcaatgcctttttatcattagaaatatacacaatgcctttctgccaaatgtcccaccacccctctcctcacctcgtctcatatcccctttactccttatttttaagtagttgagatattatttttaatttatcataataaatctcaaaaaagcaacttttaggtacccaaacaattattattcgctcacaccgttatatttcttacaattaaatgccgtaggctctctggaccttccattatatttgagagatgaagtgaataattaaagtcatcaaacaaatataatgaaatatctgacgccttgagagaagaatattggagacattgctaggcctttagcctgtcagtcaactttgattaaatttatggtgtgagaaaaatctacttcgtaagtattcttgaaaacgaaatattttgtgttggttcatgttctaaaattttaccggtcgctcaaataatcataaatatgtaaaataaaaataggaaagaaattagtcctgctactatgaaatcatgctatgttaaaataattttactatatgatttaactaagtatatttatatttatgaagtaatatattttgtctttatttcgtaaaaagtcatactatgaatgcacacacacacatacctacgactatttccgaaagactgggccggcatattttgagattaaagaaatcaccacggatgcctcactattgatgggtacgtcacctacaactgaatgcacacacacatacctacgactatttccgaaagactgggcctgcatattttgagattaaagaaatcaccacggatgcctcactattgatgggtacgtcacctacaactgaaagaacaattaatcgtaaatgcaagcacccatatcaagtataggacttgaacccaggtggcaagttccagaacaagaaacctaaccagttgagctacgcttgctttgcaataatgttggatactaaaacaactataattttttagatctatcttattaaaaaaacaagtgtgtattcatggtacatcacatttcaaaaatgttactgcgcaattatatttcatcgttatcgtattcatgttaagctgcgtggaggttctgacccactctacatgaaatgttcatagatggatcacctctcaaactacatcaattataagagtctatataaacctatacatttagtggagtttcatgtctaacacaattcatcctctaataaaccatgataatatatgcaactaagaaaagaaaaacaccttaattttactttacacttacttttactttcgttaacatgttttcttaagaaaagaagtctaccttcttttcaattgcttatagatgttacttaattatgatataatataaagctaataggttagaaaattataaaagcaattaatgccgacgtaaacaatttatggagaaatcgtggcagatgttatccgtttaatatttcactcttataagtgtcttgaactaagcgtaagacacatgtccgcgtgaaagcgtgggctaccttcctagtttcttttaaaggcagatcgagttggtgcaggtatgacgtattgtacgcggtagcttgcagaggtaaatttggactagaaaacttagttaaccgagatcgatcgatcgagctgagtcgctagctagctagggaactcatctatatattacactaccaactaaatatcaccatatataatactccctccgtattttaatgtatgacgccgttgactattcgaccaacgtttgaccatttgttttattcaaaatttttatgcaaatatgaaaatatttatgttatgcttaaagaacatttgatgacgaatcaagttataataaaataaatgataattacataaattttttgaataagacgaatggtcaaacattgaacaaaaagtcaacagcgtcatagattaaaatatggaggtttctttctgtggagattatgggtgccccatacccacacggcgtggttatccgactggttatagcggataacttatatctatggaatatgtaacggatcatgacttgggtattacgtttcctttatattatggaatagcctaaagttctggtttgattatgttgtaaagtagatttaggaaaccgataccgtattggttaaggtttctatcttgtaatcctgccccccatcctatataaggtgggcaggaggccctctagggggcatgagcacatatgatcgtcatatctataatacactcggcggattcaaatcttcaaacatgagtagcgtattacatctcattgagagggcctgaacctgtctaaatccttgtctccgcatccatccacttttaggtctcgtgccctaccccttttattattgccgaattcatgtttcgacagttggcgcgccaggtaggggtgcgccgagttatctatcaagaagtgagatggaaccaattagaagtccccgaatcagattcaatctagcaaggaaaatcaacctcagcaagttagatcgctccaatctccgacgtcaccaatggtggtgaatccttaagattcaactcgccaagatgccggctggagctgctatacagtccgtagccaaaagaatcgtttgtatccaagagatcatcggccacgtctccaactaccagcctgcacaaccctgctcgatcgtgctgctctgcatggaggtcggccacgggaggcaccactgctatctggacaggtgccgatccagttgtcgtcgtcgtcgccgttttctgttatgctcggtgagattgattccgctgagaacagattggacgcttcgagttagacgcggactcggcgcctcgccggaggcgtgtagcagcgcgtcatccaccgcagccatctatcagccgtgtgaagacagctactcgccgggataacaatcacccgtcagcacatgcacttggacatgcaaggatcggctttgcatctacacgcataaacacatgcatgcatggataaaaactgctttccggcatcggcagatttatcgttccaatctattattatgattatgatattatttttaatcatagattgatctgccttttgattcttctttttctctcgcgtgcatatactggcgtttgatggatccatgattacctccgatgacggcatcatgctgaaggactgtcggttacaggggcagatacacgcacagtggcatgcaatactttcagacgcatggacatgcaaattagcatgcgtatatgctgcatgcatacatcaatatatatagcatataatatctatacgttattgctaattgctattcctaatcagtctgattaatatattgggtattttttgcatgtgagatcatcgttggcctatccatccggctgacgtcgccctgatctggctggagcgagctgctcacacgcataatttgcactctgccgtatgcacatatatacacgcgtgcgagcagattgggagcaaacatgtgtgaggaaatatcctagcgttttccaaccatcactgggcctcttcatcttcaccgactagccgcctcgtcagccgccgactagtgtttccgcctgcacagctggcctattatgccgccgtttgttgggcttatatgtctccactgccggcttgccttcgccaccgccaactgatgtctctgcctgcacggctggcctattatgccgccgttgttgggggtctacatcttcaccgccggctcgcctccgtcgccgccgactagtgtttccgcctacacggtcacaccatagttgttgggcgtctacgtcttcacagccggcttgccttcgccgccgctgactggtgcctccgcctacatggctagtctattatgccgccgttgatgggcgtctacgttgtcaccgaccggccgtctcgtccgctgccgactggtgtttccgcctacacggctgacctattataccgctgttgttgggcgtccacatcttcaccaaccggcttgccttcgctgccgccgattggtgtctctgcctacacggctggcctattatgtcaccgttattgggcgtctacgacttcatcgctggcttgcctctgtcgccaccgactgatgtttccgcctatacggatggtggactccgtcaccgttgatgggcctagtcatctacaccaccggcttgcttccgccgccgccgactggtgttttcattgccattgatggacgactttgttcccacatcagccacctctgccatcatcaagaggaatattacaaagctaagtcattattttttcttatatgatattttccttttcctctgcctcactacatcaactggttaaccgttgactagtgagtcgggagctacagatattatatcatatttttcaacaattttcataatatttatcttgattgcttgcgaaataatacgagtaacaataaagtgcctatcgagttatggagttgtatcttcctatgctttccgtttggtttgtcaatggatagtttgcctttgggctgattcctagcacccgggggctcgttggatggaccaagtaacgcaaggtgctaagtattactcggaagaaatcaaaagcatagagataagataatttattttctactcttaataattgcaaaagtacctgagtagtaaacgccaatccgtgaaactttgtcccattaatggcgaactcatgtcacttatatgcatctttgggaagtgcctaggttgactcccgatgcttggggtctatgactagtcgggcagagtgtttaaacgtacggagtcatctgctcagggaaatcaaaattgacaagaggagaaatacatatttataaatattttaaaatacttgaatttttctcgagtattatatttacaccagatactacttatcctatatgtttgttctgtaggatccagatccagatatgcataaaagggattcatggctttaagcttatctcttacgctccaggaatggatcagtcagaacatcaccaacggcttgccttcgccgcggccgactagtgtcaccgcctgcatggctggcctattgtgccgccgttgttgggcgtttacgtcttcaccgccggcttgccttcgccgcacgcgactggtgtcactgcctgcacggctggcctattctgccgccgttgtcgggcgtctacgtcttcaccgaccggcttgccttcgccgccgccgactggtgtcttcgcctacacggctggcctattatgccgccgttgttgggcgtctacgtcttcaccgccggcttgccttcgccgcacgcgactggtgtcactgcctgcacggctggcctattctgccgccgttgtcgggcgtctacatcttcaccgaccggcttgcctttgccgccgccgactggtgtctttgcctacacggctggcctattatgccgccgttgttgggcatctacgtcttcaccgccgccgactggtgtcgccgactgcacggctagcctattatgccgccgttgttgggcgtctacgtcttcaccgaccggcttgccttcgccgccgccgactggtgtcttcgcctacacggctggcctattatgccgccgttgttgggcgtctacgtcttcaccgccggcttgccttcgccgccgccgaatggtgtcttcgcctacacggctggcctattatgccgccgttgttgggtgtctatgtcttcaccgactggccgcctcgtatgacgccaactggagttatcgtcttcacggttggccacctcgtcgtcatcattctacttcttccatcgccgactggttatgccgccgcaggttggtgtttttatcttcacaactacgcgtcttcgctaccgatttgcttctgttgctgcagactcatcttcacttcatcacggctatgcaactttatcaccattatggggtgacttcatcttcattatcttcggcacaggcaaattctattgcctctactttgcaagatttgctacttcaccaaccaagacgtctacaagagctccgacatctcggcatgcatcaccaaatatgatgccatgttattttactacaacaagtggtgttccaatattcaatatttctactcggacatcttcaacacgtatcttcactcaagcaatgactactcgacgacaagaagctacagttctcgactgtatatttagttgttttccaactaaccaaagagtcgggggctacacaaatacaagacgaatacaagactcaaaattcgacaagttttttttgtcaagctgaagcaatcaattaatcagcctacgagtcaactccagaagtcattatcttcatctttgcttcggagcagacattctacttcagcaactcttattatttcactggcaattttggcttctggatgacgacagatctgccagggtagtgtgtgtttttcacgtcaatacttagcctacttgggtagattacaacttgataggtagattccaaggatgaagcaggaggcaaggagtgttcaaactttcaagatgaagaaggcggaccaaaacggaaaagtcactcttcctaaaagctcgaggaagtacaccattcgagtgggggaagatgccaagaaaagattccgtggggaccaccttcaaccactcttgctagctggcgcccaaaagagtataatgacctccaaaatataccaaaatgcccctatgtttgcaaatgtggcaaaggcattatagtaaactcacaaaggcccgtaggggcatagatgtaatctcacatgtatgaccgtggattacaaaagctggtcaaaatcccgtagcagataagacatttttaatacaaaagtaatcagcaaaaagttgtgtgtactgttcgagctcatttctaagtataggcgggagagttcacttttcccgcctatccccaaacttgtccgtaacccaaggtcacgacaaaattctttcctagtgaccatcttattaggtcattacttgactttggtttttggttcatcctttattttactcgatcggatgtcaggtaagattcttaaggtgctatcaaacatatttctcgcatggtacatgacatcggtagcctaacgaatcttgaagtctttttcagtaagtacttattgagtagttcttgaacggcacatttggcacgttcgtatttttcttcctctttctttccttcttctttcaaaaagaaaactttgcatttgcaagaccaattatatgagtcttggcttatcgactaatgttaattgtttaacttttagctaggctgtgttcatttgtgtgtgttggaaacaaatctccgatgcacgacgaaaaatagagtggtccattagcgcgtgattattcaagtatttgctatttttttggatcaatataatttttaagcaacttttgaatagaaactttttgtaaaaaaaccatcatttagcagtttgaaaagcgtacgcgtggaacacgagagagagagagagttgaaaacacaggctgcctaacataaccttaatgttatattctagagtaaattgcgtctacggtacataaacatgataggtgggtgtgatctagtgcaaaaacttgaaaaatgagcatataggtgcaacaacttgactagcgcgttcattactttttattccatataaaaaaagccaccactcagactatctcgaaaaggatctacatgtattacatattgctttcaattagttagttataataataaaataatatgtcaatttaaaaccgaaagatatatggttatcaaaaataagtgcatgactaatcaacatatttattatctcaggttatgaacatggtgaaacacggaaatgaatcatgagccaacgatctagcaaagcgtataattccaggattaatcaacgtatgcattagtgttttggcataaaatatacatgattgtaaagtttactagagcgggagcgcgctttgcgcgctgcaccagcttatctggatcaaaatgcgtttgttcttttttgggaaattatctgtgtttttccttttttggaaaattggttgtgttttttttcctgttttaggtggtgaaaaagaatgaattagtttgaagcattgaattgtgagcatttgtgaaaagggtatcaagatggatagcttattactgtaacggcaggcattttactcgaactacttagatagtataaaggcatgtcattcagctagactgcatgcatatacatactatattctacagcattggtagtagatgcagtagcatcttagatcatacaatgctaaggaaggtagataaggcaacacttatatacaatgataatcatgacaaaaagccatgaacaaaagatcttggttccttagtcctgggtaatttcacaactgccatctgtcttctagctgggacatagctttgtacatatatataagaaaaagtcttgagatggattgcacgtcgacaactcattcactgtgtagatgaattaagagctgagattaggaatgcctttaaattgctaatttgttatgtgtagataggtgagtttgtgtttgaggagtaacctgtcattgcctttttgctgggcatcatccttgaacaatttcttagcaaccggaggtgttgctgtaggtgtaggccttcctctgtttattgaaatgatgtgttagttacaatggaagaaatctttattattggaatgcacctaggagtgatcaaagcacctttttttggctagggtatctgtagggaaggatggggttgcttgtttggcttcttcagcagtttctggtagtccctttcccttgtaaaagaagtggcggttaggtcttaatgaatgagatgaaaggaaagagatgtagtagtaccttattttcagcagtatcaggcagtacaacaattgaagatttatcatgtgaggtgttttctttagcttttgtgtcagttttgggcttgcaaaattaggaaagaagtgagagtggatgtaattcagtatgagtgacaacaagtttaagggtggctataaagtggttaccttatcatcagttttaggtttggtcttgctagactgcatgtgagacactgagacaacaatgcttttcttggtaggtgctgaagaacttgatttgctagttggggtgtcctgtgttccctgagcgatgatgaacttggttggtgttgagatggtttgtcttggttaaatgggctgctgtgattcattgcttgtttcatttggtgttggtgctgtttggacagagctgcttgagcttgctgagacaatagctgatgtcacttgtgaagcatctggggacataaggagtagtggctggtttgaagcaccagcggatataatgctattaacttgtaggcactcttgacttctcataacagtatcccgcgtaaagctaacattccatgcaaaattgctaccaataagtgacgtgatttcacttggaatgtattcactgtttggtggtttttcttcaatgagagattctacgggcctgcgtagtagccgttgtgcgatccttccgaaaaggataaatgtagcattagcatcatcatcgctggcaattaatactactttgtacctgcatgaaaaatggatatggctatagcaatgtgtggatgataattgctaaagatgtaagaggacagagcgtgttctgttatgaaccttggatctgttattccgatgctagaacagctggagtatctgtagctagagccatatggttttgaagttttgtagcatattcgacatgaattgtaccaccaagaatattcattacatatccttctgacagtcacatttactataaaacgtgttccctgcataagaagacaatgaaaatatcatattggtaattatatcatcaaaaagtggatagatgtagttaagatgtgttctagagatagtgtcaaccttgtgtttgtgagggttgatattaaggatttctgcaatactcttttcttctggtacatcctggttgtatcctgtagcaggctcatcaacccacttgattggttgaaagtttgtgctaaagctacatagaagaattgtatcttagattaatggatactgtgaaaaccttgaagaatacagtgatgcacatagattgtaagaataacgttaaataaattaaattacctctcatttagttctgctacttcaggaatatttagatggtaagcttccagttagtgtaaggcctatatatgtggaggaaattattagatattattagttgcatgtagtcaatactacagtaattgaaagtttagaaagaaatgtacctaatcctctataatctttcacaagtgttccaacaaacacagcaacttgagcttgagtttgaccagcattgtatatgtcatcagcatcaaaagaggttgctctttctccccagagtgtgacaggaagagttgaattgctagttttgtagatttggaggggaaaaagtgatttaattttaattggaagagatgacttagtgttaagaatatgtgagatagtttgtgtgaatgctagcgaaaaagattaagtaaataataaatatgtaaatatttagttgtactaaactagccttgcatcgcggatctgtaatgtcctttttaagctcttagcgtttctggacttaggacgtatagtagtgactgcaccaacttcagtgatcacacccataatgtctgtttgcattgcatataaatttaataaaatgatatggcattgcaaaagatgtatataacaataattgcaacacaataaaagtatgttattaccaacgtagaatgattttttctcgacaagggaaggaacatcttcgaatggtgtcagtgaaaatgtaataccagggaaatgaggagggacattaatgtgttcttcaagtgttgtccatttactgaagaggatcattaggttgtttgcaactagcctgtatgttctgtttgcagccctaacagtgaatgagtcaatgtagtaaaccttttcttccttaaggagaggtttcatcttttctgttataggggggtaaatttgggcatgtatgctagtcccctgcagattataaatacaaatcatgttatcaagagaattatcggtatagaaaggaaaatatagaaaatggatttggcacgtaaattattaccatttcatcgagtaagacaagatcagtgtggaaaatttttgtatcatcgttgagatcagtaaagttccatagcctggagacccttgcaaggattcttttgtttgaatctccaaacgatagctgtgaaatcagtacatgcgccatatggaatctgcaataagcacaaaatacttttagtatagacaaaacaacactactatatatgtacaaggaaatgttactaagaagaacagtacatataactgcagcggacaaatcatatactatgtatatagtatatggtacatgtgaaggaggtatatttattccaaaatatatgtacaaaattgcttcttttttagggtaaaagaggttaagcatggagcggcaaagcctgcaacagaaaggtatttcaattattattgataatttaagagaacacataaacatgatatatggaacagtgtgttgaaaagcaccgctggcaatgtagcgctaagcacttcggtgtaaacaatatttcttgtttgtgtaccacatgatccatcgtcattctcaattaatatttttaaacctgatcggcttgttgctcttgaaatagcaacgtataattgcccatgtgtgaaaacaggttttctaagatatacacctactcgttgaagtgtttgaccttggtttttattgatagtcattgaataacaaacacgaacagggaattgtcttctttgtaatgtaaaaggccatttcattttggtagtactcagtgttatccgaggtatgtaaacagtttcaccgatgtttgatccagttaatatgatacattgaagaattctttcacccaaacctgtaactaataatcttgttccattacatagcccaattgattgattcagatttcgaagtagcatgaccacagcagcttctttaagaataagtctatatgtagggaagttagtggcgtctattgagttaagaaactcaggtggatatagcaagtcaaaatctggtatttgttcagagcattttgatattgtatcacaacttgagtatatttttgcatctccaggaagcaaaccaataatatagtcatttatttcatcaactgttgtattattagggcaaacaattgcacgtgaagctaggtattcaggatttttgtatgatgcaaggaaatcagggtatacttcgctgacaatggcatttattttatcaccatcagttataatgagtaaatcatcaggaattgtgatccatgtaggatagctttcaccttcctttgctatcattggtaaagtgccatcaccaacagccaaaacccactggctaaaatcatccatgtcctttttttcatttttaggtagcattgtattaagtaatctcatttttatattcatagttaatattgtcacatgtttccataagtctgagtttgtgaccgatgcattgattatagcacgacgggagcctttaggaacaactggcaatatttgtctgaagtcaccacctaggacaacaggttttcctccaaaaggtataatagaattcaaagggcatgtctcagaaagtatatcacataatgtgcggtctagtgcttcaaagcatcgcctatgtgtcattggagcttcatcccatatgattaatgcagtctcaattaaaagctcagcaagcatagttcctcgttttacattgcaaatacctatttcatcaatgtcaattggtattttaaatcgagaatgagctgttctgcctctaggtaatagcagtgacgctacgcccgatgaagcgacggcaagaacaattttattatgtgatctaagttttgcaataatagcattccacaggaatatttttccagttccaccatggccacacacaaagaaaaaaccaggttgattcgcagcaatacgagaagttatgatgtcgaaaatgttttttttgatcattgttcaattggtgtatcaaagaatttgcatgcatgcttaacataagtggatcaagtgcaagttcttcaatcaatctattattaccaggaatatgcggtacagacgatggatgtggcaggttaaaatcctttatattaccaccactattcgcaaacacattagcaagttcgtggagaagaagattaagcaaatggtcaggtggaatgatacaattcgggttatccaatgctttttttagtttgctatgtatatcatctatcatatataaccaatacttgttaaacaatgatcgcacatcactaacagagcagtaaagaagtatagtcacaaaaagttgtctaaggtgctgtgaagatgcagagactattgcttcatcgaaaagtagataccattcattgtccccctcaaggagccctcgtgcctcacatgcttctctaaatgtggcatagacaatattattaaatgtacgcacatcaacataactttgagcacctttaacaatcattaacaacatgcgtaggtagtaaagttcactagcagttggatgcacataatatattctaccaatttttgcagcaggtgttcgctggcaccatactctagatgacgactcccatgaccactctttcggaaattcacagtatgttaatgaacgggctttagaatattttttgttagcttcaaaccattcagttaacattgaacgcttcgtagcaggactttcaagcactgctcgtaagtccgatcctttctcatatctaacatagtttttcccaggtaagtggacaaccaatcgttcaacaggaggtactctatagtgtatatcaaattcaaacaatcgatgaagtgcctcacaggtcgaaacaaatcttgcatccatgtattctaatatttcatcacgtggagcaaggtcatgattcggtgatgcatttgttgtcttagctattgtttcgaagtagattttagctcggtcttggcctttcatgatatatttaaataaatatttatcaaatttgatttgttacaccactcaacatttatgtgtgcctcgtattttttaagtaatttcatgttataggggacaacagatctattatccaagggaattccattttttataatacatcgtccatcatttcttcgtctataaattgtaaaaccagcttcatcaataatggtttcatcttgaaaatctttagggtagtttttttttagcatttatcgttttttatgcaaggacaacttttgtttgcatcaccacagggaccatgcatcatgaactcgctaaccaattcatatcctagtcgatcagtgtcataatcgggtatttcagcacatatgaagccatctatgatagatgctgacacgtcagcagtgggagctgcgagccaaaccaagcaatgtatgtgcggaagcccacgtttctggaactcaacagtgtagaggactgtaataacttaagagagaatactatgagtgtgctatccttaattcaatatattctatggaccaagagggtataagaatacctgcaagaactttaccaaaagttctgccctctctaatatcagctatgaattcattaaccttcatattaaatacacgaacaatgatatcggctctatcagatggttgttgactaggctcaaatcgaatcgcttcagcaatttcttgccattttgaattacatgtatatgtcacaaagaggtcaagtgatccataaacacggcatattgtcattgcatcttgatagttcatcaccatataccttctccctccagtgaaactggcaggaagtatgacacgctttccaattgaatcaccatcagtgacacctttatcaatcgcatctacgatcccatctacagactcaccacgtaactctttttgatggttgtcacgtcccaaaacgaccctaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaagttttataaaaagaaaaaccctaaaaagtcccccttccctcccttgggccggcccggtccatctctccccccctctccctctctcctctccccgcggcccatccggcctctccccgcgcgcgcgccgctgacgggcgggcccgcccgccaccctcgctgacgggtggggcccacccgtcatccccttaatcccgccgctcccgccgcctcccccgcgccctagcgccgccgccgccgcgaatcccgccgcctcccgccgtcc

SEQ ID NO: 73826 - DNA, 54958 bp, Oryza sativa
cataccactacttcgccttctcgctaccgcatcgttgcgccaacgcttggtctccgcgaggaccgcgactccgcacgccgtcttgcactctcgctcgttaccgccgtcccgcactgccacaccggccaccggtgcacgcgacggtgacgcctagccaccgcccggcgcctagcgacgaccaacgactggcccgatgccgcttgcagccggcgcccagcaactcgcttctcctcgtctcctcctcgcctccagcctcctcctgctctgtgccaacgcaacgccgtcgctgtcagcccgtcaccgtcgtcgccttacgtttggtccggccgtcccgctccctggcctggccggtagtccgcagcacaggcacaacagcagctagcaggctgcaggctagcgcctagacgcctggcgccaacgagtcagcgacctcaggggtaagccggtaggggcagcagtagcagttggaccattttaatcaaatcatcctcttccttggaccattttattgtagtcaagtaacaagcaaatttgtttgttcctcttgcaaatgatctgttcttgctgtctagatcagttaatcatctgtttaggttaatggaaatagtaggtactcctagttaacactgttctactgtgaaaatggaaagcatgcgcagttacttgcatattatttatttgtcctactgcattttttggtgtatgatgaatttatatatgatgcaaatattatttctttgttataaaatggtttttttgcctcaaatatatttttatgcgattacggcataaatacggtctttataaagcgaacattttcgccccatcttatttttaatcctgcgtccgccattgatataacccttccttcgatgtatatttaaactaagtgattacgatagatcggtcgccatgccgagacagtataaatcacttaaatcgaaatatacattaaagcaggggttatatagacgatcagacagatctagcatgtatcggttaatactccgatactactttagactaagatattaaaataagcaaaatatattaaacaagaagcctaatataccttaatgcgacaagatcttaatataaatgacagatctagcatatcaattaaacatataaaacataaagtagctaaatcaggtaagatcggctgaaaacccgatgctatctctctcgataatcataaaacaagccagatatcacaattatggatattactcaacagatcgaacccaactgatgtaacattaagcataaagataaatataaaatctaggcaagatgatgaaaacctctaagagatgatagatacacgatataatctagattaataacgaaacataactctatcgactactttctaatagtacaaaccagccgatgacaagttatatagcgcaactaatagagattacaaaacgcatatgataactcgacgaattatataaacaagattagagtgtcataaagatggaagcactaatcctgagaacgcaagccgtcatgataagtttacctctagttgaagatcgtaatcgatgcagcttaacccgaaaagcaagaactcgtcgaaatagaacgaaagtgaaaagggtggtgatgcgccgaaagttttattgaactgttgttgtaaattgcatgggttcgggtgatatttatacccaagatacatgatatgtccttgccggacacgactcttatctctaacaaactctaagatacacataaggctttgcggctgactcttgcctaaacatatctctaaggaaactattcaaaatatcctaactaatagatacaattgactatctgagagcttatctccatcatgacaatccttgtgtagcacgttaaagcagtttcataactgcctctagcaaaatcggccttatcggctgtatcggccatatcggctgtcctctgtctgatccatctcagccgatgcagtatccagccgatgcacattccgttcttcgaatctaactctttgccgaatccactttgattccaatgccgaacctggttcatatcttaccaaatttggtcgttaacacatacgcgataatgatatgtttcaatgcatgtcttgagcgtgtttcacaaaattcctaaaactactgccactactctctctcctctctcttcacctcgtccatgcatacatgcatgtattttaacgagcttcaaaatgatttttctcttaaattaattatccgatcacaccgttgtattcattgtaattaaatctttacaacaagatatcgcatgactatattgcgatgaaagaaaaatatatgtttcaaaccattaacactagtttcatatgtgatagcggcatgtttcaacgtgtattcaccatgtttcataggatttttaaagatttcaattgctaattttttgtttcaccatatataacttgatgtttcactcgttggttaattgaaacatttgaccgaccgaattatttttttggcatctggcgcccgatgggaagattcttcctttaattacagtaaatcatgaattagggattgattacaatcatgcatgtttccgccgtgaccatgtttgcgcgacgacgacagacgacagctaggagcattgggtcggacatgattctgctctaccggtgtccaactaaacccattaccatccctaattaggatatcatttgtgttatataaaacgtaaaatctaaatcgagaacgctctcaatttagtcacagtgagcgaccctatcatccaatcagccgttgtccagatatgtctcgaagaatcttactttactatagtactaattgatcaagcaagtagaacaaatattcctatcatctatgcttcaaataaaattttcttttaaattactcattcgatttacaatccgattacaccgttgtgttcgtaacaattaaatctttacaacaagatctcacatgattatattttaataaaaaaccacaaattacttttataatatatctaaattacttttagatttcactaagttacttcttaaatatataaaagtaaattgaataaagttttaaagtaattaacatatattatatttttgttataagttacttttatattatatttttgttataagttttaaagtaattatttttaggttatattgaattacttttatatgtctaagaagtaacttagtgaaatctaaaagtaatttagatatattacaaaagtaatttatattttttcatcaaaatataatcatgtgagatcttgttataaagattaaattgttacgaacacaacggtgtaatcggattgtagatcggatgagtagtttaagagaaaattgtatttgaagtgtaagtggatagtgtttattatagatggagtggtagccagctaccactagcgctaaacaatagcgctaaacaacacgatgcacgctaaaaaacagagggagtatgcaaatagcagctgtgtagcgtagggcctgttttggggaggttatagcaggtgcagcttctcacgaaatcttcagctttcccaaacagtttagattatcacctagattctaagaatttgtaattgtagaatcttcagcttcaccaaatagtttagatagaattcagaaaataaaagttagaagcaaaaaaaaatccagccttttagattctcatagtctggctaccgaccaacaaattctcgtaaccttaaactttctaaacaagacggtaaactagtttcaaagcaaggctttgcttttttctaaagaaaaaaaaaggaaagaaaattgagaaacaattaaacaacacaaagttattacgattatttgatacaaatgatatcccatggtaagtgaaagtacaagcaagaaataacatacgcgacaacttgacgatcgaccgaatgtctgcaaataacaaaccagtaaacagtcgacgatcgaccgaatgtctgcaaataacaaaccagtaaaagtttatataggctcgtagcaatagaatccgtgctagctcctgccttcttgatgatgtgacaagctgttcatagacatgtagagttcgtaaggaacaattcacagtttgcaagtacatatataggtacaaagatacagcaatcgataggtaggcatatgaatacagaatacataagattttatttataccttgtgtaatgcttatgcctgtgaactgtgatatcatggcctcatggggcgtccagctggctgctactagctggcatttcgtttctctctggatagccataactgtggaaagtataggtccctgacggatatgattctctcctggtcatggatactgttcagctgacttatttttaccacatggagaacttgaagacttcccaacgaaccatttggaatctcaagttcatccactccatcaatttcatgtagtaaaagtgtcctcaagttggcaaaactgttaattgcttgaaataccagcttggagatgccactgatattatggaggcggagcgattcaaggttacacaaatttgtagatagtaggacgagcgaatcatcccttagcttgcacaagcttaactccagaactttaatctgtttagatttgaaaataggatattggaatgtctgctcagccaacccgcccctgataacaagtttttcaagactagtaggattcagggtttcaaagtcaagagactcctcgtccacacgacttgcactgacatgcaaactagaaagacaggaaagcttcgacaatgaagaaaacaatgttttgctggatcggccttctccaataacaacagatagagtagttaactgggtcagcttctccacatgcttctcaaaggtatcacttgcctgcactgtctcgagagtccgcaattctttcaggtagttcacagttttcggggctttcacagctcggtatatgtctgggccttggccatccaatgtgtcagcagaaagatgcctcaatcttatgagtttgcctatccaacttggcagttcatttattctgctccccctgaggtccaaagtttgcaggttgtagagattggccatggaagatggaaggcatcgtatttgtgattttcgcaagccaagatatcgcaaattaaacagctggtagccaatacctctgggcaattcttcaagtggagattcttgcagtttcagaacagtaagatacttaagtttggctgtcagtgatgccggtaaggacttcaaatttgcagcagcatttctgctggccataagagtccgaaggtacggaaaatctactaatgcaccaatatcttcagggttttccgagataaataggcagcggacattggtatccatctctgctagtttaccaccatggcagatagctccaaattcttccttttgagagatagatacagccagctcatgcaccacaataggcatcctgcaacttgctactctaccttgttcgtccacatctacaacctgcagaaatccccagtggattagctcctttatatagcgctcaccaatttcctccacttgcaatgatccctggttctcgatgaaaccctctgcagcccataaccggacaagactctcaggcaacaggagaaaaccagccggaaaagtactacaatacaaaaggcagttcttgagatgcattggaaggttcttgtaactgagatatagtactttttgcacattgttcaggcttgacttgcttttttgaatatcttcaatttgttgagccatttcactccagactgactctgttttttgctttgagctgagcaatgctccaatagaaacaattgcttggggaagaaaattgcacaagccaataatcttcaaagttacttcacggagttctatagggcagtcacttggtcttccaaaagcctttgtacagaagatatcaaaactgtcattaggatgtaaacaagtaagcttcatgaattccttggggactctcgccgagggtcttacaggttccagcgaactagatggtgtttgggactgtgactccactgaagattcacttcttacaaaagcaacctctggcatccgagcgattatgattatccggctgcccattttattatcagaagctgcacggtgtaccttgtgaaccatgtctggcacccatacatcgtcaaatacaaacaggaacttgctatcctgattttccgtcattactctcagtgaggtactctcagtggaagtgccaacttgccttcctagttcttccatcatcattcttttcaaagcatcagtgtcagcattgggacattgagcaatggaaatccacgcagaagtactgaaatacttcttctcactagcataaacatccttaacaagatgggttttccctgacccaggctgaccatacactgcaatcacagaaagagctccatctttcgtcatatctttactctttagcgattcaatcagttcttcctttctttcggcatatcgcttagtatctatgttgttgacatgaggaccaaacattgatgatgaagaagctaatgaggtttccttgtccacttgaacccatcgttttttcattttggaaagatgctccagctccacctcaatttctttcagctgagcagtgaagcgatgtgaggccagtataacctgtactctcttggtaagtcgatattgtttgctctgtacaatatagacaatatattcgtccattatttgttcaacaaggcatcctagtttccgtgcttccccaatccaactttgaagtacttgcttgttatcatatcttgtttctatttgagccaggaagcaaaggatcatgcgaagttcactttctattcgcctcaatctaccttgaagttctgcttgcctaagaactaatatatcattactattaataatctcagatattactctggtaagagatctaattagaaaggatcctccttcaaggccatgttccaaagctgatcttccttcaaggtcatgttccaaagcagtagcacttctctctcgtcctagggcaattcctatttttctgagagctaggtatattgcagtttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaagatggcatctcatagtcgcgcgaacacgcgactccgagaggctaatctctatgtgaaatctaaaagtaagttataaaacaattatcaactagccaacagaagggcagtctttttatgactgatacaatagacttacaaagaatgacatcagaattctcacttgggaaaaaaatgataaaagtacgctgtttaaaatgtggtagctattagatgatccatctattacattatagggatttgctattcataactcaactgaaatttttttgcaagaaaaatcagattcctaacctttggatccggcagagattcgtgctccggcgagattcttgactctggcggccgtgcaacaacggcaagagcgccggattaggtttcaggtggggttggggttagggaagggggattttggggagagggtggatccccgggtttagcgggaggccagcgaggcggctgaccggcggtgcgtggaggcgccgccggagccgcgggctggaagcaggcggtgggcggagtaggcagcgggggcaacgagaagtcgagtggttaggaggcggcggccggatccggcggcgctatgctgcggagacaggggagggtcggcggcgcggaggcatcttgccggaactgtaggagacgacgaccggcttcgagcgataagaaaatcaatagggaggacggaggaggtagccagtggcggcggcggcgtcttcgaggcagctgctgcggcgcgtgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacggttttcaggacatgccatctaattcgcactactttcagaatacatcattgggacgcgaatcttcttcattctacgccactccgtccgccgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggcgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggctcaggtaaggcagcgcgggcatgtgagtcaggaagtcgatcccgtacggcggcgccgctcgcatccgtccgccggcgccgcccgcgtccccgtccgcccgccccgccatcgcccactacccctcttcaccgaatctcgcgcgtctcgccgaggagcaccatcgcgcctccacggggaagatggctgtgtcggcctcctcgacctactcgacgacgacctccaccacgagctcctcaactagggcgattttgtccaggcggcgtgtcgggtgttcgctcgcagtggccgcgttgagcaggccgtcgccgcggcggcggatggacggggactgacgcagctgtcgtcagaggtgccggcggacggacggggacgtgggtgcgcggcgctggcggatggacaggaacgcggcggcaccggcggatggacggggacgcgggcggcggcaaacggacggacgacgacgaggaccgacgtcggcggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaatagcaggctattagccagctgtaaacatattttagtgagataaaagatgagagagatgcgcaacggactacaaatctgtagccagctgcagcgcggactccaaaacgcaatatgtgtatgacaggtggggaaccatatattaatagtatagtaagcaactattatatgaattggctattagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggttgggaacaccaaccggacaaaagatcaaaccgatctttactcccggttgaaaacaccaaccggaactaaaattcgaagcgtggtatataatccatatcccttatcctctcctcaacagatcgaatctctcccttctttccctccctcctccgcttcctccatcctcatcccgatccatcccctccacctcctccccttcctcatccgaccccctcccctctcctccacctcctcctctccccttcctgcccatcctccccttcccctccacctcatcccctcccctctcctctacctcctcatctcccctttcctgcccatccacctccccttcccatccggcagccggcggggccgtggccggcggcgggtcggggcagcggggccgcgccgggcggcggcaacggctttattttctcttttttttaatttgtgattcacatgtataattttatgatttattggatgaatctgagatgacctgtgatgtatttgatttgtgtgtaattttttaggatttgtgatgtatttgacctatgatgtatttgatttgtgtataattttttaggatttgtgatatatttgatttgtgtgtatatgtaaatttaagatttgtgatgttactttatttttgatgtggatttgggatgttactttcatttggggatatgcttctcacttgatttgggagaaaatagatatgcttcctacttgatttgggagaaaattaaaaaaaaaaagaaaaaggaccgtctggaattgccgctattctctctttactcccggttggtgttaccaaccgggactaaaaagagggatctttagtcccggttggtaaagatccatctttagtcccggtaaaaatagcgatctttagtcccggattcgtagtcccggttgaaaaaccgggactatagggggttatgattcgggagtaaaaagtacttctctaccagtgcttgctctaacggggaagtaccctcagatgagccatactcaatccaaaacttgcactcccgaacaagttgaaggaaccacagccatcaagtcgaaggcccgatctctccaatgcatgccttgacttaggctatgtgtagttccccaaaaaaaatttacaccatatcacagaatatttgaacatctacatgaagtattatataaagactaaaaaaattactaattatacagattataagatgaatgttttgagcctaattacttcataatttgacaatatggtgctacagtaaacatttgctaatgatagattaattatgcttaataaattcgtctcgcggtttattggcggattctgtaattaattttattattattatccgaacaacctatgtaacaccttatataatacccgatatgacatgctaacattttacatgcgtgaataaacacccccttacaccctcgcctcgaagcagctcgtttcataggggtgagccgtgagcgattgttgcagaagaatcgcgccttcttgcatcttgcaaagtccgtccttgttcgctttttctgccggggttcgtatcctctgcctttgctacgtaatggcagggagtaacattctctctatcctagccctctatccaatatcaacggctgataatataggatgtactagttggcacaccacataatagtgattgtagttagcaaaacctcacgctggttggtttctatcctgggaaaaatattttatagataaaattttgatatggatgttcgtatagatttaaaatataaatgatgaaaaatataagtatagtaaaaaaaattaaaattagttgccagtcccatctttaagatacccaacccgtcgtatactgcaatattttacacttcatctttaggttgtgttcgtcccaggagattgagagaagatttatcttgtttttcgtatactttcgtatacttcatctttaggttatttatcttgtttattttttaagtttgaaatgattaatacccaattaattatatagtcataacttacctcattttgcgtattatctcaatattctcttttcccctctgattaaacactccctcagccttaagcttataagagtaagcgaaaatttaaattttaaatgctttacacttcatcgtttagtctacaccttatatgagtaggtgacattttaaattttttattatactttttttcatcatttatattttaaatcgttatgaatatctatataaaaaatttatctataaaatattttttccccggctagaaacctacaagcgtgaggttttgctaactgcaatcactattacgtggcataccaagtattacgtgagtatgttatcagccgttgatattggatagagggctagaatggagagaatgttactccctgccattatgtagcaatggcagaggatacgaacccggcctggagagggtacgtacgtgtggccaacattaactgatgtggtgttgcggctcccacatttcgagccgagactatatgcggtagttatgtaagtgggtagtctcgctatccgtatagtaacctacttgctagtttatttttcgtatgttagtacaaaacttaaaagaaaaaataataaaaaataaactagaagagagataagtgggaaaaaacccgcttacacgtcccgcttgcatgtctacttgcggcgttctgtgttgtgcatggtcttattttttctaatgcagtgaggagaaatatcatctactctaaaatataaagataaaaaaattatgttgtttagcaaataatatctcaggtcattacttttacttatttcagttatcaggttttaaactttgaatggcttagattctctttctaacttctaataattggctttcaaatcatggaaataatgggcatcatgtgaatcagtaaaaaaaatgcttatactattgtataaaattcaaatattgaaaatacttttattttaaaaggaaggaaaccgtctatcgagtacaatgagcatgggtagtagtgtatacccatacctaccagataattttatgtgcacagacatacccattgcacatgtgacgaccagagatgaccttgcccatgcccattagccgcaggcgtcacgtgccctagatctgcacatttacccattaattatacttacataacataaacaaagaaaaattatatagctaataaattcactcatgtattaactatataattgtgtttaagaggataggaggagaaaaggagaagaagatacgagaaacgagatgagcaactagctcataatatttgagtattgattatttcaaacttaaaaaacaaactaatataatttctaaaataactttcgtattttttctaaaaaacatatatagtttagcaattcgagcaatgtgctcacaaaaagacaaccttttctttttctgtcattcaaatgaccctaacaaactaaggctgtgttctccggcacgcaaaacgaagctcatattatcacatgattaattaagtatcaactaattttttttgaaaaatagattaatataattttttaaaacaactttcatatagaattttttttataaaacacaccatttagtagtttaaaaagcgtgcgtgtgaaaaatgaaagaggtgggttgggaaaatggaggaagaacgcagcctaagggtaagttgttctagtttaatagtagagctaactactactgcctctgttttcaaaataagtttatttttcattcatcttacacataccaatacaaatacaaaaatacctctactttatcagatactaatgcaactattactcactttatttacttccaacacaattattcgctactttcacaaactacgatacaatgattactttaaaatgaacttattttgagacaatgtaaggaactaaaaaataacttactatgggactagtgaagtagctattaaagcaagttttataatataaccaactactacctaaaaaaattaacatatcatctacacttgctaaggccattcccaactcaagatactatggcccgtttggcacagctctagctcccaactccaacttactagagccggagctgtgacaaatagtccagatcctccatttttgagagcggagttggcagagctgttccacaaaattgtactatgggggtggagctgggtttttctgctccacagctccactccaccccaaaagacacactaccctttaatttttttagtgtattttcaccaaaattccactgaactaccccttcctatccgatctcctcctgttctctctcctcctccgtcttcttggatagcccggcggccagcggcggcgtcgtcggcgtcggcagtggccggcggatggcgtggcgatgagggccacgggcggcggcggcggaggtaggcgcgcgggtggtggcgcggggtggcggtggcggcggcggccggcgagcagactgccagcagcggagcgggcggcgacgcgcgggcttagcagcggtagtggcggctgcgcacgggcggtggcgcgggttgacggcgcacggccggcgcgcgtgcggtggcggcggcggcccatgggatgagcggtggcagcgacgcctaccaggtgtttgacaaaatgccaacaagggacgtggtggagtagagctaaccaatctagccaaacactttctattccacttcagctcttataggaaccagctctaactggacttggagtttagagttgggagttggagtttggagccctaccaaacggggtctacacatagtttctataaactttacatcatcaagaaactaatagtagacactactctttcaatgcaaacaccacttttccatatttaaatttaatgctacttatcttacatgatgtcttggatgttgtgtagaaaccatgtctcatgcaagacctggtttccttctctttcctcatttattctcttgccacatcatctttcattctaagtgttatgtataccatcctagtaattgggtcgggaatggtctaactaaatagtccatcatacaatagttaactatcgatacatattacactattaatgcataccttacatttctctctcacataggttatcggatctcgtgctgtaacttgctacaaatatgtaccccctatttcctctctcatctcttttttccttcacgtacgcacaaatataacgtgacaacctatatagtccgcttccatcattttattatgtccattttctcctcctctctttttctcttaccatgaatcaaatacatatatattataaaaatgtgtagagttaactttgcacgagagtgaacactttacagatgtctattattattctagtcatttgcttaatgcagtcatacgtaagtttgtggagaagaaaagcacctcaacattattttgtccagatttattgtactaggaggtcgtattctcttaggttggcttttttttaatggatggagtaggttagatggttggaaccctggaaagctcctcgataccagtgatgtcacatggaacctcatgttggagtagatctgctttatagggagagatgcttcacatagggagagataatagtccggtgggttaggatgaaatagttttttactaccgtcctactatttcctccaacttaaaatataaaaagctaaaattagatcagatattctttttagtattataaatctagaaagattgtctgtcagtccaaattcgtactactgaaaatctgtccagattcgtagtactagaaaaatgtcatatcttataatacgaattcaatgccaaaaatcagaaggagaatggtgccacgtggcaacaccggttttgcaggctcgacgaaacgtgcgtccgcgcgtgcagggatcgatgaaatgctcttgcctgcgtgcgtgcgtgtgcaccggtcgtccagaaatttctccccaatccggcgcctttacgtggatgagacgagatactatgcatacagtgcaaacacgttaatttctcacattcccaccgtagggctggcaaagctcagtcaggcaggccgctatttcttgtggatcaaagaagtaataatacctactttagttagagattaaaatagggttagcaggatataattaaatcatccactaaaaattcctacgttccaaagatccatctttttaagttttctatggtttttattcatctgttttacacacgtatttatgtgttttatattccaaatattttctttcgtgtattttgtttttctgagttccaaacataccttagcctatgtttaagaggagagaaagatattaaggagataagtaaaactaggtgagccattatcgcataattaattgactaataattattttaaacatgaaaaatatagaaatatgattttttttataaaagggtaacttttctaaagattttttaatgtaaaaacacgccgacatgtgggtgaaaaatgatggacgtttcctttatttgtccctttgtcgaatgcaaccttagaacaagtacaatataaagcaataagctagctattgaacaaagaaggagagagaagaaaagtggactacatataaatatttaggtgcagtatgagctccaagatagtatgtgagaagtaaccacccctcatgcaagtggtaatttcttcacaaactctaagaaaagaatggtgtggtttggatgcaaattgaaaccaatatgctacatcttaattaattagttgatgatgtgaataaatttgaggtcgtaatcacccctgctataaaacttgcttataaaatttgctcttagagcaaagataatagactaatagtgggctataaacttatgtggagaatagagatttaaaaaaaacagtgttggctttcaagtaaaatctagctctacacatgcttcaaggtaaagaaatagagagacaatcttatagtcaacttataagctctaatataagcagctttagttatctctactattaatctctggctcttttatatatgtgtattaatttgttacaggcccaattggccaggctcagtataccatgcgtggcaaagccgcgcgctttttctagtccaatcttaagtttttatattttgggaaaaatgtactatatgaaataagaatggtctaaatatcttttatttaatggggtggactaaaagcataagtaggaaaaagattgaaagaaattctgaatggtgaatgattgtggagagaataataatactagtagtctacaaaatgtaattattctcagataagtttgagtgctaaataatacttatagtgagatgaaggtagtattaacgtggactcatgtttagagctctttaaatctaggattttatttatttattgagtggttgcacgtaggatacgaattattaaatttcaatcatatttttcatcaatccagtggttctcagtactcctatttttatttcttattatgggaattgctaactgtctgttgttgacagaaaattgatggttaaatcttgcacttgttaaaccgttggatgtgttcgggatcgtgctagccgttcgatacaccgtgatttctgagaaaaagagaaaagcaacgcacaaggagggatcgatcctgtgatctcatcctatttatacaagttacagtatatgctaggtacatatgtaattataatacaattatacaattatagtgtaattatgaaaattatattgtaattgtattgcagtaacatttgatagatttttaggatacttttcagtcccttttcttatataaaaggttgacagatattacaagaaataaacttactatttatacattacaaaattatatgaaaaaaatattcaaaccatgataaaaataaagaaaaaaggtatataccaacaaaattacatgtaaaataccacttcaattttaggtatatgaatatgcaatcttatgtgaataaaaatttacaaactttcgagcacataaagatttagcattgccccgagaagaaaagcacctctattcatgtgcagtcatatgggagctcgtgatcacatcgatacatgagctcgtgatcacatcgatacatgtgctgtgacatgtaagctcttgatctctgctttgcacaaaagggagaatattgtactattggttgatattgtacttctattcatgtgcagtcatgtgggagctcgtgatcacatcgatacatgtgctgtgacatgtgatctcttgacctgctttgcacgaaagggagtatattgtactatttgttgatattgtacctctattcatgtgcagtcacgtgggagctcgtgatcacatcgatatatgtgctgtgacatgtgagctcttgaactactttgcacggaagggagaatattgtactattggtttatattccatgctttgatggggaatgcatgagagcaagtataatagagggctataagagcaagtgccacattggattgagtaataagatggaggagagaagtgaggagagagatgatgaaccatccctaagtcaagaatcaacctccacacaaatttcaagaagagtgtgagagtattagtgacattgatatttatgtactagaggtgacatattgtatgtgttgcctcttaatttacgagtgaatgatatggataaatttggatatggtaatcacatttaccataacacttgccctaagaaggctgaatactgaggtgtaggctgaatactggctcggctcggcttgcagtggctcacaacaagctaggcttggcttggctcggctcagttagggaaacaagctaaaacttgagctcggctcgtttcctagctcgagccagctggagctggcttgcaagccttcctgttaaaacatctcttcatatatattttgtaattattaacaaaaaagcaagagcaaatcatcgacatgtaaaattaaataagtttatatattcaattcttcaaaatcttaatgataaatttaaagttgataaataataactccatgaaaagcaaaataatcgatataaacacatgatggtctaggttcgcgagccaaaataagcggctcgcgagccagctcgggctcggctcatttcaacaacgagctaaataagaggcttggacttggctcgtctggcttacgagccgagccaagccaaccaagctcgagccaagcccaagctgagctcatgaatccgagcttttttttccacccctattgaggtggccgaaatctgtgagacagacaggtggaccatatatttatactgaaaagttaaccactatatgagtaagcttagagataggctataaaaatctatacagtaagcagttggctgtattattggccttgctctgaataaacataggttagggcaagtactataagcctctacatgttgctcctaaagatgtcacataggattaggtgatgatatgaaggagagaagttagaagagagagaatgtgccagcctcatacaagaggcaacctccacacaatctttaagaaaatataagacgatgtgagaattaataaaccaatattgaagtttgtgtattagatgtgatatgttgtatttgttacctattaattaatagaacttgcccttaagtagtagtgctactatcaaaatgatagaaacatgcatgttaaaaatattgtacaaatgatgtgcagttgttgacgtaaaatctaaaagaacagacggaagcgtgtgagttctgcttagctttagtataggtcctatggatttcagaatgtgttagttagtttgatcatacaactaacaagataaaatacagatagattagattaaaatgacccgttggctatttcggtctatatggaattgtgggcctaaccgaaaccaataagattcaggtcaacggctatataactgatagagtttgttattcatactatatattttcctcatttctcttactcgttcaaaaatcgtacacacaactaaagaaaattttaatcatatatacaatttttcacacggttttatatattaataaaatttatgcatgtcttatgtataatgaaacataatactaaaaccattttatatttctactacattcatactataatatttcttgagtcctaacatacatagtacctaaaaattctaaacttctcacataactaaactatttatatgtaatatatgcacactacattaattattacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatcaagatctttatgtggtatttgcttaagggagttgtgttaaccaaggataatttagcaagacgaaatttgaatggtaatttaagatgttgcttttgtacgaaaaatgagtatatccaacatttgttcattgaatgtcattttgcaaagtttatttggagagcagttcagttttcttttggtttatatattcctactagcatatctcatatttttgatgatcggctttagggagttgtaaacaaaaagagtaaactgatacttgttggagcttctgtcttgtgttgggctttgtggttgagtagaaatgatagggtttttgacaaatcacctacaattacttatatgcaggttattttcaaggcaatatattggcttcgtctgtgggcacagttacaaaagtatgatgaagatgaagaattcctaattgttgtgtgtcgtatgcttgaaacgacggttatacaactgtttgtcaatcatggatggagatttaccaatacactgaaataatgttattttatctttattggtttccttttaattttaattttggttggtgtgtttgctttcatttggactgcactcttacagagtgctagtttgtaataattggctgtaactcttttgagtaaaggtcgggatgttatttcattccattattaaaaaaatatattttgtatctgtgcagagaaataaagaaaataaatactattgatcaaaagaagcctaacaagaaagcctagcacactggctccctcatcccacctgtcttatcttctcattatgtaggcccaatagcccaaaagaaggggcaaagtcaacctagaccaccactggtcgctgttggttgttccaacttccaagtcgcaacatgtccctccgtcttgctcatcaacgcaacgccgcgctgccgtcgtgcacgcgcagatgtggagtagcccgcggcgtgccgacgcctatcgaggcctcaccctcaacaggtcgcggacgcccttccctcgctcggtcaaaccctctctctctctctctcgtcatatggcccgccccacgcctccggcaccgttggtcgcgctgccgcggccgcttccgcacaacgcgcggtgcaccactgcaccccctactgcccctaccaaatcgcctcgccgaacagttccgattcgattcaataggtaacccgttcaatctacattctcccaatgtgtttaatgtgaatatctgaacccaatttattttttagattgtactacatatgttttttcataaagtatatcccaataaatcaagaaaattgctgaaaatcttgacgcaagttctaattcaataagcagtactaaaatatcatactgttgatcatacataccaaatattatgcttgtgttgtaaaacttttttttttacccctttccatttcgaatacctaatttcaaaatcctaggtccgcccctggcggtaccgcatggatgccacgggaccgacatggtcccgccctccaccacgttgccgcacacccaggccgcagcattgacgcggtgccgcaattctggcctacgggaccaaagcggtgccgcacgctcatcttacgtgaacgacccagccgactgtctcgcgtggctacgccgcaattacgtagcgctcccgcgtgcccatcatgccgtaaagagatatatttgtgcaaatctttcccatacatatatataaatgcaaaatcttaaaaaaagttatattttcaatctattatattattaaacagctttaaaatgaggcaccacgttcgctgtgggggactaaaatttcccatattaaccagagaaaaagaaaatgagagttcaagtaaaaatacaatttaaaaatagctgaaattcagaattaaaaataagcaatattgagagaagagtcaatataaaaacccgatacgagattaatcaaaatttagaataaaaataaaataaaatccaaaattagaaaagaaaaggagagtccatgtaggaatacaatttaaaaataactgaaattcggaattaaaaatcaggaatattaagagaagagtcgatataagaacctaatacgagattaattaatattcagaatctctatctctatctctactacttaaaataagaggttcttccgtcgtccgtaaaaaaaaaggggcgaaaaaaatcagtctaatccaaaacaaaaataagaggtgcttccgtcgtccgtaaaaaaacgggcgaaaaaaatctgtctgatccaaaacaaaacgggcgaaaaaaacggacgaaaaaaaccgggtgaaaaaaaaagaaaaaccaaatctgtccgatcaaaaaagggaaaaaaaaggaaaagaaaaacgaacccgattccaaggtaaaaaaagggcgaaaagaaataaaaaaggaatctgtccaattcctaaaaaagggcgaaaaaaaccaggtgaaaaaaagaccagcaaaaaaaaatgaatctgcgtggacgcggtaaaaaaagagcgaaagaaataaaaaacaaatatgtctgattccaaaaaaaaaaagaattatatgtgacgcggtaaaaaaaattgaatcctattatatttgacacggtactatatatctctatcttatctatatctactacttaaaaatttaaaatgtttctgttgtccgtaataatgaaaaaagggcgaaaaaacattagaacaaataaaagaaagttcgattcaatttacttccgtcgtccgtgaaaatcttatcttatcttaatctcaatctttccgaggggacgagcggtgccctccgtcctcacccgcgggatgaaacgccagccaaagcaaaaaaaaaacgaaattgagcaaagggataaactagattgaagtttccaaaattaaaagagggtaaacgatattgaaactcccctaactcgtaaagagggaataaaatagattgaaatttcccgacaaaattctctaaattcgaagaactctaatttcgggtaagaaccataagagtcaaatccaaatcaattaagttaagggttcgggttacttaccggatttgaagccccagagctcaccggagctttccaggaagcggcaccgccgcaccttcacctcctcgcagtcgtgtcgggttccctgcgcgcacgctgtcctggagcacccctccaccatcctttgctgaagacgggaagcgtcagcttggcgtcacccctaccgtcgacgaggtccaggctgctcggtgctcgtcgccgtttgcacgcccacctagccggaccgccgacgtcgtggcacggttttgcgtcccccagccggcgaagcaggagccgctcggcggtcgtcgctgcacgcgcgcaccagcttgccggaccaccgtcattccactcgctcgtcgccggagagaaatgggatcatgagagggatttgggagctagggttttgcccctctccccggtcggtgcttcattcggcgcggggacgattggagccgtccattagatcggacggcttagattcgcccagcgtcgggccgtcgccgccattgattatgctacgcccaatgggccgcggaagtgcatcggaccgtccccgcatatgtaggtcgcgcttagctgctcagcttgtgggccgtcgaattgactcaactcgccaaagatgggcaagcccaagtttgggccggcttgggaaggcttgggccgaaagcaaatttgatcaaacaatgtggctcacatttttcaaattaaagtccgtcggataaactgctaagtaggctcaaaaaataaatctaaaactaaatcctaaatcctatgctaattgatcaaattagactcggttctacctatttgttaatatatcaaattatacttgatttttacagatttgaggttttcaaggtgtcacaccatcaaacggtgtttttcccgttgcaacacacgggcactattgctagtaaaaataaaaataaaatccaaaattagcaacaaaaaaaaaagaagagttcaagtaggaatacaatttaaaattaaccgaaattcggaattaaaaataagcaatattgaaagaagaatccatataagaacccaacacaagattaattaaaattcagaatgaaaaataaaataatatccaaaattagaaaaactaaaagagagttcaagtaggaatacaatttttaaacaacttaaattcaaaaataaaaaaaataaattatgaaattagaaaaataaaaaagatttcaattaggaatacaataaataactaaaaattggtgataaaaaataaagactattgaaaaaaaaagatcatctaaaacacatgacgagataaattaagtaacaggtctataaagaagtagagtggtggcggttgatacgacatacaaaaactattaataaaacacaaaatagaatcctaatgacgattaaaaggaggaacgacaggcagaccgtgaagctaacgggcaaggcggttgctgggacttctagaaattaaaaataaataaatcccattgataataatattcgatatttaaaatctcaatggcaatcaaaaggagaagcagcagacggggtgtataggagtgtagttgcagagccgctgacggttggcgagacttctagaaaataaaaaataaaaaatgaattctaatgataattatgttcgacttttagaatcccaatgacaataaagagtaggcggcggatgggtcgtggaggagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggtttcagggagaataaatagaaatagtggtagattgagcaagcaaataaagaagcatatgacagaagtaaagggtagcaactggtgtgacttttaaaaactatataattagaaatatagggatgataagatttggattttcaaaatcttaagacaacgacatagatatttaataaattttaagtaaaatcatactaaaaaaatatatgattttgtttgggtgctagccgcagaattgcgcggaccacccagctagttttttaaaagtcaccttgcatggcttaacttacacaccggcagttctctctaaaaaaacacaccggcttaactatgtttttgcttttatccctcttccacaatttcaggacaaacatcaggcgcagttggttcttcagactgtgcagaagcagcattactggtttcagcatccttcgtccatactttattgttgtctagcggccaattagctactcctgagcagtgctgagcttcgacaaactccagcattggatacagttcacgcaattcctcccaacaaaactgcagatccttgaggcatctcaagcgcagcacctctactttgcactccccattctgaatttccagactatgcaacttcccaccagtaaaatacagtttctttaaactgtcagaactaatcgtcccaaattgtctcgacgggaagcagtagagatccagctttgaaagattagagggaagaacaaggttaaattttgcagcatctgattcgtcggcagcatctcgtggagataccattccccatgtaatcttcagtgatgcgagactggcaaaattggcaagcactttcagctcatcttctgcacgcttcagtttcttgctaacactgatgctaagtttgcgaaggttgctcaagcttaccaactcgcccagattgcaggtgtttcttttgttagagtttactaccaaaaaccctttgaggacttggagctgagacatcttgttgaatccctcgggcatatcaacgagcaggtagcactcggagacatccagatactggagcttctgcagcttggtgatctcctttgccagcacctgcagatcgtggcacgccctgagatccaacacgaccagctcggccagttctccaatggcagccgggatggccataattctcgatatgcctctcaagctgaggtacctcaggttcttgcacgccccgatccccttgaggtggtggtcgtcgatcagctcgatgtggctcttccttggataggcaatctggtcgactgggtcagccacccgccactgcccgagctgcaccgtgccgagttgcgatctgtaggtgaaccacgcggtgctcagcttgacatagctctggccaacgttgtagatcgtggagagctgcgggtggaacctggagccctggagcagcccgccatcgtgcaggcatgcgcggtgcgtcctagagaaatcgttgtttgaggcggaggcgccattgccatccggatcaatctccaagaacgcgctgctccttgcaacggccacgagcatcctgcggatccacgggtgcacggtgcacgcgtgggcggtgtcgcagtgcccccggcggcggactgtgcgcacgaaccgcaagtcgacgagctgctggaacaactcattgccgtcctccaaggatgacacgaacttttcgccgatccaccagtggatgaggagccgcttttttatgacggcgccctcggggaaggctgcaaggcagaggaggcaatgcctcaactgctcatccataccgtgcacggctcgccgcaggtgcgccatctgctcgccgtcacggacacatctccttatccctgccatcgtcggcgcagaagccgaatcctccacatcccttcctctgtccggagatggttcctcttgtatctttatcttataggatcctgagattgcctccctgatgatgccaatctgtactccgacaccggcgagcttcggctggagcgtggagatctcgccgccggcggcgagggaattgagtacgtcgtcgacgagctcctcgatggggtcgaagaggtggacgatgcgcctctcattctcgcccatcttgacaaagatagcttggagttctctcatcatgtcacggatgctgtcgagctgagcgaggtcggagctgctctcagcgccgcggaagctcttggcgtcgccgatgacctgcaggctggagaggagaggggtgaggatgccgtcgtcgatgtacttggagaagaggatgcatccaccttcaccttcagcttcagcttcaggagtggacatggtggatgcctctacaactactctacttgtgttgctcttctctttcctcgtaccattaccagagtactagactttccccgatcggtagagatctccgggaggggtaagattgtaatttgcacaaaaaaactagaaaccctaacaatgcgtcgtgcttaattgggccgcggctattgggccgacagtcgtgggagactgcgagtggagggaggccctggcgcgggaaaagtacacgcaaggtccctcaacttgttagccagatacaaaatcgttcctcaaccgcaaaactggacatccggcgtcccccaacttacaaaaccggtcacaataggtcccttggcggttttgaccccggttttatcccacgtggtggctgactcagcgtgggatccacgtggccccacatgtcagtaagccatgtcatcacctctctctatctttcctctccctctctctctctcacttatctcctctcggcaggctgggcgggccgggcggtgggtggggaggtccccggggtgaggcgggagaggaggtccgacgaccgccgaccggcgacgcggcggcggcgacacgggagaaggggagggcggcggcaacccagcgtggtcgtggcgcccaacagacaggcacgggacgggcggcggtaaggacggtggcggcgcgtggttgtagacgaagccgaggaagacggtgtcgacgtctcccccagcctcagccaccaggaaaggagctgggcgcgggtggcagccgtcgagggcgtcgcggcttcggtcctcgagcgccgtcatggcgtcgccgtcgtcgctgcgttcctcccgcctcgccaccaccgccaagccgacgccgacgcgttcctcctgcctcgtcgccaccgcctagctgacgagctcgctagcctccccgcgcctccgccggccgcgcgtgtggctccagctcggccgccgcggtcacccgccgcttctcgtcggtgagcacggaaaggaagctgatgccgccgccttgctcccctgagccaacgccgacgcattcgtcacgcctcgacgccgacgccggcctccccatgcctccccgccgtcgtcaccgcgttcctcccgcctcgccgccggatttggacttgggaggagctcaccggcctccccgcgccaccgccgattccgcctccgccggccgcgcgtgtggctccagctccgccgccgctcctcctctccgccgcgccgaccctcttccccaccgcgtcggtgacgtcgccgccgccgccgccgcaccggctctcctctccgcatcagctatgatggccgcagccgcgtgccaccatagctgaccgcacgagggggacggggaggccggcgagctcgcaccggcctgagctcgcgcgccgccacccgagagccgttgtcgccggccgcaccacccttcggccgcacgctgcctcctgtgcgagagcagagagcgagaggaaaggagagaaatagagaaagagagaaagagtgctgacgtggcttactgacatgtggggtccacgtgggtctcacgctgagtcagccgccacgtgggacaaaaccagggtgaaaaccaccgagggacctattatgaccggttttgtaagttgggggacgccggatgtccggttttgcggttgagggacgattttgtatctggctaacaagttgagggaccttgcgtgtacttttcccccctggcgcggtcgggtcgccgtcgccgtgttcggcgggtgaagtgtcggccgcggctgcaggcagagggaggcgctggcaccgccgccgtcgagcaagtagaggcctaaatttcatgggccctagcccgtcgcccctctcgtttcggcccaggaacgaccctgatgctctgccatctcatctaatagtttaggacaggaggtatcgaaaacaacaaattaaatgcaaaaccgggcaaatacattttctcagtttgcaactttgcatacaaccaactaatttttgacggacaggtggattgagggtcgctcggtgggctcctcctcttgcagtgcttccttatcttcgggctttgggtacggtcgcctctatcctcgtgggcaactcctaggtaggggacatccgtgacgctctcaccgtaccagtcatctcccaattcctgatgctctaggatgcagtgctccctatccagctctcgccaggcatgacggatcgtcttgtttggcgttggatcagtgaccagcgttattcggcccgctcagcctaccaggttttcttccttgggcaacactccttagcttgcgtcgatgtgctctggcatgcaaaaggccctgctaaatgcaagctcttcctctggttggcgtttcagtagcgttgctggatggctgaccttctgcaaaagctaggtatcgatagtcatttggtctgccccgtctacgctcaagatcctgagacagcgaaccacattatccttgattgtgtgttcgctcagtaggtctagcatcttgtgttgtctattcctggttaggctaccccacttcgtcccgtggtgactcgctccaagcttggtagccgacctctagggcctgtctgcctgagtatcttcaagtgagcttcgactccgtagttcttctggtctcttggcagttgtgaaaagagtggaattctagggttttcaactcctttctcagtctctgtggttctcgagtccatcctccaggaagaccgtctgtggtcttctgctagcaccgcggcctttggggacttgttgggagcgtagtggggctctgccaccaccctccctctctataggagcaacgtttctctagtagtagtttcctgtctttagcaatccttttgtattttctcttttttccttgtcctctggcaatggacatccagccgattgcgttgtgtaacgaaaactttgctttcttctaatatattgaaaaaaattaaaaaaaaagctgatggaaaatatgatccctgcctccctgggatttgccatattacaatcaaggttcatacagtaaagataaaccatcctaactcacaattctaagctctaaacatcaacataatagagtactgcacatcatctagacagaatttatgtagtagccgccatgcaattccactccagttcaaagacatttgcagggcattctctagcatcaagtccagcagtgttctccccgcaaaaaaaaaaaaaaaaaaaaaaagtccagcagtgttctgtcctgtgtggcaagttttccactgcacaagcaagtgagcaaccactgttgccaacgcaaagtatccctgtctgtttccccagaacatagaccgtctggttcaggagttggcggccggcgggagtcgacgagggcggcgaagagttgccggcggtcggccaccgtcgcctcctctggagcggcggtcgtctggagttaacaaagtcggctggaggctgctgttcggcgcccgtagccggccacggcgacggcgaggtgaggcgcgctgctctgcacgagctgcctccgagcgacagatctcgatcctccctagtgtggatctaggggcaaaaacgtccacaaacttatcagagaaaaggaggggaaagtgcatttcgcagctctggcggcatagttgagcacttgagtggtaaaattgagctagctctttctcctcctcctcctcttcctcttcttattcttgttttctgatgttcttttcatttcctgattattaccttctcgagttcccaccagatcggacggagtggcggcgttgtacctgtcgtagagaagaagcgaacggtgggcggccgcaggatgtcggagctggaggtgtatagcttgctgcagaagatggcggcgatgagggacggcggcgactggccggccggtgcggagttggagttgcaggagttgtacaccgtcctcgagaaggtgcagcgcaagatggctcacgcggagccgctggtcgtcgtcgacagcggcaactccgcccgcgccgcctactccctcttcctcgcagaccttcgccgcgtcacgttcaccgtcgaccaagccctcgatagctactccgccagcgcccgccgctccccgttcatgcaccgcgtgcgttcggtggctctgatggggatggcggcatatggtgttttcgcgtttctctcggcccgttcgtcttccctgctgcaggaaaagcttttgccgcagccgctagagctgcgccccaagatcgccagaaagttggaagaggccgtgaaggacgtgaggatgcttctccgcctcttcagtacctacgtcgccgatctcctgccgccgccggagcaccagcagccagagcctggtctcggcgctgaccccgacgatacgtggtctcttgccgatcaaaaagaagccaacctccttgtcaaaggaagagaacaggacagatgtaaggtacggcagatcctcgaacatcctggaacgaaagtggtcgtaattgtaggaatggccggggccgggaagacgaagctcaccaggcatctgctgtgcgaaatgtgtagtgctactacgcatggcttcaactactctctttgggttacagtgtcccaagatttcaatccagaatggatttatcggcaggtgatgtctaagctgagcgatcaattgaaggcaggcgaagatgctgaaagcttctggtggtctctaaattcagatctaaatgaaggcttgatcaataagaagcatttgcttgtgctcgatggcgtctggaacgaagaccctcgtaagtggaaggaactgatggatctcctctacggcaattgcacgcaaaagaccaaaatcatcgtcactaccaggattcctgcggcggctgctgctataagctctgcagtaatctaccacctgcacccgttctcggtggagcataccttggagatgctccaaacgatcaatggggagctgcctgagaagttgctcggcggtggcagtagcaacgctaccgtgtctactgctgcggctaaagaattgagtaagaggaaggtcgcagagaaatgcagcggtttgcccaccatcataaagttcttgagctcttctcttgaatctatctgtgcaaacgaggttgctgatccactaaaacagtttgatatgatgtgtgctggcaaccaaggactgctgcacatcgctgaggccagctataaccatcttccaccacatctgaagcggtgcttcctctactgctccttgttcccatatcatcacatctttgatactgacgagatgattagcctgatggttgctgaaggtttaacacagactacaagcagggaagcccaagtggatggtgatatcagcaggcttcagagtgaatgctttgatcttgtcaataatcctgggtctaatgggggaatcagaagaggatgcatgatgcatcgagtattgcacatccttgcacggcacaaagggcaagaactatataaagctattgtgggtgatcattctgctgctttgaaagaacattccaatatcagatatatgtctctcacagttgatcatacaactacggagctcccagggtcgctgactgcgcacacagatttgaggacgctgatcctactcagaacgcagaagatggtcttgtctggtcagaagtctgaaatcaaagagatcccttctgattactgccgctatctcacatacttgcgtgtattggacctgcaggcaaccaagatcaataagttgcctgagaaagtcgaaatgctctcaaatctgaggtatctgaacctttcccaaaccgatattgacaaactgcctgaatcaattggcagacttcagtacctggtatccctcaacatttctcaaacatgcattgcgacagttccagattatattggcaaaattcactctttgaggtacctcaatctttctcaaactgatattggaaaactgcctgattcaatttgttcgctccgactgttgcaaaccttgcagctatcacgctgtgaaaagcttaccaaactaccacaaaatataggatccgtgacaagtttacaaaggttagacctagaaggttgctactatctatccgagatgcctcaggatataagcaacttgaaaaatgtgaaggagctaaatgtactggaatgtccctcactggataaaatgccttgtgggctgagtgcactaaccaagattgaagcattgccaaggtacattgcaaccagtggtgacaacaatcccatattggagctgcgggatttggtaaaattgaaaagactgggtttggaaaacattgcaaatatttccaatgaggatgccgagaaaatacaactgcaaaagaaacatgagctcgagcatttgacacttaattgcaatatggatgctgaaaacagaaaatcaagttctgaagtgaaggagctactggactgtctagagcccaacccagggttgaaaatactggagatcatttcttatgcaggggaaacgttcccgtgctggatggccaacacaaatccacaacttaagaagctcactcagatcagaatcatcagattgattaatctgaagtgcagcagtctcccgccgcttgggcagctacatcaacttgagactctagagatcagtggaatgaatgccataaaaaatgtcagcagtgagctacacggtgaactgaatgctgatacattccgttctctaaagaagatcgtcttttctcatatggttaacctacaatgttggccggtggaaaatggtgctatatgtgaacatcttaaagagttgtcaattatccaatgcccaaaatttcacaagctgtcgatgaatcttaatattgaaaagctgactctattgatgagtcctcacgaattgcttggcagagaaggattggcaggtgttgctaggagtctaaaaagcctatctatttcactgtgtgaagagctatcagcatcatcaaattgtgagggtctaacgatgctttctaaccttgaggagttaaagatttctggatgtgatgaactggagaacttaccgccgggtatggaaaatcttactgcactcaaaagattgtcagttattggatgccagaagttccaaaatttaacggacttactggaatgcactgctctgagctccctggtcatatcagattgtccaatgctaccatccgtcccacagggtttgagagggatcacaacttgcgagtaaactaacagcggtatagttcaaaaacagatagaagaactctagcacaaatatatcaagtatgtgaatgaccaagcttttgcgtcattttttctcataatcctatccacatacagtttcaatttttagatttatttatagatgccaaaaatgtttctgatcggtatctccaatgtattttatataagtttcacggctatcaagatacactatccttgttactttgcctttattacttacatcgatgatacactagcaggtggattttcattaaattttattgaatagtcatctcgttctcttaagattttaaaagatagaaccattgtcacaccccaatccggcaccgccatacaacagcacctgatagaagcgtgtcgtagcaaaaacggcgcaaaccacttcctacaaaaccacgatatcggtactagtcccagaacatagcgctggtatctacggtgacaattatgaatcattacaatcttgaatttaaatagaggacttatttaccttaacttaggctgcagctctcaggggaacccgataatgcaacagacgacgcggaagcagcaacaacaggagcaaaggcagtggaaaccaatgaatgaatacccaataccacaggcaatagcttggaactaggacgaaaccctaatctttacttcacttcaacttcaccttcaaagttggtagaactatatatagagagagcaaggttacttacgtacacagcaagtcagggaaacttaggtggttattgcaagcttcaaggggaccgttatttttgcaatcgattttgttttccagttttcaacaatctaagtatgtgctttccacaaccagcgtgagacaagtctcagctcggtcgggagtgagaagtaaaccaatttatttgcaagatttgcacacctcccagagttggcctaagctggtttcccaaaccaaaccaattttccaatctttcagagtttggttgcctccaaacaaccagatacttccagggattccctgtcccaatgtctccctaacagccacttgctttttgaaacatcaggtttcccaaacggcaacaccatttcataaaacagggtaaagcaaaaactacgctaagaatcacctcacatccgcccattaccgtgggcaaagctgttcgaatagttcgttaatctctgcaaaggggtacactttacccacatgacattactaacctaggtcacctagcccgtgcagaataaccacgtctggtgactttaaggttttcacgacaagacatttccaaagccggcacagggtcaccatatgccaacgagaggggtctcagaccaacagcaggttaggtcccagaccatgctgtgccaggaagcctaggggttctccctgacaccaccccgacgaatccacttgtcccttggcatcaaggtttccctggcctagctagttactcagccaggggtgttccatttcacctatatggtcgcacttgttatatgctcggatgtaattccaaaggaatcaatccttcaaagcgaccgcacaagcatcccgcccaggaatggacttgtgtcgtgagttttatttttaaaactcattttctttcacaatgcaccgacccaggcttgggtttttccaatgtttttgtaaaccaagtttttagtcaaggcgtttctcagattttaagtttgagggcgaccgtcgatactcacacagagtgcacgaataccgaggcacaacacaggtggattcaaggaaacatgatatggcaattaacaagggagaatcaaatgcaacaagttaggtaggtccaccgattgcctcgcagatggggcaaatagctcaagtgcaatcctatcaatgcataaatattttgcaagcaatataattaagttcaaatataggctcaagatgtccaaggtggcttgccttgctcaaggtcttgagcttcacgaatcttcaagaaatccatgcttagaagtaaatccggtaactgcaactatacgcaaacaatcaaaacctaaacaagggacaaaaaaaaagatcatattaaaactaattactagtgccattaaatatgtcacaattttagagtattactggaagtggaacagagtcaaacggaattagggatcaacaaatataagttttggaaatttatctgattttctggacaaaggaaaaggacttgttgaatttttggtaacatgcagggccagcaaatgtggtgggaggagagagggacttcggtccacaggtggctggtgagggactggatatcgacttttgttgagcgggtcgagagataaagaatcggctcggcagctcacaaggctaggggtgtgagcaaggcggggaaactgttttaaacactccggtggacatacacctgtttattacatgttatctaaaaagttatgaaaagttttcaaaaattttgacataataggttaatatgtaatatatcacttcacaaacatgcaaattcaaattcaacttctacaagttgtaacaaaaataacaaatttgactgtgaatatacgtatgctagttagagtttaatttgttatttttgttacaatttgtagaagtcgaagttgaacttatatgtttgtgaagtgataatctatcttgtaaatttttttaaaaattatttgtaatcatttagttgacatgcaaaaaagggtggatgtccacccgagagattagaatccatcttcggtcttgggtcgcagtcagaacgatatcgcacacatggtctcggattcgcagtttctgggaaagcacaggaaccgttagcatccccgtgagcaaagagtttacgtacttgcacttcctctccttcctagttgttagggcatccacaatgtacttcaaaagtggtccataagcaatataatatttgattcagccacctagcaacattgtggaactagtccatagggaagaaataacaaaagctacccataagcatatgggctgcccatagagaataaaatatattatttgtctctatatcttctctcctactaatactatttactattcatatacattgtgaaggttacaatagttaaagttcatatatgtgggtcccatctttatagactacttttaccatatacattattgttgcccttattcctttttcatgtataatcgagataatatctatctatctattatattattaaaacaaccttaaaagagagcatcatgttcactgtgggggttaaaaattcccacattaatcaggaaaaaaaagaaaagaagagtccaaagagaaatacaatctaaaaatagctaaaatttaaaattaaaaataagcaatattgaaagaagagtccatataagaacacgatacgagattaatcaaaatttggaataaaaataaaaaaaatgattaatcaaaatttggaataaaaaaacaggggcaaaatcacaaaccctaattaaaaagcaggggtaaaatcacaattgaatcgtaaagaagggcagaaacacaattgccccaaaatgtttcaatagtttaaatcgggcgttgtttcaccttatataaaaacaatgtttcaacaaatagcaaaagaatgtttcatttcaccgcaacattaaatccatacatagcaaaacattgtgagtacactaggtgaaacattttgtggaacaaaaaatgaacgaattctcttaatagagggtttccaaaatatgtgggtgatttgttacaaaagaatgtttcaattcgctgcaacattagatctatacatagcgaaacattgtgagtacactaggtgaaacatttttgatggaacaaaaaatgaaacgaattcccttaatagagggtttccaaaatatgtgggtgatttgttgcaaaagaatgtttcaattcacttcaacattatatctatacatagtgaaacattgtgagtacactaggtgaaacatttttggtgaaataaaaaatgaaactaattcccttaacagaggtttccaaaatatgtgggtgattttttgcaaaagaatgtttcaattcactgcaacattagatctatacatagtgaaacattgtgagtacactaggtaaaatatttttcgtggaacaaaaaaaatgaaacgaatttcgttaatagagggtttccaaaatatgtgggtgatttgttgcaaaagaatgtttcaattcactgcaacattagatctatacaaagtgatacattgtgagtacactaggtgaaacattttttgtggaaaaaaaatgaaacgaattcccttaataaagggtttccaaaatatgtaggtgatttgttgcaatagagtatgtagtggagatacatggcaggagggaatagggacacctaataggcccacaggatcacgcgcgcgcgtgggggggggggggagcgcccgatcctgctccacccccaccggtcgcccgggtttaagcatttccacatattttcataagggatatacagttatatctattatctattatatactaaaagtccattaaacttcctacaaacgctctcaagtcgccacatggcactctaataaattagagaaaatcctagaaattctaagaaaaaagcaaaacatctaccccttaattttcacttaaattggtgggtccaatattatacaccgttagatgaaattgatcttaaaataaaccaaaccaaatactatgggccccacctctcctcctccctagatatatacgtacgtacattctttcatttctctgttttttttcagtttttcttctttttttcatttatataagtacgtacgcttcttctttcctttctcttttttttttcattttttcttcttttttccatttatataatagatatatatatttttaaataatcataattcatgcgtacgcttcttctttcaattctttttttcctttttttactttttccatttatataatagatatatatattttaaataattatattttacaaacaaaaaatctaccatcatacaactcaggggtaactaaattatctctacaatttttgaaaataaaatttacatcattatctgttactcattaaattaataataatgtaagataattttcatttaaattagtgtactcattactttgtactattatgtttaaataatacactattttaaaataaagtttacacagttatatgtgtacatatgtacgtgtacgtacgcttctttcgcttattttttttcttttttccatttatataatggatatatattttttaaataatcataattttacaaacagagaatctaccatcatacaactcataggtaactaaattagctctacaatttttgaaaataaaatttacaccattatatgttacccattaaattaataatgtaatataatttccatttaaaccggtgtactcattactttgtactattatttttaaataatgcactattttaaaataaagttcacacattatattgtatacatacgtacgtatgtgtacgtacgcttctttcgcttattttttccccttttttcttctttttttctatttatatatggatatatattttttaaataatcataattttacaaatatagaatctaccatcgtacaacttgcatgtaactaaattagctctacaattttaaaaagtaaaatttagaccattatatgttacccataaaattaataattaccacttaaaccggtgtactcattagttcccaatagactgatttagtcttaatagtattagtgttggaagagggtttactttgtgctattattttccaataatgcactatttaaaaataaagtttacataattatattgtgtacctatcaaataaacaatttgagatctatattaactaatttgtacgtgcatttaagccgatggactcattatttaaatcactggatttattttttattacattggactattattctccaataatgcattgtttcaaaataaagtctacactattatattatattatgtacccattaaattaacaatttaaaatctatattaactaatttacacttacactagaaccggtggacccattatttaaatcatcggatctattgttttcttataaataaagctttcgaagttctcttttttggcccgctacacaatgcacgtctgcacttttgccttttgtacgcgtgacaaagcgtcgtgtctaaggcatctaaggtgattaccaccgccgctacgctaccactttgccacatatcaagtcatatatggagttgattaattttattaataacatgtaaagtaaattaaaggtgtgatgccgtgagagaataattaagcaccgcgggttgaattttttccaacacttagctctgtttaacctgaaactaagagttgattatagaataattataatgtattgtgttatgtcatatttggattttgtactatttattcgtacaggtgaaagaaatcattatgttataaatgtgagcataatattaacgaatattaatagaacttttactaagacaagcgtgctataagagagtttaaccctcttttttttcccaattccatagtttgggttttcgtttgcacgcttttcaagtttctaaatagtgtcttttttaaacaacagtttatctttttagaagtcaattcattcatttgtaccctcaaatagctatcatataaataagctattctaaatcctaagtagtacatgtttttttttcatgtgagtcatggtgatcagtaaattggggatcaacagataatcaaagtcgtaagataaatatgtaagagctactatgaacaactgtaaataggtgtcaaaattaattgctattaattagacatctaatggcttgctagccacataattaatttctctctagatgtatataaacatggacgaagctgcaataaataataccatatgccccatgcatatatattatgtggttaatattctaattacatgtgttaagtcctttaaaatttcttaaaatgctctcaaactgctacgtggtgctctaataaattaaagcaactattaaaaattctaagaaaaaaaaaagcaaaatatctattatttaattttcacttaaatcggtatgtccaatattataaaccattagattaaattgatcctagaacaaactagatagtacgaggttccacctctcctcccggggcataggtacgcacctacgtacgtgggtacgtatgcttcctctcccttttttcatttttccctttcttttttttccatgcatgcgctttcctcccgttcttactatatcatgcgtcttcatgagatgatttaatcataagaattttaagtatcttgctctataaatggattgtataataattaacttgcaatagtttcttatttactcgagaaaaaaaaacatgattcaaaagtcataagtacttaatccatctcctactcaaaagtttgtgaatgatttttttaagatactttaagaaaaatagaacccttaaattattataaaataacattatccaaacattagtttgcccttaatttatgagacaaaattttcgaacaaacaataatcttatctttcaataatataatgcccgcgcatccgcgcgggccaccttcctagttgcagtaaaccaaacagccaggcaaatagttgtatccaccttaagccacaaagagttttatgtaacagaaaatggtgtagtgttggttgttagagtttatgatgacatcatattggtatctatgggtatcatttctaacacctaaaatatcatattaacatcagcatagtaccaacatgctagaatttgatacctatatgtatcttgtctggtaactgcagtactgcagtgttcttgaaggaacgatataggccgtgtttagttccacagacaattttttttaaaagtatacggacacacatatgaaatattaaatgtagactaagaacaaaacaaattacagattccgcctgtaaactgcgagatgaatctataagcctaattaatccgtcattagcaaatgtttactgtagcaccatattgtcaaatcatggcgtaattaggctcaaaagattcgtctcgcaatttacttgtaaactgtgcaattatttttttcgtccatatttaatgcggcatgcatgtatccaaatatttgatgcgacggaatttttggaagtttgaagggaaataaacacagctatagtgttccctagtcatcctcttatgtaacagtctcagatatcaacaatgagcttggctctggcgtggccagactccaccctgtattggtctcccacgccgaagtgcgccatgagcagccacaccacggtgagcagctcgcctccctggctgagctgcctcgcgtgggcattgccactgcactttccggccgaatagcacaacatctccacccacacggcggccatgagctgccatctcctctcctcagtgatgccctcaagctccatgagctgcttcgcgagcttgcacgcctggaagagcaccgacttgctcctgtcccccttcacgtcccgtggctctgcgatcgacgtgtccacgtccgtgagcctgttagcacatcccttctcgtccctggtctcgtcgtctcgccggaagaagttcttggcctccgcgcaggtgtcaccaaagcggatttgaccgatgctcgccgtcatcatgaacgggcgcatgaccagcaggaacagcatgtagttcgatatctccctgctcacggtcaccagattatccgggtctctttctcgtgccgtggtgccatgatcgtcgtcgttgttgccggcaggggccgagctggagacgcagaggcaccggagacacttggacgacgaggagcagctgatacagcatccgtcatcatccttctccgccggagcccgataatgtttgttgtagaagcagagttctgtggcgatgtgccagaggaggatgctctcgtcaaactcgcagtcgacgctccagcccagcttctggtagagacccttgcgctggagcgcccactggccacggtgctcgccgaccttccggtagctcttgggatccttgctgatgctgcttgccttgctctttagctgttcgaagatgtggctcttcagctgctccgaaacgccgatgctcgtggtgtacctccagctgtcccacatcgtcttcacgcggaagttccacctccactccagccactccatgggtttcttgtaccagcgggacctgtccttgacacaatagctgatcaggttgtactgcgacatcttgttcgaccatctaggccgcttctctggctggaacaggccgatcagccaaaacaccgccgctgccacggggcggagcgcttctgtcctgcgcatgtcggtgtaggtccaggaggacacgacgatcaggagaatcgcgtaggtctccaagaagatggctccgcccaggagcacgaaggagatgttgatgtcaacctgcttgtagtagcctcgcatatcacccaacgcgcgggtgaagagcacgagcgacacgaccggcgcggccagggtgaagaagcgtaggccgcggcctaggcgaccatgaatcacgagggccttggagtggaggcattcgtacatgagcaccagctcgatctccaccaccttgtacgcctgttccatctccagcctccggaagaaggagaggctgtcgatccggtcctggaagctaaggatgaggtcgacgaagaggcggcggaagatctgaaagaacctgtgcgcactgtacaccaggtcgccatattcctgctgcttgacttcgacatggtggtcgtcgtctggaggccgctcctgcacgatgacgatcttggccaccagcccggcgtccgtcctcgactggcactcctccacgaatttggcgtagtttggccccggatctggcggcgtgagcatggagctgcgcaggcagcccatgctcgccgccctgagcgctagcgtccgctcgccgtacttggtgatgccggcgacgaacatgattatcgccgggatcatcagccggacgccgggccgtgatttccagtagacgtatccggcgagagcgacctgcgacagcaggctcaggaagtgacgcagccagagctcgttgtcctccacggcgaaggcggtgatggtgtcctgccccccgagatgaaggatgaggaaaggggcccagaagacgaggaggtgcatctcgccatcgagtgagccgtcgcagagcttctggttctgggacaggttgcccatcgcgtagatggcgatgtagtcggcgaggaggtaggcaagccagagtggcatgcgcagccaccaagcggctttgcgcttgcgcaggccgccggtgaagaggaggaagacctgaagggataggctggacaggacaagaacgcggatctcccactcaccccacacctcccgtaaccgtctcaggttcatctccgtctccaaaattctccaatgctccctggtttcaatctccccggctagctgctagtgaagctcctcctgcatcatcgatcgaggataagcatttagcactgtgcttgcacaagaggaatgctttctttttttcatttgcaaaaacgaaccgttctctctcagtttggacatttgtttactatatggctatccatggacaatgatttttttataactaggtgccatagcatccatcatttacatacgacataaatagttatagaaaaaattgaaaaaaaattagtaacatcgtttgtacaactagagaaagaaaaataataaaatcagaaagtgaatagtacacgtatattgtagataaaatttgttattttttcttcatatatcgatcgaatttatacttgcatgtttgtatgatgtctcatattatcatggtttatcttatcaaattttatgatatttttatataactgtttaaattacatgtatacatatagatgtggcacctagatatagaaaatactttctgggccatccagttgaactattaaagtcaactaatcattacggacacagtatttgctctatcgtgagagcaacaaggaggtgtgatctcttgcaaactaaagcgcacatgccagatgccattgcccattgacccaaatatttaacgcaaagttgccacctattaattccaagctagttttctctctagactccgctggctctagacttcgctggtcaacttgcattatcagccaacggttggctcgttagtcgttatctggcttaggggtgtgttcatctacacatcgacccagtctaaaacggaaattagctgtttttacggtttgagttatgcgggtttgacggaagcaacttcgagtcggacacccaattggagagataaatatcgggcgtcattacggggtgtgtttagattaggggatatcacatgtataacttaattttaattttagagtgtcacatcggatatgatattatatagggtgtcggatatgatatagggtgccgcatgggttttttttgacactaataaaaaactaattacataatccgtcagtaaaccgcgagacgaatttattaagactaattaatccatcattagcaaatgtttacagcttactgtagcaccatattatcaaatcatggagcaattaggcttaaaagattcgtctcgcaaattagtcgcaatgtgttgaattagttattttttagcctatatttaatatttcatgtaggtgttcaaacgttcgatgtgatgagatgtaaaattttagggtaggatcaaaacaggccctatgtcgtccgatcaattctgtatgcacgatcgaagggactctgcatgctcgaaatgactttgagggactctgcatgttgatttcagtgacttagagggtgtttagatcccacacaaaaaatttacatcccgtcactgttaacgaccaaatttggtaaatcatagatcggattcgaagttacaatcaaagcggatttggagagactttgtttctcagaaacagagtacgcatcggctattgactgcatcggctgacactgaatcagacaaggagaagcggatgtagccgatccccggaagatggttctagaatcattgttgggatcggttgaggcgccgcacaagcattgccacgagtggaaagagtccaaagaagacaattgtatctaattaatattttagtagttttcttagagatattttcggtaagagtcctcctaagaggcttattcgtatttttaagttataatagagatagagtcgtgtccagcaatgacatattatgtatttcaggtataaatatggccggacaccttgtaaaaaaggagatcaataataatacttttggcgcatcaccacctttatctacacttattgttttcgatgagttcttactttcgagttgggctgcattgggttcgatctcagacgaaaaggtaaagcttgttatggcggtttgcattctcgggattagtgcctacatcttcatgacaatctaatcctgttcatgtaaatcgccaagttatcatatatgctatataatctagatcaatatcgttatctgaccccattggctagtctctatcatcaaagacagccgatagggttagataccaacattgaattagattatatagcatatctaccatctaaaaaaggcttttataagcttgtttagatcttgtgtttttcttcgtgcttaatgttgcatcagttaagtttgatctattaagtaacgtgtagaccataatatctaacttgttttataattgctagtagagatagcatcagagattcagccgatcttacctggtttagtcatcttgtttccttgtatacttacttgatatgctaaacctgccctttatattaagatatcgcttggtcagaatatattaagcttgttgttaatctattaggtcatcctgttattagattgattttggttcagtatatttcatcttcattgatatcttggtacagattagtatcggagtactagccaatacatattaggtttgcttcatcggctatgctatgaatctatataatctttactttaaagtatttttagacatacgtgatttatactgtctcggcgtgctgtccgatctatcccaatcactgggtttaagcataattcggattatatagttattgatatctatagctgatcgagtagatctatttattcttgcattacatgttctcactaccgatctgattcatatcgcatcgccctggtgttaaatgatacgtcatcggcagtctagccaatcgactattgtttatggatttaaccttgttcttttttatttcttgttggtagcaagatcaaaccaactggccgatgacgtatattcaaatttaaaatcccaataacaataaggagaggaggcagcggatggactatatagaggagtatagtggcaatatttgacgggacttctaaaaattataaaaacaaaactcaacgagacaataaactctacaaactaaaaggtctaatttttaaaggttccaaagagaattaatagaaacagtggtagatcgagcaagcaaataaaaagaggagtgataaataagtaagagatagtaactgcgtgacttttaaaaactataaaattagaaacacagggatgataaggtttggtatttcaaatacttaagacaatgagatagctatttatcaaattttaaataaaacatattaaaaaatagataattttatatgggtgctagccgcacaattgcgcgagccacccagctagttttaataagattaacattaagtacatccaaacatgcccatgttctattaacattaggaaacgtggtgcctcctagtatctactcgagcaccaaaaaaagcctcctctagataagtatcatcttcaagtaaggtgtttccaaggatggtatagtcatcttcactgatggtttcttcaacaagccgaatgatttctttgtgcttcttgacttgagtagtagaatatcctcctacaagaacaatgtacttcccttaaaagcatatcattgattgaaacaagtgaatagcagcaagttagaaagcttctaaatataaatttttttgtggcgtttcctgaaagagaaaaatactccatgatacaattgcgagattacactttaaagggaattttttttggaagataactattcacatatggcaacaagaagatgatggtatactaaaagtcaattaaacttcctaacgctcctaagccaccacatagcatccctacaaacactctcaggtcaccacattggcgctatagaaaatcaaaacatttagccattgattttcattaaatctagtggacccattattttccaccctcccaaaaatacgtacgtacttctttttctttttttctttcccaaactaataattcgattccatattatctatgcttttatgctttaatttataaaaatatatttgattagtattattaaaaattactcgcttgtacggtaaaataatgtcacattactaaattatggttttctttatttatatattattagaaaattaacgaacaaatatattattttgaaaccaacatcctctctcctacttagactacatttgatctagctcattggttgaccttatccattatccagggcacgttaaacgacgtaggtcgtcagcacaagattaattaaatattaaatattacaaacttgaaaatagatttatttttctaaaaaaacctttgataggaagtatttgcaaaacatgcacaatttagtagttcggaaggcatgatcacgataaacgagggagtagccaatccaataaacactttagaacttaatcttaaatttattacttttgtacttaaacacttaatatgtagtatataatatactttgtcaatccaaaacagcctaatgtatcgatcgtatgttcctactaatcctaatgtatatagattctatatacaaaccactatccaccaatcgccaagtcatattgtttacaaggtatccgtgcatagtgcacctaatatttagctgacatgcaatggacatgtgtgtgatcaagtacagaaaataaaggaagatagtaagtgggcaaccatcaagaaatgatagataagtagaggatgccatcaaggcacaacaaacaatagttgagtacaaatagattgtgattatgagtaatagtgtttctacactcctacaaaaactccttatatgccacgtgatgctctaataaattagagaaaatctaagaaaaactataagacaaaaaagcaaaat

SEQ ID NO: 73827 - DNA, 984 bp, Oryza sativa
  unsure (1)..(984): unsure at all n locations
gcggccnggtagattgactanctcgnacccnacacatatacatatatatattttttttcttgtgttgtgtgggaaacaaattgtttagttttacatctggaccatatgcaatgaaatttcattgagttcctctaaagttggcagctcatgtcgaaacaatttatttggttttctatattatgtcaacaatatataaaaaatacaattcatgaattgtgtgtatactacttattctcacctttctctccttgtagggacatttcgcattccttatctgccatgaatcctcccatagcaaaggttttgcttgtctcctcttcgccattacttccatatgacaccgagacttcctttagtccatctgcagctcgtaaggctcatttgtttttattttcaatagacatttatatgagacatgcaatacattacactaatctcctttagttccaaataatatcatcttcgtttatgtatatttatttcttatgttctggggggaactaattgtgtagtttcacttttgggccatatgacacccagactattccgagttcccctacagttcatggtccatgtagaaataatttatgtagtttttccaaatatgtcaacaacatagagaaaacacagaacacataatgcactctcaaatattgtaccttcatctacatctgaagacttcttgcgttccttatctaacatataccctacttgagagaatgttttccttggctcctcttcaccatcacttccatatgtcatggagacttcctttagtcccgctgcaactcatatgcccccattttataattccaaatatacatgtatgcaacatatatacactacatgtaacatgaacatccacaagttctaatgtaacctccgcttgttagtatatatttctgatgtgcatacctgttgggaacaannatgctagtttcacgtttgagtcatatgacactgagacttctctgaggtcctcta

SEQ ID NO: 73828 - DNA, 1491 bp, Oryza sativa
  unsure (1)..(1491): unsure at all n locations
tgaacgcacaccagggagtagatttgttaacatgacagaaatagaagtgggggtgccccccgccaggaagattatcntcccgacggcggggaaaataacggcaggcggggacagancattatttgccaagaaaaaggagagtacgccccacacgcaccggataggaccacgcggaattccagccagagcgagtagatatcaggacgccgagaaaggacgaggacagacatttcatataagcaccgcaagagacaacagaagcgatgcaaaaggtagaccctcggcgatacatagaaaaagccggaaagaaaaaaacttaccgcagaggaataaacacaagggaaaggcaagagacattaaagcgcatttttttgttaaaagatgaacaatttgtgacccagggcgaaaagaaagctgcgtacataataaaagaaccccggtcgaatctgggtactttcccattaggcttccgccaccgacatcaaaataggattccaaacgacgacacgatcaagagacactgttttgcacaaataaatggnggtgnnngggtcntcaacaacaaagttgtataactcatcaatatgtacaacttttgttttggtcattttgctagatgactttgtttcaataatttgaatttgaatttcaaattatgacaacttcgaacaacatttacaagtactaaattatttcaaatggaaaactcatcaacaacaaagtggtatagctcatcaagatctataatttttattttggtcatctcttacaaatcgctttgtcagatgaagaaatgatccaaataaaaattatagatcttgatgtgttataccactttgttgttgatgactttttgagttgaaatcatttagtacttgtaaatgttgtttgaagttgtcataatttgaatttcaaattcatactattcaaacaaatacatatagaaaagtgaccaaaacaaaagttgtaaatcttgataagttatacaactttgttattgatgactttttcagttgaaatcatttagtatttgaaaatgttgtttgaagttgtctaaatttgaaattcaaattcaaattattgaaacaaagtcatatggtgaaatgacaaaaacaaaagttgtagatattgatgatttatacaactttgttgttgatgactttttcatttgaaatcatttagtatttaaaaatattgtttgaagttgtcataatttgaaattcaaattttatatagttcaatcaaactcggatgaagaaatgaccaaaaaaaatggtagatctaaatgagttctacaactttgttttttacaactttttcatacgagctgatttagtggcataaaattcgattcaaaatttgcaataaaaattttgccttctcaccactttaaaatatttcatctttccctcacctcttcctcccctaatattttcccttctttcagtgccggcgggagaaagacctaaatttcaacatgaaatgaccatt

SEQ ID NO: 73829 - DNA, 19008 bp, Oryza sativa
ttgtatatagtgtatcatgaaacacctggtataccatggtccttgaggtatcatgatacacctggtatctcaaggtatcatttggtacctcgagacatcattcggtatcctcaaattatcacctacggtacccttgaggtatcatttggtaccctcaagatatcgcccgtggtcctcgaggtatcatgagatacactcggtacctcacggtatcatttggtacgctcgaggtaccatgatacatatgataccctcgaggtatcatctagtacgctcaaagtatcacctacagtatcctcaaggtagtgcccgtggtcctcgaggtatcatgatacatatgggttatacatggggatttttttaggtatcaggtatgttatagtgatacatttagtctctatgctctagaaagagatatcaagtgattcaaataaaaaaacacaaagaaaggaaaagaatagtgaaaagaaaaaaaaaggaaaaaaaatgtatggttgggccgtggcccaatacacaggagcgcaacagccctaccgggccagctggcctatccatgtactcactctatcctataatataagacatgtacacattccaagattcaactttaaaaacatttaaccaacaattattataatataaattaaattttatttgttaaaattattatcattggattgacatttaaatttactttaagatggttataaatttgttgcaataaaccttatagtatatgagaaatttaaagtcaaagattagttttgaagactgtgccaatggttgaccatgtgttatattatggaatggagggagtacatatgtgcaagtgtaggagtccttgtggtctagctagccacgtaccgacgtatgtatgtataggagtcctcgctaaacgtggtggcttgtgtggatggaagcgtgccatgctagactgtcccgttgaagaatggtacaccgttctttaatatttctatctcagcaaaccattaattcatcaacagtgtgccaacatgatggtactagttttgcagtttttattaaattaataatacttcacaaaaaaggtcgttcattttctgggttactaaagatgtaacgagcaaatttcttgttaactagatctggcttatgccttttgttaatctcctttagtccactgtaatagtaccaatttgagttccctttccttagcttcacggcttgtttgttgaatactatgtgattgtcataaccaccatgatgattggcatgctcatgcccatcttctggattgccaaaggtgtaataatatgaaaatttcttcttagctaggtgaacatgatcatgtccatgtgcgaggttgccatagattgaacgtgaaaatttgttcttagctagcttcagcttaggctttttgtcaatcccattcacttcgctgtgttggtataaatctgaagttttcttctttagcttcatggcttcatagttgagtaccatgtatttgtcattgtgaccatcatagtaaacatgacggctaactgctgggttgtcataaatgtaacgtggaaatttcttcgtaactaggcaaacatgatgatgtccatctgctaggttgccatagatgtagcgtgaaagtttcttcttagccatgttcagcttagattctttgtcaatcccatttgcttcactgtgttggtacaaatctgagtttttcttttttagcttcttggctttgtggttgagtaccatgtatttgtcattgcgaccatcatagtgaacaaggtggtcatttgctgggttgccatagacgtaacgtgaagatttcttcttcactagattaagctcaggcttttggtcaatccccttcactgcactgaactggtacaaatatgagaattctttctttagcttcatggattcagtattgaataccatgtgattatcattgtggccatcatagtcaacacgaacatgcctgtctgctgggttgctatagatgtaacgcaacaatttcatcttatctagtagaatatgatcatgaccatgtgatgggttgttattgttgtgacgcgaaagtttcttgttggctaggtctagctcaggtttcttgttaatctgatttgttccactgtaccagtacatatccaagtttttcatctttatcttcagagcttcatactcgaataacatgtgcttatcactatcgccatcatagtaaacacgatcatacccgtctgctgggttattatagttgtatggtgaaaatttcttcttagcttggttgtctagcttgggattcaatttgagtattgagctcttctcatcagcccccttggctccactacctgatgtaagaaggagattcttcttctggttgcctgtagatacatgcacacgatgtcacagttcttgcattcgttgatcattataaactgaactaggagttggttattttcaccactgattttaactgtaaatgaaatctttattcttatgcgacatataatcttccccaaaggttgctcattcatgtactgttcttgtcaaaacatatctgacatttgtcagaatttacatgggaatcttccttattctaattctactacctccaccccaaaatataggggtagtgtggtgtaatcagcctcacatttgttacaaatttataaatagtgccattttacagttcgcaaattaatatacaaagtgcagtaccatggcacctttcaattaaatactatcacaaataaatgatgttttgggaaacaatatgatcatgcaccaaggtattagtttgattatgaataaattaataactagtataaaacgtataaaaatgaaccaaagtattttgaaattttttgaagataaaactagccataccattttcaagttgaattgaaatattcaaagagatattgatggtcaaagtatattgattgcatgcattacaaacattacccaactagtaggtatttaaattctatctttttttctagggacgcaatttgaagatcggatatataatttaaaatgcatatgcaggcagaggcctggattttattttcaattattaaaacaacagtttcaaatgttatgctacatttgcacaatcaactataaggcagtaaatttatctgcatcttcatatactgttgatgaaattggcaaaattcaacacttgcaacccctgtacatacgtacttgaaacattagtattttgtacgggattatatatagacacttaattttagtggacattttggactgtcaatgtccaaggcatatgttttggttacaggagagattacttactaaaacctcatcaactttgtttgatttgagttatcaccttataaaaaatttaataaaacttgagcaagtgaacggtattattatattgatcaagtataactatatattgttaactttccatgtttatagcattaacttcaaataaaatatgcatttggtcatgctggttttgagtgtgattttggctgtgttgtaccaccttgtaattaaatttgtactccctctgttccaaaaagaatctaatcctagagtgaacatgtgtctagattcattattaggattgttttttttaacaaagctaggggcccagcttttcaattacactagaaaatggcgcaccagttggcgcgcttattaattataacctgtatataatacttataacttatttagaatatatatttgttagtttttgagtttttctacaattttcaattttatcaattttatctgtttttaaaactcatggaaaatagactgtatatattttctggtttatttagaacacaataatttcgcacaattgtcagaacggctagttcaatgctcgtaaaatttatttaggatagagagtttagttttctactaacttatcgaaggttaaaatatttccaaatatcataaggaaatttgatgtattttggtaaagaaaatcacaaatctgaatatttttttctatctctaggggggtatgtgtaaacatcataatttacccaatagagtttcatatgcacacaccatagcaaaatttagtttgatatatgcacatgaattacatagcaaaattacttgtccaacttataaaaaaaatagcctacttgataataagttttatcttagggccatttataaacactccaaaccgagggcctatttgtaaatttaaattttttagaggaaaaagttcagaaaattgttttggtagaaccggacatgttttttttatcctctgcataatttttacctggggtgtgtaaaaatcataatttgcccattagaggtgcgtatgcatatcatttagcacaattttagtttgatatatgcacatgaattatatagaaaattttaatttgatgcccattgcctcatgccagagcaaaatttaaacttgataaaattagttgcgagctacctatcaagcaaaaggcacccctcttgctattttattttctatccacatttcattttatttctcgtttcaacgggtgaaaacaatctatctattatattataaagatagcttgaaaatgatacggtatttgctttgatcgcatagaaattgttacattaattaatataaaaagataatagttgtatatacataatataatgattgtatttatattaaatgtcacaaaactacaattatttggttaaatctaatcatgtttttaaaatatgttacaaaatatattgaacaaaagctaagaattgcaaatttaattctataattaaaatatgttgcacaaaacaataattgcaaaaatgaagtacatgtaatcctagtgatatttgcgtgggactttcgtcgagtttgggtagaatcatagtcggtgatattcggtgcaccgtactaccgtactatgtaggttatttgctcagtgaatcatagtcgaaaatactcattatttctcatagttcttgttctatgagtggtagggtgcaccataatattcaaaaaatgctatccacttagtatactcattcgtcagagtagcttggacgtaccgtcaagagatagaagtgcttgctcaatcacattgagttagtgaaaagaccacttggtttgatggtatgattgatcttctacgtccattataattaccacattgaatgtatatgtcagatatacttatagattcaacaaacttctagttcacgataagtcatctttagttaaaattcgcacaaataattccaatatattttatgcaattctatatattttaccgcaatattaattaaaaataataaaagcattacaaataatcaataatcataaatgccataaataaattttataatcatgaatatatgaaatataatttcagtgtattttgcaaatttacaatgccattcaaacaaatattccaaatacagagggccatttatgtattttctagaaatttcagggtttaaaacgcaaagtttccaatgcagaggaatatgcgattaatttttggaaaccacaagggcctttttgcaaaatctatggagattttttccttcttctctactttctttcctccttccttatctttccttccttcttctatttacttttctttccccttcctccactgatggcgccagcgggtgcagaggctggacggacggcaacggcgcggtgggtgcaaaggccggtgaggcgctgcggccggccgttggcgtcgtggccgggtgacggagaggaggaggccgtgtggcggctccgtgcgatttggaggccgggacggcgtggtggggctggctgcggcctcggatggaggaggcggtggcgacagctgcggccgctcgcgcgcgcggatcatgcagcggcggcttaggcgcgtggatccggtggcggcggctgctcgggcgcgcggatccgggtattcccccacacggatcctgagtcggcggcggcagcgtagtctcacctccccacggtggcggcgtgccctctcactccctctccttcccgtccctttcccctctcttctctatcgccggcaactcccacaggccggatccggcgtaggcgtcggtggcccggttgcggtgccttcccctccaccagatccggcggcgagaggggaggcggtggctgcccggtggcgggatgattatttagatgttcttgtgtgatgttttagtgaaaaatttctgtgatgtttttcaatgtttcctatgatgttttttggtttgggattgggattgattgatgcggggtggataaggtcgatgcatcagctcgattaggagaggggaatctgttgttcttgaggatttttattcaatgtgatttctttatctactactgagtcctgactgttctagatgaggtccattggatatttttttttcaccgttgatatgacatcagacggccacgggaggggtgcgcatacgtggccgcttctccagccgagaatcccgctggggctcgaagcgtggtgccacgtggcccaatcactgggcagggttagaaccgtgcaatcgtatatagagatatgtaggggcagacctaggtccaaggcaacatgggtcatggcctggcgcgggttcataatccaatgggtctagctagggacagaatagtatgggccagcttgggccttaattagcctatgccttgtccgcccctataactatgatgagatcatatggcggtataataattgtgtgtgaaataatggtatatatatagagggagtgaaacttggaacacatacatcattacaatcaacaggtgacgatgtcgttgctgtaaaatttactctacaaattatgtgaagtaattgttatataaattgaccaacatcggtcgaggagcagagtgatctaatatactccatgcatttatttttgtaaggtttattttgattctataagaaatcaaattttgtagattttgaccaatgtaaagttaggaaactcaaaagtatatttaattaatgcataaaattaaactaaaccatacgctttattcatacaattaatattggctttatgagaaattgatggctaaagtttgatcatgaagacattttataattactatatgtacatttaaagtagtaagtactacttcaacaaagcataggagttaaacaaacatttataatatgagtgaggattgagtaaagtaaagtaaagtatttcttgtattgtacaccatccccgcaatccaaactacaaattgctataagttgtatagtaccacctacacattcgatgattaattatgcatctcctctactatttttataaaaatagtagaattttcttacgccacatgtgtccgatttggccaacattgtctccactcgaagcaatgagagtctgcgtccgattcctgcgtacatcgtgcaacgccgcacgtttgttaccaatttgcgttgccggcatccgattggcattgatgtcttctctgcgtagcccactatatttccttccatatctcgcatgatctacgttgccgagggaggcgacttgacatgagacgggctgggccttcctgcatcgaccgtgccatgcatatagatcgaatccgtttcagtccgaagcaagagactacgatggaatatattgacgtgcaatcctttcgcgcattggcaaataaaaagggacgatgatgggataataaacaacaagacttaactgtctatctgtataggttttgcatggatgcaaaaatcatagcaagggctcctattttcatcaagcaaataatggccaactcgtcgaccgacctcgagcttcctttctagagtaggatatactgcatatacttaatatgtgatattaacattgcttcaacccattacaacgcatgagtattttctctagttactatataattgtatcccactaattagcttaaatattttatatgtctttccacaggcttcgtaatgatcactaaatcatacccgtacaattagattcattagtaaaatcatagctgtttgattagatctatatgtcaatctctatctatatactattataaaattggagatgtttctgttggaattttggtacgttatccttgtttgagttggttgtatgtcgtccgtatccaattcgatgcgaatctagaataactattatacacccatatcccatcccaacccaaccctaccggccaactctatcccgcgtgcctccaatcggcgccacacacgaccctcccttgatcggcatctttttttctctcccttttatttttatttttctcattttttctcccgataatcctaatactctccttctccttctaatctcgtctcatttatctttttctcttccaaatttccctcctcataaatagtttccttttgaatttatcattgtttaaggtgtgcatacgacaagtttgttactctgcaaatgctttccaactatagtaaaaaaattattaattgaataatcaaaatttcagtctttgatcgatgagtatagcaaaatgcacatgcgtcaacttatggaatggccacccgattgatttgtgaagctatggaaagacgtacataagtgattcttcgtgtgatgacacatgaagcacgcacaacccggttgaatgctatatatggtttctgactttgttttgctattgatttgtttgtttaatttcggtttgttgtttaaattgatcgagttttattaatcgtgaaaattattttcacctgttgcaatgcacatgtatttttgctagttatttaaatgccagaccagcccggaccaacttctacaaacaaatgagtccatccagaccaacaaagtaaaatcagctattggcatgtggcacaatatactagtatgcagggacttagaccatgtgcactttttccatatgaagatgctagggggatgtgtttggttgaaaggaaatccctacatggatatgaccatccaacttaactatgtttggttgataggaaggacgaatcatgaatgagaccgttataagagagaatatttcatgcagatgctggatgagctatttcggaaatattggccggatgagaccatccaccttttctaatcttgacaataatgataattaatatattttgttgttaaatagtaattaattgtcaaggtttgtgttgattagagataatgagtcattttgttgttaatttgtgtataatatggagaagttaatgataactaccgctaatatagaatatattatgttattaataaaaactttcatatttccagttattcatccacatcaatctaaccaagtaagaaactaaatcattcccatccacctaacaaattaaacaaaaaactggatcatatccctaaaaaattagatcatcatagctactcaaacttgacaatcaaccattaatctggatcataattcctggtcatggcttatcccttttgaaaattttgttaatagctagtccctagttacttctgttaagattgttctcagatacgttacaatgagcattcacatcgatctactcaaacaagtaccaccataatacctggggttgattgtcttataccaaaaactcttatggttttgtgcaacttgaaccataataccctgtattttatataatttaatatgtttttttatgcaggtgttaagtaattggtgctaaaatctagcactctattttggaagaaaagaaatgagaggaatgcatataaccagtaggaatcactatgaggtgctatagcctataggctgcagtattttttaattacttagctatcttaagcatggcctatggttccatcttggtgtttatatctagctactactatgcaaatatattacccttttatagagagagaattaccagatggttgtgtcaagaggttgagtatggctgatggtattggagaattgggatgaactgtcttccagtatgccatcacgtcagccgtgcggtctggcaccatcatcgtcatcttctttgcgctcaacaacttcctcccctcgccaactccgaccaccatcacctgtcaaccaaccaaccaaccatcatacatcactactgatgtagccaagatgtgttatttcaacaaaagctttcatagatgattttttcaatttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattccttgcaaaaaggaaaagaagaaaaaatatatcgtgagtgggtgaaaaagcatggatgtaagagctcaacttaatggagacaacacttacaagaataaatgagaggagtgacaaaagagtactcattgcttagtctcagataattttagcattggctgcttatagttcttgctcaatttggtcaggactagcacaagaggtatttataggctagcatcgctatcacgatcacgtacaatcatctgctaaaaaacaaagaaattgagaaatggtggcaggatctaaaaattaattctgaattaattttccatgctggggcgcacatgctttttttacactgtatatgtattaaattcaaataaaggaataccctgtgaaaacagtgtaaatccactgcaaactttaaaaggtattaccaaagtaacttttcataacgtctatgtatcttattatataaaattttacaatggcgaaagatataaaatcatcaatttaaagtagtatggctagaaaactacatgaaatttagtaaatttacactgtataaatgtaatacatacattgtaaaaaagatggaaatccaaaaatgatcaatcaattgaacatctaatctataccttctataaaactacaatccactaatcacataaagctcaaaatgcaagcataacagttattagttaacatacaagtagatcacacatcaacccactaagcactaaaagatcaacatgcatagtaaatactaaaacttaaatgtaactacatacattacctataaattattattttttaaagctcaacatataaaaatgttaattcattattactcatatcatttccacaatatttatatctaaattcattcatcatttcaacatcatttaatacatattcattcatatatcctgtagcaaagcgcggggtgtcacctagtaactgctatacaacaatcactagtattctcgattgacaacctcctcaatccaagcttccatctcgtggtgcttggtcacgcagttcatacgagtgaacgaaagtgagttttactatgaacttaaggatactgtgaacgatctcctttcagaaatcactcctgttgagaggccctcctcctcccttttttctcaatatggaagagaggcagaagagaaatccagagatagctcaactttttcatggaaaagttggggatcgaatgcaagattgagtccctgctggatggaatggaaacactagaaagatcataagaaaccgagctcaaagtgaatcgcaagagaaccccccatcccttagaaggatttgaagctgtttagacactcatagacaagtaaaatccaactcaggttcctcgagaagtgaagtgaacgagcaaggtaaaacacaatcaagttaggaaaagagtctttcatgccaaggtgaacatagataggtagagttagtttattttccttaattaccagagagaagacttacatgcctgtttgactccgcatatatacccccattaaaaagagctctgcatatagatattcgatgacatgtaaatcaaccattttttcctttttgataatcctacggtctgctcttttccctggggtgctggatatgttcttcattgcttccgacagcaatatttcaacctgagcggcttttcctttatatatgtaggtattgcaatgaaacatttgttcctagtaaaatccctaatctaatcttgctagttagatctagagacaatgatgaaattcgtaccacttaatgtgttgctatgaagaccagaggagctgttaagttactctagttaatttggccacagcctaatttgccattagtgtcacattcacaaactgctgatcacaactgtactaaattttggcgactgtctgggcatataacatacagacaagtggtgtaataaaatgtttggcttgattcagttgtaaaattgaaccaaacagttcctgaataaattgtgcagctaaccaacaaacaagcccctcaagcttcaacatcattttgttaggtagcagttatgtttcgtttggatggtctcttgtgtgttctgtttggaggagtttttggcagctgtagttttcttgaagtcaaaagcttgtctaaacaatatagcttttcatccagattcttagaagatgtagttatagaatccagaaaataaactagattctcaccagctgaatttctactaatagcttcatagaatctaaagctacctaaacatgcccttagatgatgccaccagtgggagctattctattatcctttttagctagatgtgccatgactatgggtttgtttagccaatcttaaggttttagctagacgatgaaatctgtttgttgaataattttctatgtagtatgtttgtttcttattttgaaagaaatgtatggcatggttcctataactttaaatttttaatgtataatgtcattgacttttggagatatgtttgactattcatcttatattaaaaaataactaattagcaagtgtgaagaaaatataagttgtgcttaaagtagctttagtaataaacaaaccacagtaaattaaatgatagctacgcaatccttttagtaagaagaatttgatcaaatgttttctcaagtatagcagcatcatatattaaaaacgtacaggaggaattatagcacccgagggagaaaaagagggagcgaagggcttccagcagttcaatgggattgtaaatacttttggttttttcctcctttcaattaaattcccgcagttcttctgccgtcgtttctgcttaaaaaaaaaagggcttccagctgagtttcatgacagcgccattaattgattgttagcccgatagaggctccacgacaactcccaactaatatcatgaacatttatgcatacatgatctgacgatcggtatgtgctactgacttggaaggtatagaaggtttggtatggatcgaccattaataacacgttggccatattattaattagttgatgacctcaacggtatctaaaatttaaagtgtgactttcaaatacaggaagttagctagatggcatgtatgccattaaaattctgtttgtcactcccctttaaaagaaattgtttgtcacaaatagacagttcctatttcgaactaacacacaaatatgcaactgggtgacaaatgtgcccctactttcgtctgttcaaatgatctgggtttgaacaatgatttttgtttgtgtacttaaccaggaaaacatcctctcaaaataagaaaaatattgttgggaggaaggtgtagtatagtctattcatgatattttactagaattaattttacgatccatctattttactagaaattaatttactcacattgtttaattgaaaagacattatccaatataatgttttggaatagcttaaaatttatccaagcaaatatatatggacaaaagggtccagtttgagttttagcaaatgtattttgaagcgtattttgacttgtgtttagggtaggacacatgcctcgggagatttgtcatccaatggacaatgacacattctccctgggtttggaataataagcatgacatacttgtgccaagtgaatttttagaggcttatttaggatcgagagatgttcctttgaaatctttttttttcttataacctgaggagatccaaggtgacaagtcggccaccgaatactgtcgccacttccggagcatggatgatgcgatggccgacctcggcgaacctatcaccgagtgcacgctagtcctcgcactttcacgaggtttgaataaaaagtacaataatctgcaaactgtattgcccttatagcgtcgcttccccaccttcctcgaggcatgctctcagctgcttcttgcggaaatcaacaagggacaacagaccaccagaaccgccattgccttcgtcgcctccaccaacaacggttccggtggagctgggtctgtcgtcactgctgcatccagcaccaccaactccacctccgggaacggtggcaacaactgcaatcactgccatgggtgtggcaatggagatagcggcaacggtggcactgctcaggcctccgaacaaggtggcggcggcatccaagccacccactcaggccaacaggctgcgggagagtggcaactagtcccaacaccaagtcacgccgtagcacaccccttacaatccctgtgccgataccattcaaatatcaggccatgctctcagcatgctgggccaggtgttggcggtccttaaataccaaatgaaacactggacgtagtggtagggtttgttactaaccaattccacaagtgttggtaaatatttgtatgtagttgattatggatgaaagtacacctgctgtgtaacgaaattgtcctccaaacgtcagaacatcgtctcctactccagcactaaagccgagtatagagcatttgcaatgttgttgttggaacatgctggcttcaccaacttttgcacgagctgcattcacatcccactcgaaccactttggtctattgtgacaacatcactgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataaaccgtgcacataaggtcctatggcagtatatgtgggtggtttcgctgacgtggcatcctagtaagcaaaaataaataaataaagtacgtggggcccacatgtaagagagaaaacgatatgggcccacatcccttgtttcttcccctttcttctcttctctcgtcttcttcgatgggccgagacgcgcggggcgacggctggcgagagcggccgcggcggcggcggcggcaggcgaagaagtcaggcgcggtggtggcaggcgaacgcggtggcggtgggcgagagcggcggcagcggcgggctaagcaggcaggggcggccggcgaagcaggcaagggcggcagggttgagcgccggcggccgcgcgtgcccaccgtggtcctccgtgtccgcctcgtcgtcctctgtggttgcgccgccggccgcgtcgttgaggcggctgctcgtcgcggtggtcttgttcacgtggccgagcagagcggacggcgggcggaggagggggccgcaacggcggaggtggccgaaggaggagcgtggcggcggtgggcgagctccgcgggcctacaccgccagccgagccgtcatcgtcctcgtcgtcggccgagccatcctcatccgcgccgagcgccgcgcaccgctggttccccctgccaactacaccctctccgcgtccccgtccgcatcctcgcgctctccgtctccgaccccgacgtcccgctcagccccgccgtcgacgagtcctacacgctctccgtcgacaagtcctacacgctctccccgccgtgctcgtccgctcgcccaccgtcgtgctcgttcgctctgcccgccgccgtgctcgtccgctcgctcgcaggccgcgctcgcctgctgccgctcggctgccgcgcggacccgccgccgcgctcgctcgctgcccgcccatcgctgctccgccctctccgccgccagcgtctacgcggccgcttcttgccgctgccggcggcaacggcactcccggagtccatggagctcggcgacgacgcgttgagcgagctgcaggcggccgagctcgcgtctttgctgctgctgctgcaggtgcaactattgctctcctgggttagcacttgctcttgctccatctgtgtgacgagctagcgcgcgacgaccaccaagattgcttgctagtggaccgccggcctcactcagtgaagaagaagagaaagaggagagataaaagagaagagaaggagaagaaaagcaaagaaaaaaaaagtactattgatatgtgggccccacgtacttttttaattttttttttactagaatgccacgtcagcgaaaccacccacatatactgccatgggacttcctttgaacggtttgtgtgagtttatgggtacacatttctggttttgtggttaagggacttcagaaaatctcgctgttaagttgagggacctccggtgaacttattccggatattattgacaggagcagtgtggagccaaatccgccgctgttgctgattgctactccatcaagggctcgagctgtgtggatcaggccgcttccgccgcttggcccactccactagcttgcctacaccctaacacagcaaggggtgggcacatggctacggtgtaggtgcccccacctaggtgaaccctcactttacagtgtagattgcaacaacaacatgtaaattacaacaacgattcttctgttaactatttcgacgaacctgcagtttaatctgaaaatttaggcaaaatgtgaccattgcagtctttttcttctttctcaaacacactattccagtcttttggaatgaccctaaagctgatcagttaattgtgaaggaaccctctacttcgcagaagcagaaatgatatttggcatatactttgcagaaacagaaacacaacttggcggtggctggtttatttagaaatctctgcttggttttgatggcaagcatggtaatttcagaattctccaattcttgttgacaaaaaaattctgctggttgaacatggtgtgatagtgatttgagacattaatcaatgatggattatctgcttgcctgttctttctgttacatgagttgtggggtgtttttctgttaaattaatctaggttgctctcttgatctgatctagacagatcctgagcaaaggttgcaattaggaaaacaaaaagaaaaggtgagagagggtgctagttgaagttattgaatggcttagtatacctgttgactgtagatcagtcaattttagttcaaatgtttattgattttgtcatgtatactgtactatggtttgtgaagaacaagaagaatttgtatttggtctacttaattgatctaaattatgtagaacttcatgattttcttcagtgcaaaacatttctaaaaaactgccaattgtagctttttttcatttttctttgtatccccataaagaactaccataacttttttttttaccttgtgcgaaatgacatatgcaattttttaacaaagaagcagtcttatatcatgcgtgtgaggccatatatcaacattttcttcagtgcaacagtcttttctattctaatctgctactagaaaatcatgtgcctcacattttacaggatctttgatgatatgaatgcttaaggatgctattttgaattgctggttttctcagcaagcaaaagttgcatggttttgtctgatcattttttattacttcacaatgatgatagataggatattgcattgtgttgtctgatttggacattcttgaactgcagccctttaaacttatatttttcatattgtccttacaaataatgagatcttctcatcaaatgtttctagacaaacactgcttactacaggggaatctctgtgctctttatccaatctgcagagatgagggtaccagggagttgtacaaggttcttggtgccacttacatattgttatatgttatactatttaatgaatgtctaaaacacaaggaataggtcccccatcatagcaataagcttctgctttatgttaaaaaaaaaacgattctatgtgtgaagctttgtgatctcataggcaactagagaggtaaaagcacatggtaaacctaggttccactggtggagaaatgctctttactcccggtttagaaccctttgtagtcccaatttttcaaccgggactacgaatccgggactaaagatcgctatctttagttccggttcaaataaccaggactaaagatcaatctttagtctcggttaataacaccaaccgggagtaaagaggggaatctttagtcccggggatagcggcagtccctcgaggtcccttttctttcttttttttttcattgttaatttgctaatggctagagttaatccctgt

SEQ ID NO: 73830 - DNA, 8382 bp, Oryza sativa
attcctgcagccctgcagattgagattcacatacctggctagttggttttagtagagatagagctcaagctccaccagtacagtcatgctcgagctctactcagccagtcagccttcgctgcccctgccacattcattcgtgctcaagatttaatgtgcagccttgattaagtgccctagctccaattaagctagtactgccatggatgaacttgggctagaatgggacctattgactagttggtggagcataagtgtggagtgataacatatggtgttagaatttcccaccgtgccaccgtgattcattggctatgtgctaattgagctcaagctggagctctgccgtgtgccgtgttgagctcaagacggagactaccacacactcaagctcaggcgctgacgtaggtcaaacacgtagatggaacctgaggaagtgtggtgagctcgaactaaaacagggaagagaagagaaaagggggagatctagaggaagaacaagactggttcaatatgaaaatttttgcaaagatttctggttcaaaccgaaaagaatgtcctacctctagtccaacatgcaacaatggtcaataaaagtggcccaggatgcaattttctcatatagataagtgaattcctgataagtacttataaagtatacctttgaagtatatgcaaacccaaccttctgagttgaattagtaggaagaaacttgagggaacacaggtgccttctgagttgaattagtaggaaggaacttgagggaacacaggtgccttctgagttgaattagtaggaaggaacttgagggaacacagatgcaccagagagtacccagctggcagctgccagcagacgataactggattgaatgaacggtgagcataaaggtccatgtccttggtggagaaaactcaagtaaatcaaagatgtggacgttaggtaagccttattctccagttgattatgccctctttgactgaccaatagtaaattttgttattaagactgaaagaccaagaacggctatagagggggggtgaatatagcaattcaaatcttgcccccgaaaatactcatcaagccggatttctcaaaatccttactagaaccgcggctattagagaagccggatctagaaaagaagatagaaggaattcccgaaactagaagaggaagagaaaaggaattcccgaaactagaagagaggtgaggaggagtgagcaaaactcatcatcgcaaagttcaaattgcaagcggaatttaaattgtggaatttaaatggacaagacaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgaaaactctctcaccaagcatctcaaaaggattaccaaaggagcaacctccacccttgcatccatctctctatttatagcctaagacccctaagacattgtctcaaatacccctaggacgaaaccctatctcagatgcaatcctggctgttcattcttccttacatgcgaaggaaacctcttagatgcttgccacgtcgtcgatccgaagactcctcgcacccccgatccgcgtcgtgtccatccgagcctatccacatgcgccatgtgtccacgtgctccgcgcgcgctcgtgctctggccagcgagcgaagtttcccgcgcatcccgtccaaaatctgcgtaggacccacgcggtatagctcccgcgagagagcgcgcggtcaagtccgcgcctgccgcgtgtccctcacgcgcgcgcgccgtcgccgagatctcccgcgctcgcctccgagttgctgcctgccgcgtgtcacgtcttcctgccgatgccgtggtccgtcgaacgggaggacgccacgtcgcccgtacggctcccgccccccgcatgccttgtcttcatgggcccgtcgccgtgggctgtctccatcttgggccagtcaggaccggccatgtggcctcctgctgaccgaacacccgagccggacaggccggttggcctctcttccagccagcccacatgcagtcatgcatggtattggaccatatgcacgtatgcactgccgaagcatcacaagctagctagctaatcaactagctgcccatgcttgcatatgcacacactagtgcatatatgcaagctcttcttccattcaccattttctttgcgcacccggcacttgcacttgaccttgcaaagtccgttgcaaagacctcctcatacggtgttcgtccaccgtgtgcaaccttgtgtccaatcttgtcacccggtatccttgatcgctttggacctcaactcctccctgagtctagtcccgatccaccgttgaccaagatcgaccccgatcacctacacacacatgaaccaaacaaccattgtcttggcacagatgtcgcaacctgaccaatgttagtccacgcacacacttcttgcacttccggtacttgtcaatttcccatcacaaaagaactgtaaccacacatggtttcacaaagacattcaccgcaaccaaaccaaaaaagatgcttccgaatgctgactgaccaatattgcagaaaggctagctgaaaccacaacataatggtaattttccacattccagaagctggaatcatggtaatgagttgccaaggcttgcttgctgatttaattttttaaagttatgcataggatgcattcctcaattagcagacatgtttgcaactccagcgttggcatttgcttgccattccgctggtaataagcctgttcttggtaatattcctccagattacataagattttaaaagtaaaatcttggtatatagttgatgaaacgtgcttgctatttttggtttctaaatactcctcttaatacacattacagaaaaaaaatgctagaaatcttgaatttcacgtagtgaaaagaagaaaaatcatcgtcaccgcaatcacttccagttaggcggctactcatcttgaccggttgaatagatatggcgtaatagacatgatcaggtagtgatatgcagggagatcgagccttacctcgaactagtgcgccacggccgccgagggctcctcctccatccccgcatcgccggcggacgcgctcgtatcgtatatgtggcgccacgtggagacagtagtggcagaggatcgagcaagggaacgccatgcccggacctccttgcgccgccggcgccggtccacgcgcagcctgcctcatcgcggatcgtccggccggcggcggaggccatggctgccggccacggtggcggccgtgtgtcgcctgcttacgcaaatggagacggaggaggatttgtgcggcccagttatcatcagcaaaagagagccgatctcggctccaaaaaagcccacactaacaccaggcaataattacgcagcccgtatgagataaaattttttaggttaattagatccatgccactgtaactttgacaaattaaaaaaatgttactaccattcgtcatatccgctacatgtcactgggaatttttaaaattggaacccagggggaggacggccatggagcagggccttctcggcggttgttggtgatgggagcggtggagccgcgtcgggccgcaacggccgcgaaggcacgcaaggccggtggtgcggcggagtgcaccgggcaacggggggcctgcaggggaggcggaggcgcgcgggtccgcgcaaggacggcagaggtggaggggccacgcatggccgcggaggccgcggagccgcacgtggcctcgtgcagtcgcgctcgtccaccgcctcgtcaccgacggcgacccacactctaccccatggtggacgcagctatgctccgacgtcgccgtcgtgctcgccatcctccttgaccgcttcttcgacatggaacaccgccaagcaaaccgacgacgtcggcctcgcgcggttggtggactttgccgacgtcaagcgcatcaacgacagaatgcatctatgggcgggcaagctagacccgctgctgctacaagggatgtatgaccagggtgccatctgacagtaggtgggcgtgcaggcagccacggggagcgcgagcagcgtggcggcaccgtgccacgctcacggcacgtggggccgatggagccggcagagccgcgcgtcgagcggaggaggccggccggcgcagacggcggagccgtggagaggagggggatgaggacgggaatagagacggcataagagaggaggatagaaattatgaccggagtggcatggttctaattttaataactttcagtggcatatagccgatacgatgaatagcagtggtatttttttaatttggcaaattacagtggcatagatccaattaacccaaaaattttacagccaggtccctcaatgtttaaatgatatcccccgcaaaaaaaatgtttaaatgatacggagtatatggattgctaatttgctatatcattcctaacgatctggttatttacaaccagtcaatcaggtctccatttgggatcgctatatggtaatgatccgaccttttgcaaatcaactccacaaacttttttacacacaggtcaaatggagaaactatttaatgtaaacaatctgaaaactatcgttaattcaaaaaatatatatacgcttgagatttgttcatgtcacaattgcgagtaaaaatttccgtgcatcaccaatgcatcctcaccgcaaaaaccatggcaaattcagctgtaattttactcacagttatgacgtggaaaaatattactatacatctatttttagatccaacagtaaattttcactgtatattttccatgttgtgggtggacaggaagcaaatcctctaacatgaaaccctacatgtcaagcaccatgtttctctgactggcccacatgtcagtcaccacatattagcagaagaggcgagcgccaccgtcgtctctacctttactcccgccattgagtcggcctgcaccttgccatctccgtgcccatcttctccacgcacaggtaggcgacgccatgtcccgacctccagaacacctcgtacgccgccgccgccgacgatccatccaccgtgccatggacgtcgtggcagtggcacaggcgatcgatggcgccaggcagaagaaactcatccacctcgcgcaatccgatgtccgttcgcacggctggctcctccctcccatcgatcgccacgaccgcggcgctctcggatcctgacggcggcagctcctccggcgaggcgtgcggcgcgaagatggccgtcacctgcagcagaggcggcggcccggaatcttcagaggatctcctcctctcgccgtcgccgccgtgaccagatgatgatggtcgcgccgagacatgccgctgcacgaacagtttgatcacctgctccgggaatgtcgtcgtccctgacagctcaaccatgtcactgcttctgctctggccatggcagcatgccggatttggacgagcacggtgagtctcggaatggtggatgctccagtactctggatcagtagaatccacaaaggggaagcagtagaaggctcggtggtgaacctgagtgagctcctgctttgcagcttcagcgaccggcttgaaactagggagaagtgaatccaagcacctggccacaatcccagtcacgttcgtgcttgctgtcaaacgtagaagaattccaagaacaaagttctcctctggcctctcatggttgttgtagcgaagcaacacaccggcttcttgccctcgttctgcgaaactcattggctttgatattaggtagtactgatttccatgagaactttcatactgcagtgctttgcctgcgaggagatgcccagtgagaggatcaacgagcatgtagttgatgctgcctattctgccaaactccatgaatttcaggaactcgccggcgccatcggcgaacctttcaaacctctgaatggttgaagtggagttcaggctatcaacattcttgtcagcggcgaaggaggagaggaatgatcttgtggcaagggcgatccgtttggggaaagagcaccgactgatcttctccgtctcatcgtcttccatggcgcggcgcttgcatctgtccatgacatggctgcactcgtcggaggctcgcttcagcttcttcctccaacgcataagcgaggaatccatggccaaaggccacctgctggacacttccagggcggcctccatcttgatgtgtgccatctccagcctctccaggccatcttcctcgcttgatttgcggttatgattgtcgatgaggaaggtggagatcctgctcacagcctcaccgacgaccgcagaagcgatgacctcagacatcaggatgttcttggtgatcactgctgccctctattaaaaagggaattaaaggtcaggtgacaattattcatcacagaactagagatactggacttcagcacaaaatatacttaccacaccaaactggttgaaactgaaactagtgctttaaactgatagctttgcagattgtgaacagcataaacctgaatccagatggaaatggttcagagtcttcacgataccaattagacagtgaaagtcatgaaggagcatctgtacaatgagtgatgtcatgaagttgacagacattaggtaattaatgtgaccgtgatagcaagatgactagtcttcccttcacaacaccacaagtctgatgatttgaatgtacagttgatttgtcacaatcacacaaaacttaaaaagctgcctcgttgactgtcccaatcttgtaaaaagtctagctattgaagacaaattatcctcgtcaccgcaatccttttccttgaaaattcgtggtaatgcttcaatgtcatgttaatcatgatcttaaaaaactgtgtttcacttgcataaactcctaacagtttcagctgcacatacttaattatagtgccaactatgtatgtacttgctgaaagttgtagcatcaaaccaaagaaaaagttatcctcaggtgtgtctctatcattgtaaacaaagatcaacttagctcatgctcctcgttctacaatgttatttgcctgtatcaaaaacaagtggtacctgtttccctgcactaatttgtaatccagcgtttcaccagcaagaacgtgccccacaagagggtcgaagaacagataatagcatggcgtccctccaaactccacagatctcagaaaatcattagctccatctgcataccactcaaatcttcgaacaacagatctatttggctcatggatattgccgttatagatggataatactagagacttggtggcatgcacaatttgcataggaaaggatgaattccttactagttgttcagcctcttcttcctcgacgtgctgcctacacctgcatattttgttatcacactcttccacagcttcttttgccaacgtaatatcgggtcaccagtaatccgccacttatttgatgtctcaagtgtaacctccaacttgatttgtgccatctccaacctctccagatgatccgctgtacttgattttcactcacagctgtcaatcaacccagatgatcctctgtctcatgaaccacagcagaaacaaccacctcttctatcttcaataatctctacctgatcagcacagagcaagatatatcaatacatcaatcttttgcgaaatcgcaaaagaattgcacgtcaatatattagatcaatacatcattcaggatgctcaaataaaacaaaagatagatcagtgaattcctgataagtacaaagtgcattgttgaattatctgtgaacccaaccttctgagttgaattagtaggaaagatcttgagggaaaacaggtgagccacagagtatctagcagacgataactggtttgaatgaatggcgagaatgaaagtacatgtcttcggtggatagagaatcgagcaaaccaaaggtggttctctttcaagtttggttagtgctctagtctgttctccagttggtttctgcccactttgactgaccaatcgtcaatagtcaatactgaatgctgactgaccaatcttccagaaaggctagctaaagataaatatttttggaaataaacccctgtaggatttgttttcaacatataggtctccatgtacacactcccccttctgccgctgtaccacaccaaaactgaattttacatgtagctctctctcataagtcgatggttgggcgctcgcactcccctcttccggccctcccgctggggcgccgccacaagccaccagccaccacgccgt

SEQ ID NO: 73831 - DNA, 12308 bp, Oryza sativa
  unsure (1)..(12308): unsure at all n locations
attcctgcagcccagtgaaagatgatatgaacgattttgtggcatgggcgatccgtttagggaaggcgcactgcctgacctcctgttccatctcatcgtcttccatggcacggcgcttgcatctgtcatgatttggctgcactcatcggatgtgcgctttagctcttcctccaacgcaggagcgaggcgtctgtgacccgaggccacctgctggatatctcgagggctgcctccattctgatgtgtgcaatctccagcctctccatgccatcttcctcgcttaatttccatttatgcttgtcgatgaagaaggtggagatcctgctcacagcctcgctgactaccgcagaagcaactacttcagacatcaggatgttcttgtcgattaccctagcctgtttgtaaaaggggatggaaagataaggttacaacttacaattatattcacaacagaactagagatatagaggtttataagaatgtagcacggaatgtactcacctcaccaagctgcttgaaactagtgcttcaaacatactgcgattgtgacttgtgaagagcataaatctgtgtggtgaagaggggagttcaattgattcacaatgggacagtgaaaggtccttgagtacatctgtgctggaattgatgtcatgatatagaaatttggtaattaattaacatgaccgtgatagcaagatgacaagtcttccctccacaccgcctgtatttctccaaatactctgtaactgaatcaacttttgagtaatacatatgttcaggccgagaaaattgtgccatagttgtttcaaaaagagatgacaagtcttcatctgtggaaggatccatccgatataatgtgaattaaccaagcaaaagaaaagtctaagattgaacgatagattctggtgacaaattgattagtctcaatcacagactagtcagtcagaagaaataaggcgcaccgcacgacttgtcgacttaaccaaaaacaatgcttccgaatgttgactgaccagtcttgcagaaaggctagctaaagatgaatcctcttcgtcactgcaacatttttttttaaagaaaaaatcattgtcactggctcagtgcaatcacttccaggcttccagctactcctcttgaccggttgaatagatctcgcgcagtaaacgtgatcaggcagtgatatgcagggagacggagcctcacctcgtgctattgcgccgcggccgccgaggggaaacatcggtctcctccatctccgcatcgccggcggacgcgctcgtatatgtggcgccccatggagacagtggttgcagaggatcgagcaagggaacaccatgctcggacctcacctccttgcgccgccgccgcgggtccacgcgcggcgtagcctgcctcctcgcggatcgtccggcggcggaggccatggccgtggcggatgatggtggtcggcgaggagggtgaactggagacgaaggggtggcccagttgtcagcgaaagagagtccatcgcggcccaagtataagcccacacttacaccaggcaattacgcagcccccggatcagatgagatcagaaaatttacaaccaggtccctcagggccgttttggattgaagccaaaacgtgccataccaaaattttggtaatttaaatagaaaatgtgctagtttgaattgatgccaaacaattggtagtgcccatgttcaatttggctatattttagaatcttcctcaccatcctattaaaatttggctttatattggtcccaaaccaaacatagctagctaactttgctctacccaaaaagtatggtagacacgcatgtcaatacatgggtggatgcacgcccccttctaacaccaccggccgtcacattggagcacaggaggcaagcggcaccgtcgtctaccatcagaccagccattgagtcggcctagggacacaagcaagccgacttgcgagctcacttatagatcaaatatgtgataatccgtaggtttttatatcgtggtcccgcttgccacatctagatatgtaaatagatcaacccatatatccatttatagtttaaattaatagataacccgcgagttacccactaaattttgcctataaattaaacgagctcgtgggttggcccgcttgtatctcaaatcggcctgcattttgccatctcggtacccatcttttccacgcagaagttggtaggcgatgccatagtgggacttccagaatacctcgtgcgtcgacgatccatccacagcatcgtggttgtggctttggcgatcgacaacgagtcaatgactggtagaaagaactcctccacctcaaacagcacagcccaatgttcgttcatggcttgctcctcccttccatctatcgccacagccgcgacggccgacggtcatgtttcgggatagcaactcctccggcgacgcatgtgtcacttagaccgccttcatcagcagcatagatgccaaggaattttcagaaaatcaactactctcgtcgttgccgaccagataattgtcgcaccgagatatgtcgttgcacggacaatttaatcaccggccggctttaggaatgcacctgatggctctgaccatggtgctcttgtccttcgcggcatgccggttttgggcgatgtgctagcggctggtgggccttcttgaaaacgaaagggtagatgactattttttaatataaaatcctctaatttttttggagtagaacagagtctcttggagcaaaaagttgttattgttatagttcctttctttatttattattttcctcaataataacgtgtcactgatttataagttctttttatctttaaaaaaaagatatgcctacatatatctaatacgatatgaccgatgacaggtatagccggtgagctggctattctatttgtcaaaaataagtaaatattgtagataattttgaactataatataattttattttgatgatagccacgtaatagcagggccaaccttgctattttttttttacattgagtaatttgtattggtggtacacaaaacttattaggtgggtgcaattaagtatataaatttataaaatgctcgttttaatacacgaacttgtctaattcttgcgaatgaggatcaaaataacttggcaatgctaattatacgaaaccgatgttgattaggatgtgatgtgaatacgtgtagtgagtatgcataagatatgcaatatttataatttgatccttactttatccatgatgaatttcatatatttttaacccttatatcattgcttggtatttttaaaaatctttttctacaatcactatatcctattctatttttttattgaagaggtgtatatctaattacaaccttcttatatactccctctgtattttaatgtatgacgccgttgactttttaaccaacgtttgactattcgtcttattcaaactttttatgcgaatataaaaatacttatatcatgcttaaaaacatttgatgataaatcaagtcacaataaaataaatgataattacataaattttttgaataagacgaaaggtcaaacgtttgtcaaaaagtcaacagcgtcatacattaaaatatggagggagtatatgtttacatagtatcataatcagcccctaaatcaataagattagccatgtagtgtcattttcatctttctccgcacgtaccagacaagttcatgcaccaaaataagcattttacaaattcgtgtaccggcgatgcaatttactctttacattcatgaccctacccggctacttgcaacggatgtcagcaacccacaaatttacaatcaggtctgtcattggatcactaccacaatcaggtcactcatagagattacaaaatttacaatcgaaatccctaattttggcatttctttttttgcaaatcaatacctatcagtttttgttttttttttagaactagggccagagagcccccatttctcttactagaaatgagcatatccttacaaagtcagggaaacaaaaacaaatacgaggaaagaaagctaaagagcttatccagatgcctcacagggctcgatggctgaacacgaataacatcattcggtcatcaaaaggataaaacagatcacaaaaaactaataacatcttcatccttctatcctccagattccaggtctccatccatgtcttgagcagaagatgtcacttgccacctgtcttataagtctggctcccaactgcagtcttcttcgatttgcttccaactttgcaaagatgcccaggaatccacccaggaacaagccataaagaccaaatcagtaggatctcttggaaatttattttcaaaacaagctttattcttggacttccaaattgtccaaatgattgcagctaaaccaatcacaatcaagtgtttcatgtttttatcatgtctatccagccaatgtccaaaaatatcctgatgattcaaagtaggcagtatatccaaagcacaacacatgatattccagagaagtttggccaaagggcattcaaaaaacaagtgctgtatatcctcttttttatcacaaaattgacacttttcattcccctttctccaaccttttttatacaagttttccttagtgagaattttgtttttaacaaacagccaaataaagactctaattttcagaggaatcttanatttccatattttcttttgagggaaagacacctgatgcattttaagggctttgtaaaacgatttcacagaanaaattccatcctttgtcaaattccaatagattttatcttcagagtcatcctgtaagttcagactttccagactgtttttgattctcacccatctctcagtttatctccctctagatctcttctgaatttgatgcattgcaagcctttcattttcacctttgcaattgtcacatgtttggtcaaagctatattgtacagatttggaaactgaatgttaaggggttttccacctattcagctgtcctcccaaaacaaagttcttttcccattccccactttttttgaacaaaatttaaaaaaatcatcctttacttccatcaacccatgccagaaatgagagttaccctgtttaaagtttacctcagacatagttttatttttcaaatatttccccctaagaatctcctgccaccaaccttctttgttttccaaattccaaatccatttccccaacaaggccttattcataatgtccaggtccagaacacctaaacctccttgatctctaggtgaacaaataatgggccattgcactaaatgatattttctgatgccttggtcctcctgccacaaaaacctcctcctgaagaagtccattttttctttcactcctttgggtaacttgaaaaatgagatcatatacatgggaacactgcttaaactagaattgatcaaaattaatcttccccctattgactatcagttttggtttttacatagctctcatagatcgatggctgcgcggagtgggcgctttctcttccatcctcttgttctcccgccgccgccgccaccaccagccaccgcgccgtttccgccgccgcaccagagctgagctcggcgatgccacaacctttcacaatgacacggccaatgagtccgcctgcaccctgccatctctcttcccatcttcttcaagcagaggtaggcgacaccatggccggactgccacagcacctcatgcgtggacgacgacgacgacgatccatcgtacgccgcctcatggcggcacaggcgatcgatggcgttgggcagcagaagctcctccaccaacattcctgtgcacggcttgctcttccctcccgtcgattgcttcgacagcaacgctccgggctctgggcggcagctcctccagccaagcgtgcggcccgatcacggccgttagctgcagcaggggtgtcctcctatcgccatgaccagatgatgatgatgatgaagaagacgatgatggcttctgccatgcagagatataccgccgtacgaccaatttgatcaccggctccgggtatctaccatggtgattgtgtccttggcagcatgcggagtttgggcgagcatggtgagtctctgaatggtgggtcctcctcgagtactctggatcggtagaatcaacaaaggggaagcagtacaaggctcgatggtgcacctgagtgagctcctgctttgcagcttcagcaacaggcttgaaattgggtggtaacaactccaagcacctggccacaatcccggtcacgttcgtgcttgctgccaaacgtagtagaattccgaaaatgaagttcttctccggcctctcatggttctggtaccaaagcaacaccccggcttctagtcctcgctctgcgaaactcattggccatgctgctaggtagtgctgatttccttgagaaatttcataccgtagagctttgcctgcaagaaggtgcccggtaagaggatcaacgagcatgtagttgatcctcctgcctatgctaccgaattccatgaatctcaggaactcgctggcaccatcagcgagcctttcaaacttctgaatggttgaagtggtgatcaggctatcaactttcttctgtccagtgaaagatgataagaatgatcttgtggcatgggcgatccgtttagggaaggcgcactgcctgacctcctgctccatctcatcatcttccatggcacgacgcttgcatctttccatgacttggctgcactcatcagatgtgcgcttcagcttcttcctccaacgcaggagtgaggcgtctgtgaccggaggccacctgctggatatctccagggctgcctccattctgatgcgtgccatctccagcctctccatgccatcttcctcgtttaatttccgtttatgcttgttgatgaagaaggtggagaccctgctcacagcctcgctgattaccgcggaaacaactacttcagacatcaggatgttcttgttgataaaccccttcctgcttgtaaaagtggaacgaaaggtctagttagaactgttcatgacagatctagagaaacagaggtgtacaagaacttagaacaaaatgtactcacctcaccaagctgcttcaaactaatgctttaaacatactgcggttgtgacttgtgaagagcatacatctgtgtggtgaagaggggattcaattgattcacaatggcagggggacttgtcatccggtagcaggatgacaagtcttccctcaataccgcctgtatttctccaaatactccctgtaactgaaccaactttggaataatacatatgttcaggccgataaaatttctttccatactcgtttcaaaataattaaaagaaaaaaaagacaaatcttcttctgtggaaggatccatcaaatataaaatgaattaactgaggaaaataaaagtctaagattgaaagatagattctggtgacaaactgattggtctcaatcacagctagttggtcagaagaaataagtccatgactgacttcgtggagaaaaaggttagcaaagcaaaattgtgttttctcagaagttaagtgggtcatgttggatgtatggtctaattaacatagcacaaggtgagaagtgagaacacatcactttttagactctaattaacatagtctccgtatgatttgtcaagcaagaaaactgccctctatgaccgtccaatctcattgcaaggctagccaaagataaatcctccacgcctctgcaattaggacaatttaaagtaactactcgtcactgcaatcagtttcgggtactagtcttgactcttgtgtggtcgaacagatcttttgccaattctcactgaacttatctttcccctaaaaagaacagtaacccattgcctaaatctgttttgcaggttgtgtacagatcgatagccctgatgcagcgctggagggtgctccaaacaagaaaagactgcgccctgctagagctggacaacgtttttaagaagctgatggataagatgtacaggctgtgtctagtttcttccaaagttgaaagtttggattgaaattggtacgatgtgactgaaaagttgtgtgtgtatgacaggttgatgtaatggaaaaagttggaagtttggattcaaagtttggatctaaacacagccacagctttggcctggagatgccctgccctccgtccctaaatatttaacgccgttaactttttaaacatgtttgactgttcgtcttattaaaaaaattaagtacttattaattcttttcttatcatttgattcattgttaaatatacttttatgtatacatatagttttatatattttacaaaagtttttaaataagacaaacgatcaaacatgtttaaaaaagtcacggcatcaaatatttagggacggagagagtattagggaagatgggtgtgtgggggtgtttttggctggtttactctctgttctcccttcctggagatgggcaaagggcactgaaagctgacgatcccagtggtttaccatgtttccgatctggtagttttatttttctgttgtgtaagattctttcagtaagtttgaggctttctttcaaaaaacagggtaatgaaattacctgcagtttttttttaaaaaagaacagtaaccaaactgcacagaacaggtcgcgacaagcagcagtgaaattgaatgcgagcaaaatgtcgtacatatctgggatggagcgtatctgggatggagcgaattaacgcgaacaccatattacataaaatggcagatggcatttactaggaactgtcttttgtccgtacaactaagtaacataggaatgcgatgcaatagtggtgtggcgtcttgtaaataggtggtggctgcgaagcctcgccatctctgtgcattcttcaaattctcaatatactacggtcggcgtgccgacccggcgaatgcgatgcaataatctaccgtacaaaatgtaccaacctcatcaagctggttgaaactagtgcttagaatatactgtaattgtgccttaaccaaaagtttaagattgaacgatatattctgccattctggtgacaaactgattactctcaatcacagactaatcagtcagaagaaataaggaacacagggcttaaccaacctcaagctttgcaactgggctaagtaaaaatactgaaattattttaaacaataagggaatacctgtctgcttgtctgcttgatgattaaaattgtttggcttgacatgtccaccttcctcactcacccattcacagacccagcaatcaacttgttctccttcttgcaacttttttgtgtttccctttgtttctgtgtttcagtagacgatgaagtcagaataaatatgcatgtgttttaatgtttcatttcggaatcatcctaaatacatataatctgaaatgtaaaccgccccgaggataccactgtatgaaaattactgatatgcaaattacaatttttttacaaaaaataaagtgaatgggaatatgaaatagcaggaaatagggtaagtacaaaattttgtcatcaccttcaatcatggtaaacgcatgcgaattcaaataaaatatgtcacgcccaatgagtgaggatgtacattagattgatagagtatgaacatcatattatcaccattcaccaacataagtgatcagctggacaaacaatagcatatggagacatggagcacacattacagatcaacacactcctaaggacttctaaatttaactacctacaattcacttttcaccctataatattacatttccattcttcttaattctccctgtctccttaaccagtctctgtaaatgatctaaaatttcagacgcaatagtggagatgctaactctgtttccttttctttctgaatccaatcaaggatagagccctgcagctggacaggcgcatgagcagcccagaggttaaggaagtcacagatgaagtcacaggtcacaactgtgcgcctctgcgttctctgatccattccacgcagcagctttgctttcttggctcctcgaatggttctccgtgtgctcgtcatgttcatggttgccttcacaacctcaagatatgcaccgccatgtttagacttccaaagcatctggtacactctagcttttgcattctgatgaaaacaatctacagcctttggcagcatgatctgttccatttgttgtaaggcaatgtttgtgtgcaagcaatgttgctcattagcattaatcacctctaccacagaactctcgactgttgggaataggtctcctgaagagccatgcggcatatagataatgttaactttcaggtgcggaacttctttgatagaaggtttgccctcgacgatcgttccgcattctccaaacccacgcagtgaaacttcgcacttcaaactcacttcaataattggttctagagaaacgttttgtaatcctatcttgtccgtgtttccactgccacgtaccttcgcaccatgatgcttgcaacacagtgggtttgggcgaaaccattcaatagctatactatgaatgttgtaccaatggtttgaatgagcctgtggcacccaggagaagtcttgtgtaggtagcagagtaagttgctttctaacattttcagttgtagacttgaaatgaggggtaaacaactgcaagcccttaattatagtgccaactatgtttgtactctccgaaagttgtagcagcatacccaaaataaagttaccctcagatgcagtgccatcactgtaaacaaataacaacatagcttgtactcccctctccgctatgttattgggttgtatccaaaacaaaagctgcctgtttccctgcactatgtactctagagtttcacctgcaagaagatgcccaataagagggtcgaagaacaagtaatgacgtggtgtgcctccatactccacagatctcagaaagtcattagctccatctgcaaaccactcaaatcttcgaacaactgatctactcggctcgtctatattgccatggaagatggatgatatcagtgacttggtggcatgcgcaattcgcctaggaaagaaggaattccttgctacttgttcggcctcttgttcttcctggacacgctgcctgcacatgcgtattgtgtcatcgcactcttcagtagcacgcttcagcttcttctgccaacgtagcaatgggccactagtgatctgccacttattggatgtctccaatgcgaagtccaacttgatttgtgccatctccagcctctccaggttatcctgtgcacttgattttcgctcacacctatcaataaacccggatacgatcttgttaaccgtctcgtgaacgatagcagaaccgaccacctcttccatcttcaataatctctccctgatctgcgccgagcaagatacatcaatagatcgatcaggatgcccaaataaaacaaaaaatagataagtgaattcctgaaaactaataatgcgttgaagtatgtgaaaacggtaaaccgaaaccttctgagaggtgcaccagagagtacccagcacacgataactagattgaatgaatgctgagcctgagcatgaatgccatgtctttagtggagaaaaatcgagtaaatcaaagttggttgtattggaagttagataaccttttttttagccgggttggccataagaagaggccaaccaaatcttattaagattatgagagcaccttgacattaggtaacccttgacatatggttcgagaagaacaccttaattactattacactatgtgattctcctaattggaactattatactatgtgattctcctaattggaagcattaggagaatctgatgtcttttaatgcgttttttttgggttcttcttagccatggtaaggcgtggtgctatgtttggtgatcattttgccagtctgtctggtgtctgaacttgtaagcagagatgcgtttgacaggggtttgttagggggtagcaacctgaacttttgttgtgaaccttgtaatcgtatcgttttcattaatgaaagcgggaggggcttgacctctctttatcaaaaaacaaaaaacaaaaactatgtgattctccagttttttttaatgaaaacgcaacgattacagaagttccagagaagttcagcacgaagacagagggaacaaaagaaaaaaaaaacagaggacgattctccagttgatttatgctctctttcactgaccaaacgcaaattttgttattaagataagattgaaggcaaccaaaccaacaaggatggatgcttctgaatgctgattg

SEQ ID NO: 73832 - DNA, 2157 bp, Oryza sativa
  unsure (1)..(2157): unsure at all n locations
cgccgaagactttccgtccgatttgtgtacggaccccccccccttttttgaattttctgtttattggaaagagtacagggggtatgaataaacgncagtagcagggaagaacaggggagagcagtagcaagggaattggttctaagaaaaggaagagaggggatgatccaatcttatctaaatatctgtctgggacttaaccgatgtgggagagaaatatttactcccggttgataactccacccgagactaaagatagatttttagtcctggttggtagtaccaaccgggactaaagatctaaatgatctttagtcccggttggtagccccctgacatacctctgacagggatgaaccaggactaaaatcatctttagtcctggttggagatcaaaatttttttaaccggaactaaaaatcgtttttagtcccggtttttaatgaaaccgggactattgtggaatttggtcgaccgaccaaagatggtttctccaccagtgttcttatacattttcttaacattgatttttattttaactgcattttaagttgatcttaaaatcggaccatatgatttacttactctgaatagcttattttctggatgttcttcaggaatttggatgcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactccatcgttataaaaggaaacgctctctcactcccttctcatcacttcgctcactcactctcactcatttcctcccattagtcttcccactcacgtctcactcctctcactcacttctcactcgaatgagtcagcagccaccctgttgtgggcacgcattctaaggggctgccaaggcaaccagggcgggaagggtagtcggggtcagctaggatgaaaaggagaaccaggtggcgacggtggcttgagcgtacacggtggcgcaagcggcgacggtggtggtctaggttaccatggcgctagaggaggatgaggacaagatagcagaaatggtggccgcgggtcaacggcagtgggcgcataaggtctagggcgaggtggtaagccatgatgcggttatgatcgttaggttggtttagtcattctttttacaacttgcctcgatccttactgcaaatggcaaattcatgcaagaaagagtgtagctaataggtggaggataactagtgcaggtgaagacaaacatgctcagtgcggaattatctggccagtacttgcaactaacttccagggtttattggccacaggttacagacatttggtcaaactgagcccaatcttgtgtccctgtagggatnggtcgaggcaagtgagcaaat

SEQ ID NO: 73833 - DNA, 1994 bp, Oryza sativa
ccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcacctcgccctcgtccggccaccgccacgagtcagctgggaggcgcgtcgctgcgaccggagaggcaccaggccgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccgcacgtcccgatttcggcggcctcaactccacgatggatttcagcgtccgagcccgcatccagagcccgcaccagtcggccgcccacttcgtcgccggcgagaggtgacaccgccgcccggcttcgtccagggtaggagtcactgctggttgagtttgtggagaacgacgcaccttttcctgtgcccgcgaggtgtttgtggaaatgccctgccgtctgggatgatgcagagtcctgattgaaagtgaattgttattgtttggctttgtgagattagaagcaaattgattctgtaatcttgattgagattgatttggttgtatgactcatatatgctgtaatttgaatgaatgaatgaataaatcagtaacttctgacgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttgctgtagtgctatcgtgaaatttcatggtcagtagttcctgtgcatggtcgccctgatcaatagtgggtaggacatctttggagctgtttttatgcgagattcctgcaaaattcctagtacgaattcatgtgttgcaaacaagcccgtatgtctccttcatttcttgatacgatagggatggattgtgttttggttgacaaaatccaaagagagcaattttgtgaatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcggcctggcgcctcccccggtcgcggcggcgccggacgagggcgaggtgaagcgccggcgtacgcggacttgagggcgaggctaagcgcgtgcgggcttcctgttaggctgaaacggggattttttttgcctgcgtgcgggtccaagcgctaccttcgttggattcgttttgaacgggcgagatgcatcgtatgtcacgctgtgacttgccttagctaagtcaccagctgagtccccggcggcggagggcggagggcggaggccatggcggtgggtgaggtggtggtggtcgggttgtgcttgtgcagcccagttgcagtgaaaaacaaggccgagcccaagtaaggcccacactagttcaactcggcccgcacatttaatcatcagagcaatgcaacccagggatgcaagcggtccaacccgcgaacctgcttataggtaaaatgagtgaataacccgcgggttgacttgtggattacctaataatttgatatatgggctgcaggaa

SEQ ID NO: 73834 - DNA, 5440 bp, Oryza sativa
  unsure (1)..(5440): unsure at all n locations
ccgctctttganaatcgatattcgagctcggtacccatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatatatatatatatatatatatatatatatatatatatatatatgtatatatatatatatatatatatatatatatatgtatatatatatgtatgtatatatgtatatatatgtatatatacatatatatatagatacctatatatacatttatttatatatatatgtatatatatatatgtatatatatatatatacatatatatatatagatatgatatatatatatatatacatatatatatatatatatatatgatatatatatatatacatatatatatatatacatatatatatgtatatacatatatgtgtatatatttatataacacaagaaaaaaaaaatatatatatatatgtatatgtatatgtatatatatatacatatatacatatatatatatatatacatatatacatatatacatatatacatatatatatacatatatacatatatatatacatatatatatatatatatacatatatatacatatatatatacatatatatacatacatacatacatagatacatatatacatatatatatagatacatatacacatatatagatacatatatatatatatatacatatatatacatatacatatatatatacatatatatatatatatatacatatacatatacatatacatatacatatacatatacatatacatatatatatacatacatatacatatacatatatatacatatacatatacatatacatatacatatatatatatacatatatatatatatatacatatatacatatatatatatacatatatacatatatatatatatatatatatatatatatatatatatatatatatatattcaaacaaatgcgagattattcgggactaaaagatgttagtgtattgtattctatgtaagacatagatgtctactgaaaataaaaataaatgggccatacgagttgcagagggactaaaggaagtctcggtgtcatatggaccagaagatgaagataagaaaagcaaagtattccctgcaaaaaattggtcaaacaatgaatacgaaaagtatttacacaaaagcgaaggtcagaatatttggaactaagatgtatgttgtaatacgttggatatcttatatatatgtctactgaaaacaaaaggaaatgggtcatattagctacagagggattgaaggaagtctctgtgtcatacggaagtgaaggtaaagaggagccgaggaaagcattccccatgggacaatatatgttagacaaggaacgagaaatgacttcacacacagataaaggttagaacatttgcatttggtatattgcattttcatatatgtcattgaaatatatagagaactaaataaattgtttctatatgggccttgaactagagacaatctcaaagaagtccgcgtatcatatggcccaaaaatgaaactaagcaatttgttccctactgggtatgaacacaacatgtagtatataatacatatacacgcaacagaagctgaggatatttggaactgtagggcactagtgtaatatatttcatgtatttcttatatacatgtatattgatttttttttaaaaaatggccttatgagttgcagatggtctaagggaagtttcggtgtcatatggaagtaaaggtgaagtggtgactcggaaagcatttcccatggaacgatacgtgctagacaaagaacctaaaaggaatctgcacagaaacaaaggtcagaatatttttaagtacagttgatgtattgtattttcatatatcatattgacatatgcagaaaactaaataatttttttctaaatgggcaaccaactttagatgaacttagagaagtctcggtgttgtatggctcaaaagggaagctaaaaaatttgttccccactgggtatggacataagaaacataagcatgcaaatgaaggtgagaatatttgaaattagcggatattggtgtaatatatttggtctatatcttatatacacatgtttattgaaaatttcaaaaatgggatgaatgagctacagcagatctaaaggaggtctcagtgtcgtatggaagtaacgatgaagagaagccaaggaaagcattccttagaggagggctttttttaggcaatgaatatgaaaagtctgtacacatagacaaaggtgagaatatttggaagaacatttggcgtattgtattttcgtaaaagttgttgacatatatagataatataaaaatattttctgtattgcccgtaaattgtagaggacctcaaagaagtctcagtgtcatatggctcaaatgtgaaactaagcaatttgttcccaacagggtatgcacatcagaaatatatattaacaagcggaggtaacattagaactagtggatgctcatgttacgtatattgtgtgtatatgttatatacatgtatatttgaaattataaaatgggccatatgagttgcagctggactaaaggaagtctccgtgacatatggaagtgatggtgaagaggagccaaggaaaacattctctaaagtagggtatatgttagataaggaatgcaagaagtcttcagatgtagacgaaggtacaatattttggagtgcattatgtattttgtatttttctctaggttgttgacatattcggaaaaactaaataaattgtttctacatggaccatgaactgtagaggaactcagagaagtctcagtctcatatggcccaaaattgaaactaaacaattagttccccacagaacataagaaatatatatacacaaacgaagataagattatttcgaactaaaggatgttagtgtaatgtattgtatgtctcatataaatgtatattgtaaataaaataaattggccatatgggctgtagggggactaaaggaagtctcggtgtcatatggaagtaatggtgaagaggagaccagcaaaaccactcctatgggaggatacatggtagatatgaaaaacgaaaagtctctgcaagcagagaaaggtgagaacaggatgtgtgcacaattcatgaattaatatattgttgacataatatagaaaactaaatgaattgtttctacatggactgccaactgtagaggaactcaaagaagtttcagtgtcatacggttcagatgtaaaactaggcaatttgttccccatagaacacaagaaatatgtatacagaaatgaaagtgagattattttgaaactaaaggagatgttagtgcaatgtattgtatgtcttatataaatgtctattgaaaataaaaataaatgagccatacgagctgcagatggactaaaggaagtctcggtgtcatatggaagtaatggtgaagaggatacaagcaaaacctttgctatgggaggatacatggttgataacgaacgtgaaatgtctctacaaggacagaaaggtgagaatagaaagtatactcacaattcatgaattgtagttttgtatacattgttgacataatatagaaaaccaaataacctgtttctacatgcatgagctaccaactttagaggaactcaatgacatttcattgtcacatggtccagatgtaaaactaaacattttgttttccacataacacaagaaatatatatatgcaaacaaatgtgagattatctgggactaaaagatgttagtgtaatgtattctatgtaagacatagatgtctactgaaaataaaaataaatgggccatacaagttgcattgggactaaaagaagtctcggtgtcatatggaagtaatgatgaagaggagacaagaaaaatcattcctatgaaaggatacatggaagacagggaacacgaaaagtccctacaagcggagaaaggtgagaataggaagtatgcataaaattgaattgataagtatattgttgatataatacagaaaactaaataaattgtctctacatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatagttcactatgcttgtaactcaaagatacaaagtggataattgtaataataataaaataaacatggttcaccaatctagaaatttcaaccattggcggatcttaatatatactctttccttgtcaaaatatatatctatctttgtatttcaaatttttacctcttaaccacttaagaaatgcatttccttaagatcttattcggtttagaggggattaaagaggattggaggggattgaggaggaataattccacaccacaatatgtgtggaataaatctcccccaatccgtccctcacagggattaaccaatcaaggcctaagggagctaccaaaatttatctcacaagttatactttcaattctttttcaaactctctgagacatatacatacatgtgtgaaacattaattttctttttttttctttcttttctatatggtatataaggatagaatgatattttattcataccgnttgtcgctgcatgcgaggatgacttggcatgctcacgtagcacctttttggg

SEQ ID NO: 73835 - DNA, 5467 bp, Oryza sativa
tgcagccctttcaaagctatgagtgaagttttgttttctgttaagttataaaaatatatatgcgctcaaaaaagtgtatgtggacatacgacaagtgatagagaaaaaagccgaacgcaatattcatcgaatgtaatatttttccttgtgcatgtatttcttcatttccgtactgaaaggaactcatatgatgcactggattattagaatttatgtggtattggattacaccatcgtgatattcgaactactcacagtcattgtttttatttatttttaaatcctagctcaatgttttaaaatttagtggttgaatagtgcgcgacatttttaaaattgcgtccaccgctccaccaaaccaaactagcacgaaatctctcttatggcaccatcatcctatagttagcgtgaaatctattagtgtgacacctgtgtcgtgctatatatgaggtgacaccaatatattttttcagaagttcttaaaatcggtatattcacgcaaaacactatgcaaaaagtgtgttttcaagaaaaaaaaattcccacatgccaacatacactaggaatctagcctttccattatctattatcttattaaaggaataaaaaaagaagtctccacgttcgctctcacggcctagaaattctcatattaatcagggaaaaagaaaaacagagtccatatagaaatacaatttaaaaatagctaaaattcggaattaaaaaataaggaatattagaagaagagtatagagtccatatagaaatataattaagaaataatagaaattcagaattgaaaataaggaatattagaagtagagtacagagtccatacagaagtacaattaaaaaataatagaaatttgaaattaaaaataagtaatattagaagtagagtatagattccatatagaaatataatttagaaataactaaaattcggaattaaaaaataaagaatattagaagaggagtatagagtacatatagaaatacaattagggaataatagaaattcggaattaaaaataacgaatattagaagtagagtatagagtccacatagaaatacaattaagaaataatagaaattcagaattaaaaataatgaatattaaaattagagtatagagtctatataggaatttaaaactaactaaattttggaataaacataataaaattaaaattagagtttagagtccataaaaaaatacaatttacaaataaccaaacttctaaattaaaaaaacatgggaagaagagtgcaaagtcaatacaggaatacaatttagaagtaaatgaaattcgaaattaaaaattaaagaatattgaaagatgagtttagagtccacatagaaatacaattagaaataataaaaattcagaaataaaaataataatattagaagaagagcctaagtatatatagaaatacaatttacagaaaattcagaattaaaaaaaatattaaaagacgagtctggagtccatataggaatatatataatctacaaataattaacatttaatattaaaaataattaatagctaacacatatatgaaatacaatatgaatattacacattagtagtttcgtaaagatagtacaaaatttaaaattatgtcgctcattttacatatttgaataatacattgagaaaatatatatgctcttatagagagaaaatataatgatgctagccgcacaatctgcgcggaccaccatactagttattaaataaagagaatacctgcaatgtgactgattcctgagatcctgtttcatacaaaaagatctttttgttgttcggtagtttcaccgactgatattccgctaatctccagtctccacagttcaccatctcccttcccacctccgaatgctcttcttccatcatctccattgctcactgcctcactctcgtcagctctctctctctctctctgctagtgcttctaggatccatcatccatggctgcttgcaaagtctacttcttgtgcagcatattgtaggattctattgtttgagaacattttagggagttgcatgttacaggtaaaccgcacttctttttcctgaatcaattctacatatgagctttttttcatgcacaaaaaaagtatataggcattgaatgaatctacttgttcttttttagtagtgagaggtctttttccacttgacaaaatgagaggtctgtttccttaattcagttaaccttcgttctgcaaaggatggttcagtgctttctgttactttgtttgccgatgtactggcgattattccctgaactctgtcttaccttataatgaaaaaagttcatgaaacagagtacaattgttcaaggttatttctgttttacacttcacttcttagttctgtgtttttcgtttatttattttcatgattgattttttttagacaatggcttttatgattgaatatgacaagaaacaggggtagctctaaatctaaatatccaagaaaaagactgtgatagttgacaaaaatatactcatggatgctcattactttttactacagttcaatgcatgtgtaactatagatatatgctttccttgtctacaaagtagggaatctgagggagcaaaaagtttatcacatggagggagcagatgaggagaggccactaattcatcacctgcctccacaggtactattctattaccttaagttggtaccaaatatattgcatctccatgtgacacatgacatgtaaagtcgataattaatttggcttcagtttatcagaaagaaacaagaaatacatgagttctcgcagcaaatttgcacatacatttaacgccgattctgtgtaataaaaattagcactggcattgtcattcaggaacaatgttcgcaatacacctgcgatggaacggttgatatcgacagaaggcccgcactgaagcatagcacagggaattggagagcatgcttcttcattttaggtatttcagagaagttcagaaatattccaaacaaatttaacactttctttgttaaacctgcacaacttttaaccaatatatattgggtctgaacatatatgaactaggtgctgaattcactcaatgcctgtgcttctctgcggtcgtgaagaacttagtcaggtatctgacgagtgtgctccaggaaagcaatgtcaatgctgcccgaagtgtgtcgacttggattggaacttgcttcttcacaccactcattggagccttcttggcggacacattttggggaagatacaggacaattgtaatatgcctctctgtttacagcatagtaagtgcaacaatcagaggctattaactgaataatctaatctatcaagtaaaattgctccatgaacatttcctatttttgtcagggaatgctcattctgacgacttcagcgtcgcttccatttctccttcatgattcctacaacaatggcgacgacattcgtcgtgttgtcgcctacctagggctctacctcattgcacttggagctggaggtatcaagccctgcatgtcggccctcggggctgaccaattcgacggtgccgacccggtagaacgggtgacaaagggctcattcttcaactattactacttctcaaacaacatgggcacgctgctgtccactaccgtgcttgtctgggtgcaggacaacatagggtggggcatcggtttcgcgactccgatgctgctcatgggttttggcctctccatgttcgtcgccggtaggagggtgtacaggtacaggaagctgggaaggagtccattgacaagggtgtcccaggttgtggttgcagctgcgaggaatcacaggctcaagttgcctgatgatagctcactcctgcatgagctgccttcactgaccgaaggtggctataggattcaacataccactcgattcaggtactattgctcatcatatcatcaaaatatatgtctagttactgctgcagacattaacctcaaggtccacaacctagtgataagcttatatatttttcaccatcactcttatgatatgagtggcattttgtgcaactatgtttagagtatgtgttgaaccttaaactaagcaggaatcttctaataacaatttattgaacgatcattgagcttataattataccacgcctaccaagaaaaatctgtcgcgttttgtggactaaaatttcctatatgtggaattcaccttcgtcgattgcttcaagagatatcaacagtttatttttgaaaacaaaagcagaactttgtctcatttcattgataagagttaccaagaaagggatcacacggaaaacaccatcctacaaacttctcaagatcattcctcaaagctacacttaacacctaaaaacaccaatgcaaccaaaaacttaaggatacatcggtttctaatttactctcagagaataattccttgttctttcttgaggcgatttgccatgcgacatatggggtaattaacagcatgttcgaagagctccaaaatctgaaatggatctagagttgtggacctaggaaaagttaactccatcattttaaaatgttttataaattagattcacctgctctgctcttaaagaaaaggaatatgggcttcagctctaccggataaggatccagatgagcttaaacccctgccaggcatgttctaactatttgccactctatagattactttgataatataccacttaattaacagatgttaattaatgattttccaattctaatttttgtaaaggttatttgctatcttaaaagttattactcccttggcctgttccataatacttcttgatatttttgatattaacacgatttacaaaatatatatgtaactatgtttttctcttataatacatacaataaataaatatattttccttttattatagtactttgtaagacaaataatttaaagttattgaatgtcaaagatataaaaatttaatctcaaccttatctaaaatgtctaagaattatgaaccaaacaatgggcccactattttcaaattctcgaaaatctaatctcaaagaaaacataatcccctgccctccctctccgcatggtgtccaggttcttggacaaagctgccatcccgtccgactccgacgacaactcgccggtgcaaccggacccatggaggctgtgcacggtgtcgcaggtggaggagctcaagatgctgctccgggtgttcccggtgtgggcttcgctgctcgtcttcttcgtggtgaccgcacagatgtcgtcgacgctgatcgagcagagcgcggccatggacggccgcgtcggccccttcaccgtgccgccggcctcgctcgccaccttcaacgtcgtcgccgtcctcatctgggtccccgtctacgacgccgtgctggtgccactggcacggcgcgccaccggcaacgaccggggcctctcgcacctgcagcgcatcggcgt

SEQ ID NO: 73836 - DNA, 14793 bp, Oryza sativa
gggatgccctaggcagtggcggcgaaggagaagccgatcggaggaaaaacttttaagtgtcggtggagcatacgagggcgcatagggagtatatatacccctagatctttagtcccggttggtcagagcaaccggcagtaaagaaccgggagtcaagatatctttactcccggttgttctcaccaacctggactaaagatatttttccgctatttccaaattctttttaatcccggttagggttaagaaccgggactaaagataatagcactcaatattgaatttagttgcctatgtatttctaaaatagtaaataatgcattaaaattatttaaagtcaaaaaattaatgacaaaaccttcaaaaaattattgttgtctatagtaaattaagtggataatatataataagcacgtgaatgatttaaaattgttaaaaattctaataatcatatataactaacatatgcatgatattaaattgttaaaaattctaattaacctatgtaaataccacatgcatgatttaaaattaataaaaattctaataatcatatataattagcatatgcatgatattaaattgttaaaaattctaattaacatatgtaaatcccacatgcatgatttaaaacttttaaaaattctaataattatatatacctagcatatgcatgatttaaatttgttaataatcatatataactagcatattcaataaatccaaaatagtttacaacaattacggcaatacatcggcggtgacggttgtccgcacgtactttctcctcactattgttccttccttgtgatcgctatgtgagtaaagggtgtcttcatttgataggaggatgctagggtcaatcgtcaccgtgaaagggggttgcccatcaaactgatcgtaatcctcgtcagttttgtcctctactccgacgatttttcttttgcctgggagaaccacgtggcgcttcggctcgtcaggccctttgaccttctttcctttgctagacatgtccttcacgtaaaaaacatgcgttacatcattggcaaggacaaaaggttcgtccgagtatccaaccttgttaaggtcaacatttgtcatcccactgtcatcaatcgttacgcctccaccagtcaacctaacccattggcaccggaacagagggaccttgagaggtccatagtcaagttcccatatctcctcgatggcaccgtaatacgtaccagttgtaccatcgtgtcccatggcatcgatacgaacaacactattctggttcgtgcttttcatgtcttcggctcttgtgtagaatgtgtacccattgatctcatatccctggaatgtcgcgatcgagctagatgaacccctcgccaggaaggccagttgctggttaatcgtctcgttatccatgagatgttgtcgcagccatccggggaaagtatcaatgtgatgccgtgtaatccatgcatcggacttatcgatgtttctcgagcgaactagagccaagtgctcctcgatgtaaggagccaccaatgaagattgttgtaaaaccgtgaaatgggctttacggaataaattgttgtctaccgtcattattgctttccttccgagagtcccctttccccgtagtctcccttcatggcgtgattcaggtaccccaattgggcgaaggtcttcaataaattctacgcagaattcaatgacctcctctgttccataccccttggcgatgcttgcctctggacgagcacggttacgaacatacttcttcagaacgcccatgtacctctcgaaaggaaacatgttgtgtaggaacacaggcccgagaataccgatctctttgactaagtgcaggagcagatgcatcattatattgaaaaatgaaggtggaaatatcaactcaaagctgacaagacattgcaccacatcattctgaagggcttctaacctatccggatcgatgaccctctgcgaaattgcgttcatgaaagaacatagctttgttattgttgcccggacattgtctgggaggataccccttattataactggtagcagttgtgtcatcaacacgtgacagtcatgagactttaggttagtgaacttcttctccttcgtgcttattattcgctttatattcgtggagtatacagatggtaccttgatgctctcaaagcattgaaacaaactttccttctctgccttgctaagagtgtagctggctggactcaagtaatggctgcctttctcctttggttccgggtgaaggtcgccgcgttgttccatatgcttcagatcattacgtgcttccagtgtatcttttgactttccatctacacctaggaagccaaaaaggtttacgcaaaggttcttagtaaggtgcatcacgtcgattgtgtggcggacgtccaagaattcccaatagggtaacacctaaaatattgagttttttttccacatcgccgcgtgaccatcttcgctctctataggctggctgccaggcccctttccaaacactactttaagatctttcaccatagcaaatactatttttccgctgcgatgtttaggcttcatacggtggtctgccttatgttcaaagtgcttgcctttcttccgtactgggtggtttgcagcaagaaatcgacgatgacccatgtacacaatcttcctacagtgtttaagatacgtactttctgtttcatccatacagtgagtgcaagccttgtaccccttgttggactgcccggataggttgctaagtgcaggccaatcgttgatggttacgaacagcagcgctagtaggttaaattcctcctgtttgtcttcgtcccacacggggacaccttccttcttccataatagtttaagatcttcgaccagtggtcttaggaacacatcgatgtcgttaccaggttgcttggggccttgaataataatcggcatcattatgtacttcctcttcatgcatagccaaggggggaggctgtagatacacatcgtaacaggccaagtgctatggccgctgctcatctctccaaaacgattcatgccatccgtacttaaaccaaaccgtatgtttcgtgcgtcttttccaaagtctttaaattttctgtcgatgtttcgccactgcgaaccatctacggggtgtctcagcatcccgtcctgttgacgttcttcagcgtgccaacgcatcattctagcattccccttgttcctgaacaaacgccttagccatggtattatagggaaataccacatcaccttagcaggaattctcttcttcgttagctgcccgtcaacctcacctggatcatctcgtctaatcttgtattgtagtgctttacaaacagggcatgcttctaggttctcgtactcctcaccgcgatataggatacaatcatttggacatgcgtgaatcttctaaacttccagtcctagagggcagactatcttcttagcctcgtacgttgtatcgggcaatttgtttccctccggaagaatgttcttgacaagtttcaataaatcgccaaatgccttgtcactaacaccattttttgccttccattgcaagaactccagagtggtatccaactttttgtgcccctgctcgcaacctgggtataacgatgttctgtggtcctctaatatcttgtccaatttatgggcccccttttcactttcgcagtcctccttggcatcctgcaacatctgaccaagatcatccgcaacatcgttataatcagcatctctatcctcctcgcccgtttgatttccttcaaatccagcgtactgagcaaagtctggaatattgtcgtcttccacttcatcttcttccatttcaagcccttgctctccgtgggatgtccaacaattatagcttggcatgaatcccgactcaaacaagtgaaaatgaatagtcctgaatgcagaatactccttctgattcttacacttattgcatggacaacaaataaaacccttctgcttgttagcttcggccactctcaaaaaataatgcatgccgtcaataaactctttggaccgccggtcagcgtacatccattgccgatccatctacatgaaataaaaaaaaatcgtacacaaataatcattcgtacaataatgatagtcatacaataatgataaaataatcacaaactctttcaacagtcatacaataatgacataccattattcatacaaaaattataaaatattccgttaaataattcttatttattatttttgaagttttaaattcttttaattttcaatttagtttgttttcttttatttaagattaactttcactatattttcctactcaactattttataaaaccttctttagcaaataaacaaaatttctatatattctttcttttcccacacaaattttctctctcatcaacttacaacaaaattttggagacaaaaaagtgtgcaaaacatagctccaaatgtaatatgacaaaaaaacattggaggatgaagttgctaaccttttaggcacctccgattcgtatataatcaccaaagtaaattcactataatttttggcatgacctcccctcttttttgaagaaattttgaagcttgctcaggctggaggaggaagaagacatatataaaggggtgggactttagtcccggttggtgttaccaaccggtactaaagatcagcgggatctttagtcctggttggtaataccaaacgggactaaagttacgatctttagtcccggttggtagatccccggggggcctgacaagccctaacagcatttaaaccaggactaaagataccaaccgggactaaagatcaaatatgcccgttaccctttttaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgtataagtacgttttatttgttcatctttttccatgagtagttgtacgtacgtgtattgtatacgtacaactactcgcgatagaaattccgtttctgttcgtttttctcacggcaacaagtccgtttctgttcatttttttccgtgagtagtacgtacgtatatgtattctgctcattttttccgtgaagtactacgtacgctacgtactacatagtactactcacgggagcaattcagttttctaaaattcaagggaggttagctggatgtattttaaataaatctaatctaataatttaaaatataaaagattcactaattaaattaaaatcaaggattgtatgtttttttatagatttgtaaggtttctctaatttattagagtaccgtgtgatggcatatgagcatttgtaagagtgtcacatgttggtttatgagtgtttttaaaaaatttaatggacttttagtattagattatatagatatacgatattattttcagatgagcttatagctagtatttagctagatattattttcagatgagctatagctagtatttagctgatctactattaaacttgctattacgtgtattcctctttttcattcaagccatttttttaatagacacaagcaaataaattttaaattaaaaaaacaattacctgttaacagttaatatcgatttgaaaagacaagagcatcttgctattcaagagaggcctaaacaggttttctaaaatgtaaattttaggatttatatcaaaatcaggcctctaacagattcccagccaaggtcctaaaatttacccacacctaaaagcagtgccaatctcgcccagaacttgggaacatgtacgccctcccaatgacactcgattatcgcgccacttttttacctgtccatgctaatttctttctattggcaccattttttcttctgcctgcttccttttttccccttctctcgtcatcattttctttctcacgctagctcgcacacgccgccgtcacttcgccacttaggatttccactgggtcgcctccaatcctccgtccgtgccgtttcattcgccatctcccgcgccgccttcattccatccatagtgccagcgaccgtccatctggtgcaccggcggccctcgtattggtgggcagcggcccttcatcaagtgcgccgaaaacccctcctaacgtgagggtcgtctaggatattaacctgcagactgatgacacagccgtgtagaggatcagctaggccttctgtttttcccacattagaggcaaatctgtcgtcaatacaaccttctgtttttccacattataggaaaaatcttgtatcaatataaccgtggccggcgagggattctcttacggcggcatagaggtaagatagcactttaaaagggctaactccggcatgtatggttctatatatacatgatccgtaatgcttgtcctaacttattctcagatcgagctagagcctagacatagagaaagtatgagcattgtggtgagcaagtcggcgccggtggtcgtccggccaacgctgccgccggtgaagacttccggcagcaagatcgttctgtcgcctatggacaagcttagtgccatgacgccaaccacagtgctgcttgcgttcgaccatcccatcatccataaccatgagggcatccgatcatcctgcattcagatgcaggccacggcggaatacatcaagagaggtctcgctcaagcacttgtccactactatcctttcgccggccgcatttcctgcgacgacgacggcggcgatttttacatcgactgcaccggcgaggagctcggagcgacgttcgcgtgtcatcgacaaccagcccactgacgccgagacggcggtggtgcagcagctcgccttcaactgcacgcccgacgacgaccacctacctcactgtctgctgtgggtgcaggtcaccacgctgtcctgcggaggcttcgtcgtcggggtgacatggaaccatgccgtggctgatggtttcggcatagcacagttcatacaagccgtcggcgagctcgcccgtggcctgccatcggcgccgtccgtcaccccagtcaggttagatgaccaaaacaacgccgtttctcccttcaccatggccttcatgcagttagcagacaggcacaaggtaccagaccttaccttcaacaacgtgaccgtcccgtcgaggttgatggaccacatcatccgaggacgaacgaccaacgtcaccgtgttcgaggcggtcgccgccgtgctttggcagtgccgaacccgggcggtgatgacaaatccagaggcccccgccgtgctgctcttcgcggtgaatgcgcgaaagtatctcggagccaaggatgggtactacggaaactgcagcacgatgcacgtggccgtggcgaagagcggcgcggtggcgaacgccgacatcaacgacattgtagacatcatacggcgcgccaaggagcggataccggagcagctcaagatgaccggcggcagcgacatgacgatgctacgggagctcgccgatgaccatcgtctggatggatatgagagcctgctctacttgacatcctggcgaaacatcggattcgaggatgttgatttcggcagcggcaagacggcgagggtgatgacctacccgcagagggaggtgttctccaagaaaatgcccatctgcttcatgctcaagaacacaccacaaggggctagggtgatttcaggctgtgttaaagctcaccatgccgacgccttccatcaagaaatagccaagctcaacgccaccacctaattaactctgcgagctacctacagtattatataacacatgactctcagatcataataagtaaataaatccatcaaacaaactatatatgcctggtgttatcatgtaccctctcaatttgtgccatttatctataattagatttatcattatatcgttcacgcataaacaattcatgagcctatcctatctgtataataacaagccaggtgctcccttcattttttaatgtattatgccattgaattttttaaatacgcaagaccatttgtcttattaaaaaaataatctaatattcatttgtttttattgagatttgattcatcatcaaatattttttaagcatgatttaaatatttttatatttgcataaaaattttgaataagacaaatggtcaaactttgataaaaagttaactgtgtcagacattaaaatacggaggtagtaatctctattattgtacttcatcaattcgtcatgaagagatctactccctccgttcatattatatgtcgtttgatttttttttctagtcaaactaataaagtttgaccaaacttatagaaaaatttagcaatatctgaaatatcaaattagttttattaaatataacatggaatatatttcgataatatgtttattttatgtcgaaattactactatgtttttatctaaggtaggccaagcttaaaagtttaactagaaaaaaattaaacgacttgtattatgaaacagagagagcagtaaagtaattcttttttaaaaaaataaatcatcacaagacagttcctatttcgttgaatgtagcagcaaattccaaaaacattccgtcaggagagcggagaaaccatgtgctctgttagccctgacaaccatccttgccacctcagttggcgcccctcgccgctgttgcatcgaatacaggaaccaagccaactagagagaatgaatggttggaacacacttttagtggaaataaaagtaacacttaaacttgacaaagtttaaatgcaccgatcacacggctggattgatgtcagtctgaccgcagtactccggccgttctgaccaccgccttgagccggttggaccacctccctatcgccggtatgaccgcctgctagttagaccatacaatgaactccagtcaaaccgtcgggatctagaaaaacacgtatcgatgaaactcttgaaagtagatctactttattgcatcaatatgtgtttacaaagtgcatctaaagctagcattcctctctcaactctttaactaggattgaagcgtcgaagaaaaccctaacttttctctcccaaaaagtcgatttcttctagcctcaacccctcatgtatttatacccacaacctgcttcttgtcactgtattactgcaccaagtctgctgcgccccaatgcagtaatgcttgaagtgtttctcccaggatgcaccctggccgtgtttcagcaaacttttggatatcttaccacaaacaaactgaaccccccctgaaccagatgatgttcacactggtggagaaatcgtttgtagtcccagttcgtaacccccctttagtcccggttgtccaaccgggactacgaatctgggactaaagatagcgatctttagtcccgggtaaaataaccgggactaaagatcgatctttagtcccggttggtaacacgaaccgggactaaagatctatgtaccattttttttatttgcatggccctgtttgctgcatggttgattatatatatatatatatatattacaatacattatatatgcattgtaatatatatattatgcatgtatatagaatacatatatatatatatatgcgtatgtatatatatgtataaatacatatattacacacatatttataatttaaagcacttaacattttatgtacatatatgttaccaaaatatatattaacactaaagtaaatgtacatacatatataaatatatatatacatgcatgtatagtacaattcatttgctcgctagctatagctacgacttcgacgcctgcgttacatcagaagaggaaggaccgacgttatgaattgtcgatccatcgtagtagaattcatcatcgtgattaaggacttcttcgttaatgaaccccatcagttgttcttgaacagccgtgataaaatccttgtgtgggagtttttccctcatgtgaatacgctatcattcgaaaaataatgacatatcaatatatgaaattaataaacaacttaacaaatcgatacgcaatgaaattttgaatggtttatgtatacgtacatcgagctctcgtatggtgtatatttggtttgataggcagtgggcatactcgcatacgtagtagccgcataagttagttccattgtcctgctttgcacactacatgagaaacgatgagagatttaatatactctttatattaactgtaacaagagattcaattcaatataattttggatcatgcatgtactcactggaaaatgaaacctccgtccaagtttttctttccaagtcccgcggaccaattgacggaaccgatcccaagccctacatgtgcagttgcaagctatgattaactaaatattacccgagatcaacataatagcaacagagtcccgcgactttggaatagatggcattatattacatatctatcagttggaagagcttgtcaaaaaccttctcctctttattcattgagtcgtacacagtgactctgcatgcgtccaagtcgaaaaagaacaggacccagtggaatctagaatatgcgtgatatgagataaatatcagaatgtacatgttatatgtatgggaacgaaatttgttcgaacaacaataaaaactcactctgtgttgtacgtcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccgtcgggccctttcaatctccattctacaataatgaaaggaaattattattgcttacacatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgctccgaacatctctctaccattggcgctcatttccatgtaccgttcatggaatttgtacatttgtgtcggtagggactgcagctgctcaggcctgacaagcggtttaccgagttcaaactagtatgccacttccgccttcgggattggtgcgcctccaaccaactgagccatggttagaccagtgtccgaaatgaaatccgttatgccaaagtcttcgccggtcaccaacggctcgaccacttggtttggttgttctccaagctgaggaactgctttggacttcttgtaataggctttcctaagtgttcggtcatagtccgatagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaactttggccttcttcgttgcccttgtgctggcaggaggtggagcttggcgagaccttgtcttgggaggtgcaggcggacacggtggaggtggaggtggaggaggcggaggagccggaggagatggtgcatgaggaggtggcggaggagccagaggagatggtgtaggaggacatggcggaggaaccggaggagatggtgcaggaggagacggcgaacccggaggagatggtgcacgagacgccgcttgtcgcccagggaggatgatgtaccgcttgcgctatagtataatggcgtgccttgtgtctcgtagatgcgtctcaccatctcctcctgggtagtccaactcgaggtcctcgtacacggcttccaccagctcaacttcgaccctcgagtatcctgctggaatcggcctgcagtggtaagtccctgaaatgtctgttgggatggccattcccgacgccaccttcacgtgatgagaggttatctattagtaatcaaactaaccagcaacttgcagaacgtacgagtcaaaaatcatatattacatcgagcataccttgattgataagttcttgaagggaatatgcagctcacatggtgtccgttgcgtgatctcatcaacggggcaggtggtgtcgtcatgggtttgcatggcgtccatgctatgtgatactacctgccccgttgaggcgcagctactacgattgcctgatgggctgaccattggaggaggtatgtacggctggggatcgtgtgaccgatgtgctgccatgcgttcatccactttccgggccacctcctcttgcatgctgagttcgtagctcgataccctgtactcaagatctgcaatcttcgcctcagtatctctcttgctcctcatccgactcctgtacgtgtggatgtcctccttgattcccatcttctagggaatcacgcctttccctcgtgttcgtcctagatgctcgagagtctgtagggcgagtgacagctcgtccttctctctgtcgggtcggaacgtgccctgagaagaggcttccactgcgtccgttagtcgattcgtagcctcgcgtatctgatcgctgaagaccaaggagccattaactgggttgagcgttccaccatgagaatagtaccagaacttcgatcgatcaggccatttagcggtggacggttcgatacccctctcaagcaagcttgcctccatctcctcccacttcggcatcgcgacgctatagccgcctgaccccaagtggtgatggtacttcttcttagcggcattttctttgtttctttccatcatcgcctgcccttgttgacctgtcttgtaagcaacgaactcgtcccagtgatcccttagcttcgggaatacatcgaagttcggtgtctgcccccttcaagatgtatttccggtacaaatctcccttgaaggtctagaactgttctgccattttcttaagagtccactgtttcactatgttctctgtacccgcagggagcgtgaacgtctcgagcattgtggtccacagcatctctttctctgattccgggacaaagctgtcatcatccccgcgtgcccttgttctgcgccagtacaccttgctaacaggcacgttatccctcacaacccaaccgctgtggcgtacaaaattcttggctacttgtgccggggcactaggtcggccgtctgcatccacctcagttatgatgtgccgaccctctatcttcttcgcagcacctcgttgtccgcgtgccctcttctgtccagcgtagggatgacttccactagcctcctcctcgttcccctccgcatccctctccacgttcccctcctcgttcccctctgcatccctctccgcgttcccctcctcgttcaagtactggtttggatcctcgttcccctcttcttcgttccagtactggctacttcccgatgcgattgtatcgtacagtatctgttcctcatcgcgatcagccatctgttcatagaagaaatatttgctaagcataatattaacactctactaatcttgtattaaaactcaaataatcatatatgctaagtctaagtgtcatgtatttgtatggtagataatcttatatgctaagtctaattaagtttcgaatattacatctctaataatcttatattaaatctctaacaatcaaatatgttttgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacgatagataatcatatatgctaagtctaactaagtttcgaatattacatctctaataatcttatattaaatctctaacactcacatatgctaagtctaattaagttttgtatattaaacctctaataatcttgtattaaatctctaactatctctaacactcaaatatgctagtctaataatctaataatatctaacactcacatatgctaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaacgcaaaggaacatataatgtatttcacgttttcaagtatatataatcatatatatatgctaagttcaacaatagtttaattatctcgttcgtacatgtttcgctcgcattcgttctaacacttttagttcaagtgcattcacgttcgttaacgtttcaatcacgtttgttcgcgtttcattcacgttcgtttacgttcgttcacgttcgttcactaacactcacgttcgttcacgtttcagtcacgttcgttcgcgttcgttcacgttcgttcatgtttcattcgcgttc

SEQ ID NO: 73837 - DNA, 8172 bp, Oryza sativa
atggctaaacattatctctaacagccccccctcaatcataacttatccaagttaatattgaacctgaaattctgaaactgttgcacaggaagagatttagtaaagccatctacctcttgatcccctaaggagataaacctgatctctaattgcttacttgcaactctttctctgacaaaatgataatctacctctatatgcttagtacgagcatgaaacacaggatttactaacaagtatgtagctcccatattatcacaccataatcttgcacatggaggtgaatcaataccaatttccttcaacaaagtctatatccacattacctctgccgttgcattagcaacagctttatattctgcttctgtactggacctggagactgtagcttgctttgtagcactccaggataccagatttgatcccaagtaaacaacaaagcctccagtagacctcctatcatcaacagatccagcccaatcttcatctgaaaaagcacttacaagagaagaagaagacatgttaattcttaacccaagattaacaatagacgtcacatatcttaaaatcctctttactgccatcgtgtgttgcactgttggacaatgcaaaaacggacaaaccttattgactgcaaaaggtaaatctggcctggtcaaggtcaaatactgaagagctccaactatacttctgtactttgttgcatcatttattcctaattcagaaccattataagctgagagtttctctatagtagagtgaggagtagaaacaggtttacaagcaatcattcctgcccttttcaacagatctgaagcatacttttcttgtgtcaataacataccatcactaaccttttcaatgccaagaaagtaatgcaaatctcccaaatccttaagggcaaaatccttcttcaaatcacttaacaaagcatctgttgccttctgtgtggagcttgccacaatgatatcatcaacatatattaaaacaaacatattaactcctcctttactttggaagaacaatgaaatatcagcttttgatgctttaaaaccaagatcacataatttgctgctaagcctagcataccacaccctaggagcttgctttagcccatataaagccttatcaagcttacaaatatgattgggtttactcttatcttcataacctcgaggttgtttcatatagacttcttcctctaacaagccatgaagaaaagcattctgaacatcaagttgacgaagtgaccaacctctagagacaacaatagataaaatggttctaattgtagctggcttaacaacaggactaaaggtgtcctcatagtctataccatatctttgtttaaatctctttgctactagacgagccttgtatcgatctaaagttccatcagacttgtgtttaatcttataaacccatttgcaatctataacatttttttccttacttggtggaactaagtgccatgtcctattattcagcaaagtactatattctagatccatagcatttttccagttttgattacagagagcttcatctaggttttgtggtttaccactagcagcaagtaaattatacctgactgttccatcagtgtagaccttctcctttctaatgcctctctatagacatgtcaggggacgtgacggctgttgctgatcagatgtcgttgtcgacgactgctgctgctgtgatgctatactactgcgactgccatcatgactgccgccatcattgcccccctatgtcgcacggcgactggcgctagcagccgacatgtcgccactagaatgggcgacatcaccaccagatgttgtgtcaggctgcacagactgctgtggcggtgatcccagcatggagtcaggaccaggaggagcgggagaatcgccctgggagtcagcgccgtcaggatcttctgcggcaatttctagatgatctgccgcttcattttcttcactattttgtgcactgttttcgtctgaattttctgctgcatgctcaatagagacattagaatgttcaggagaatcaaacatatgatcattcacatttacacccgcactagcaacatcaggattcaacaagttaggtggaagaagaagaatttcagaccgtagtcttgcaccgggcattggaatgcatttgagagaagggaaaatttttttcatcaaagaccacatcacgtgagatatagatcctgccggtagatggatccaaacatttgaaccctttatgaatgttactatagccaagaaaaacacattgtgtagatcgaaattgaagtttgcgggtgttgtagggtcgaaggttaggccaacaagcacatccaaaggttcttaaggaagactaatcatgtttctgttttaacagacgttctagaggtgtggcaaattggataactctagatggtgtgcgattaatgagatatgtagcagctaggaaagcttcatcccaaaattttagaggcattcaagcatgagcaagaagagcaaggccaacctctacaatgtgtctatgcttatgctcagcggagccattttgttgatgagcataaggacatgaaacatgatgactaataccaattttggtgaagaaagagtgtagcttttcatactctcctccccaatcagtttgtatggcaattatcttgtgatcaaagaccctctctacaagttgctgaaaatcaaggaatttctgaaacacttcagattttttctttagcaaatatatccaagtaaatttactaaaatcatttataaaactcacataatacttcctgcccccaaaagaatcaggagcaggtccccatacatctgaaaaaataagttcgagaggcacacttgacacacttgacttaggatatgggagtcggtgactcttagctttctgacaagcatcacagactcctgactcacttatatctcctaaacatgggagactattattcttcacaatttttgaactattgcaaaagaagaatggcgtaaacgactgtgccattgggtgaagctaggcttgatggctccaagggcttgcttgaatggagggatcgacgactgtcgtaggagatataacccattgcggcgaggtcctctaagaagaagattcttggtgtccagatccttaatagcaaagaaatgagaatgaacctcaataaaggcatgattatcaaaggcaagtcgatgagcagaaataagatttttgtgtgcatgcggaacatggagtatatttttgacacataaattgcgtgtgggtgtatgaatttgagaatggcctatatgtttgatttccataccttcaccacttgccgtgtagatctgatctttgccattgtatttttcatgggtcgtcagcttctctagctctcccgtaatatgatccgttgtaccggtatcgatatactagttttgatcaacattatatgatgcagctgctgctaccttggcatctggaacaaaagaatcatcaaacctgtgccaacagtcggcaacaacatgccctatcttgccacagagctagcacgtggggcacggcttggagttgttgtagcggccgcctccattgtagccgcgcccgcgaccaccgcgatccccgcgaccgccattgttgctgaagttcccgcgagctgcgccattgctgccgccatggttgaaggcgaagccgccgatgctgccaccttttccaccgccgccgcgctttgcgctattagcgcaggaatagccatgatttgctgcaatctgtcgcagcttccctctggactcgaaactgagaagttgtgagtaaacttcaaaaattgaaactggttcgtgtttgcctaccaaactggagaccaccggttcgtagtcatcaccaaggccgaccaaaacatagcccatcagttcttcgtcgacgaggggcttgccggctgatgccatctcgtcagcgagtgttttcatcttgctgatgtagttcgatacgctgaggtcgtctttgcgcgtcgtagagagcgcaagccgtgtgttgagggcacgcgatcgcgactgggaggacaccatctccgtgattgccctccacgcctgcgccgccgtgtccattgtcacgacttgcgtcaggatctcctttgacaaggaggagaagaggtagccgaggatttgctggtccgcagccaaccaggcttcgtacgccaggttcatggtttcggtggccctgccaccttccttctccgttggaaccatcaccatctgggacggcgacttggtggcaccggtgagatatccttccatacgtgcgcccctgatcacggtaaggaagttgctgtgggtaagtttgtctaggatcgcttgcctagagaggggattggaggtggcactactgatggaggaagccatcgcccatagatgcaacctcggcgtggcagataggccctgataccatatagaaattatgtaagcattatcacctcgtctcgaggccgcgtaattgtatttatatgagttgggaatagctcccaaacgtggcttacaagaatgagatcggatcagccagagttcggttgtaacagcccaaccttatgtcaaccaatccatatcacatgtgatatttcatgtaacaaactaatggctaaacattatctctaacagtgccctcccctcctccagatccgatgggaggggatacggcggtggcccggcggcggcggcctctccttacctcctcgtcgtggcctgtgaagactagctctacccccccctctctcctctcacctcagtggccactagcgtggaggtgggccaccggatctacccacttctgcgatgttgtcctgctgcttctacctccggtgagtacatgtgccgacgcacatcctctttctctttccatccatctctttctacccgcaccatttctttcccttaacattatcttgatttctagatttggaagaagcttttctctagtagatccaaccgacgacgcgcacggagggatggaggcggagcaatttttgaattttttttaacactaattttggatttattttttatggctgtgaagcatctgctcggcccaaattgagttgagctagttttttttttcaaatcatatacatcaaaggtgccggttcttaaactgacacctttgagtcattctcatcagtgtcgtctccatggtgccagttgggaaatccggcaccgatgggggttacccaaccagcaccaatagcccattctttagtagtgcgaatatcaccatcaatactggttttatctgttagagaagtcactatgcccggttttacggataaggaatataaataggattaaacttatatctgagagagttatattggcctttttccttagtaaaatgcccaaaacagaaaaccctggtcttaacctctcatccgttacgctagcattgctcctattccataaaaagataaaaatgaagaaaaaagtttaatcacttctaaataacgattatacccgttcaaacttttttttataataatacaccttcaagtttatactgccactaactagagtggtaatataaatagatctaaatccttctatcaaatgagatcgacggtttagattgcttcttactaccagtacagagcatgagcatcctagtgggactataattaagtgagggtgtgagatggagtccaggcgttgatcccaacgaggaggttgcacgtatgcgcggatatgcctggctcatgagcgaagctcgatttaaacattcctggcgtcctagctcgggagatacgggcctgcctcgcacgtgcatgcatgtgagctacatgcaaataccccctccgtactataaaaaattcaatcctaactacttcaatcctaactacaaacctgacttgttatttttggacagaatagtaacaatactctctctattcaaaagtctaacacctatttattttattaccaagattaggaagtaattaactcatccaccatatgaaaaaacttatgagcgtgcaatccataagtactaaaatgacttcttttttccgatcaataatttaatttagcacatagtgattaccaataagatttagagtttgaaacatatcaaacaattttagatttctggatggaggaaatatataatatacctgcacgcgggatgcgagacagcgacgaaataccaaagcttgccctaattaaataaataattaattcgacgaagactaggaacgaccaatgatatctattggccaaccatataacactgtggaactgcatatcgaccagtatatatgaaaagtcacggaggaggccagcagccagcagccagcagccagcaggtatgtatgtatgtgtgtttatagcaaatccgttatattatatggttgtaatctctatagtactagatctgtatgactactgtattaattatatgcttacgtgatcctaacttatcaatggtagaacacccagacggatattaatttagaatgagtattgtggtgagcaagtcagcgccggtggtcgtccggccatcggagccggccacatcgacggccgacaagatccttctgtcaactttggacaagcctgttgccacgataccagtgaccgtgctacttgcgttcgaccaccccatccatgacgccaccgcggagaccatcaagacggctctcgctcaatcactcgtccactactatcctatcgccggccgcatttcctgcgacaatgacgacggcggccatttctacatcgactgcaccggcgaggatctcggggtcacgttcgtggccgcgtccgccaactgcaccatggaggagctcatgtgtctcgtcgacgaccaggctcccgacgacgagacagcggtggtgcagcagctcgccttcaactgcacgcccgacgaccttcatcaccgtctgctgtgggtgcaggtcaccactctcaactgtggaggcttcgtcgtcggggtgacatggagccatggcgtggctgacggtcccggcatagcacagttcatacaagccgtcggcgagctcgcccgtggcctgccatcgccgtccgtcgtcccggtcaggttggacgacaagatcgcaacccaagccgtacctcccttcaccatggccgttcatcgcttcatatccggcctcaagccagtatcaaacctcgacgtacgcaacgtcaccgtctcatctagccttatcaaccacatcatcgtcggagctcgtcgtcgtgccaccgtgttcgaggcggtcgccgccgtgctctggcagtgccgtacacgggtggtgatgacggatcctgaggcccccgccgtgctgctcttcgcggtgaacgcacgcaagtacctcggcgccaaggacggctactacggatgctgcaccgccatgcacatggccgtgtccaagtccggcacggtggccaacggcgacatcatgaagttggtcggcatcatacgccgcgccaaggagcagataccggagcagctgaaggcagacgacggcgagatgatgctacggacgatggtaggggagaagcaggtgaatggatacgagagcctgctctacttgacatcctggcgaaacatcgggttcgaggacgtcgatttcggcagcgggaagacggcgagggtgatgacctacccgccgaggatgctgtccatgatgcccaggattgcgcccatctgcttcatgctcaaggccacagaggaaggggtcagggtcatgtcagactgtgttacggctgaccacgccgatgccttctatcaagaaatagccaagctcaaagccaccacctgattataactatatatgcgagctatctataccttcttcaatatgccaattatgatttatctacaataaaaatttgaatatatataccgtgcaagagcatgcatgaacaagtaattctatatgggactcttctacctgtatcactatttcactatacatttatggttctttaatttttagatatggaaatttattactggccactgggctatcaagtgcacatagcctacatctatatctaattaaacaatagagtaaaatgcattagcggtgcttaaacttgtaggattgtgtcatataggtctctaaactcttaaaatacatatctaggttctagaacttgtcaaagtgtatcatttaggtctcaaattgacacatcccctctaggatcctacgtggcg

SEQ ID NO: 73838 - DNA, 12079 bp, Oryza sativa
tcatcaaagattgggcccggtaaatcaggatcatgacccggaggatgatgaaaacaggaagactcaatggtgtcctcctggcatatttacaaagaatcagaagagaagggttcaaagattgagaaactgagaacgcttgcaggaggtcgagcaagagatcaatcaccggctaaagaaaacaaagccgaagcaggaatggcgcgttaagaaacaagctcctgtagccgatgaagcaaagagattggccaaagggaaaggcattgtgattgcgtcggttaacatggtttttaccttgccagccgaatttaggatcgaccaagccgatgttgaggaaacagaagaagaataggctaaattgattctatcaccagaacaagcagtctttaaaaagcccgagggtgcagagaatcggcatcttaaaccattgtatataaatgactatgttaatgggaagccgatgtctaagatgatggtcgatggtggagctgcattaaatttgatgctttatgctacgttcaggaagttgggtagaaacgccgaagatctcatcaaaacaaacatggtactcaaagactttggtggcaatccatcagaaaccaagggtgttctaaatgtggagctgacagtcggcggtaagactattcctactacgttttttgtcatcgatgggaagggttcttacagtttgttgcttggaagggattgggttcatgccaattgttgtattccttcaaccatgcatcaatgcttgatccaatggcaaggcgacaagatagaaatcgtgccagccgacaggtcagtcaatgttgctagtgccaatttagctctttgggagatggacggccttgattgtttatccggcaaagtttgggatggagattttctaaaagtgtccgattctgatatacagccaattgaagatggagaacccaagctattactttgagggcatcgtggagggttcaaacgtctacaccaaggacacagtagatgatctcgatgacaagcaaggtcaaggttttatgtcggccgatgatttggaagacatagatataggtccaggcgatcggccgaggccgacatttattagtcagaatttatcttcagagtttagaaccaagctgatagagctcttgaaagaatttagggattgcttcgcttggcaatattatgagatgcctggactcagccgatcgattgttgaacatcggctacctaccgaaccaggggttaggccacatcaacaacctcctaggagatgcaaagctgacatgctcgaacctgtcaaggctgagattaagtgcttatatgatgctagttttattcgtcgttgccgatatgccgaatgggtttctagcatagttcctgttatcaagaagaacggcaaggagagggtgtgcattgattttagagatttgaataaagctactccaaaggacgaatatccaatgccagtggccgatcagttggttgatgctgcttcaggatataagatattaagttttatggatggaaatgtgggatataatcaaatctttatggctgaagaagatatccataagacggctttcaggtgtcctagtgcaatcggcttgtttgagtgggttgtaatgactttcggcttaaagagtgctggagctacgtaccaaagagctatgaattatatatatcatgatttaatcagctggttggttgaagtctacattgatgatgtggttgttaagtctaaagaaatagaagaccacattgccgatttaagaaaggttttcgagaggaccaggaaatatggcttgaagatgaatccgacaaagtgtgcttttggcgtatcggctggccagttcttgggatttcttgttcatgagagggggattgaaataactcagagaagtatcaatgtgatcaagatgattaaacctccggaggacaagacagaattgcaggagatgatcggcaaaattaattttgttcgaaggtttatttctaatttgtctggaaggttagaaccttttacaccattattgagattgaaggccgatcagcaatctacttggggggcagaacaacagaaggctttggataatattaaggaatatttgagttcccctccagttttgattcctccacagaaaggaatacctttttggttatatttatcggccggtgataagtcaatcggctcggtcttcattcagaagcttgaaggaaaagagagggttgtgttctatttaagtcgtcggctcttggatgcagagactagatattcccctgtggaggagttatgcttgtgtttatatttttgatgtatgaggttaagacattatctactgtccaatgaatgtactatcatatgcaaggccgatgttgtcaagtatatgttatcggctcctattctgaaaggaaggattggaaagtggatattttcattgactgagtttgatctttggtatgagtcacagaaggcgatcaaaggacaagctatagctaattttattgttgaccatcgtgatgattctatcggcttggttgaggttgtgttgtggactttattttttgatgggtcagtctgtactcatggttgtggtatcggcttagttataatctcccctcggggggcatgctttgagtttgcctatactattaaaccttatgcaactaataatcaagcagagtatgaggcagttcttaaggggttgcaattactcaaggaagttcaagctgatactattgaaatcatgggggattctttgttggtgatcagtcaattggcaggagaatatgaatgtatgaatgatacgttgatagtttataatgacaagtgccaagaattgatgaaggaatttcggctagtaactttgaagcatgtatctcgagagcagaatattgaagctaatgatttagcccaaggggcatcgggatataagccgatgatcaaagatgttcagatttaagttgctgtcacaacagccgatgattggagatatgatgtctatcggtatttacgggatccatctcaatcggtttcttggaagttaagatataaaacgttgaagtatacattgttggacgatgagctttattatcggacgattgatggggtgttgctgaaatgtttgagtgccgatcaggcaaaagttgcaatcagtgaaattcatgaagggatatgtggcactcatcaatcggctcataaaatgaagtggctgcttcgacgtgctggatacttttggccgacgatgctggaggattgtttcagatattataaaggttgtcaagattgtcagaaatttggagcgatccagagagcgccggcatcgactacgaatcctattattaaatcatggccgtttagaggttggggaattgatatgatcagcatgattaatccaccgtcaagtaaagggtataagtttatattggtggcaaccgattattttaccaagtgggtagaggcgattcctttgaagaaagttgattctgggatgctatacagtttgttcaagagcatataatctatcgatttggtatccctcaaaccgttacgactgaccaaggttcaattttcgtgtctgatgagtttgttcagtttgccgatagcatgggaatcaaattgttgaattcttcaccgtattatacacaagctaatgggcaggccgaggcatctaacaagagcttgatcaagttgattaagaggaagatttctgattatcctcggcaatggcatactcgtttagccgaagcattgtggtcttatcggatggcttgtcatggatcgacacaggttcctccttataaacttgtttatggacatgaagctgttttgccatgggaagttagaatcgactctagaagaacggaattgcaaaatgatttaacagccgatgagtattacaaccttatggccgatgagagggaggatctggttcaatcacggttacgagcccttgcaaaggttaccaaggataaggagcgagttgcttggcattataacaagaaagtagtgcccaaagatttttcggaaggtgaacttgtatggaagttaattttgtcgattgggactcgggatagcaaattcagcaaatggtcgccaaattgggaaggaccgttccaaattcataaggtggtatctaagggggcttacatgttgcaaggactcgatggagaagtttatggcagagcactaaatggcaaatacttgaagaaatattacccaagtgtttgggttaacgcatgatcggctgatgttgccgatgcatgatagccgatgtgtttacattgccttgagatgaccgatatggttatatcgcacttagttcttttcatattgtaatcggttgtggtttgccgatgtgcaatggtcgatatggttatattgcccttagtcgtttttataattttatcaatgtttttgacattgtaaaattaggggggcacatacatggaaaattgcaaatttttgagcatatttggcagttatgttaatcggcacaaaggattatctagacaagttgaataatagcactagggtatcttagccgagtacaaaaaatttcttgaggtctattatacagaatatcactaagacaaatatcgttggatagccgatatagccctctgcctaatttgttctacttcttctatggcttgggcatcttgagcatcggttccagggatgactttcaaggacttggtcatatcagcgatattcttgatagccgatttcagcctcgccttctgttcttcgatagcttacgggagatcggctaacttcttgtgctccatatccagctcggcgttgcattcttgaagttgtgccatgagatcaatcttacgagcttcaagccgatcaatatttgacttgatcgggccctcagacggctgatcaagcttggacttctcttcgtgcataagctgccgattgtgctggattgtagcttcgatgtttttgcgttcccggcgatcggctaatctctacttggccttctccagcttgaattggtgttgctcaaggtaaacggctggagtaagggcatcggttagttcatccgggagtagagcttggatatctgtgaacctggcctggatcgagccacagttggtcactaagttgtctaatgatgcttctagccgatgagagatatcctcgagcattctcttcacatcatcagacagaggagctacagctttactggtggtgtcttcctctatttcatcgagataatccttgatgtcgaaagaaaacatatcggctaagacctgcaagagataatattatggatggttaaggatcaaaacatgattggctgatctcagatttgtatcaacaaaaacttactggaataacaggagcagctggttgttcttcctcttcgacgttatgactgtctgcaaccgatggagtacggttgcttgattctcgctgcacaagaggtgaaggaggaggaggaggctataaaaagataaatgttagacataattccggccgagattagttaatgagaagacttagaatatcttactggtggagccggtttgagagttggtgctgccgatttcttcctcacggcagttttcttcttctgtgattatacatctatgagtaatcggctgaaaggtaaagtagttacagaggaaatcgaagagagatgcttactctcgaaaaatgagctggggcagaaggagttggaggagtctgcttgggtgaagccgatggtgttctctctgtatcgctcatttcggctgcagcctgatcaatgtcctcttcaatctcttcttcatctagcgcttgttcgatagatggatctagggcagacagatcatcaactggcttggttttctttgatttgattttcttcttgagagctggagctgatgtgtccatagtcgatgatctggtttttcttttcttgcctgcatcagctggttccctgattaagccttggagaagagccgaagtcttgggggcatcatagccgatgaatggaggagatggtccacctccatttggaattattcctggggcatattcgatatcttgccactattgctctggtgtgggggagaagattctgttgtctataaaacagaggattagattaatcaagcgatgaatcggctaataattgttcaaatacgattaataaaataaagacatagctaaggaacaatatctggaaataggtctatcttgaacattgaagccggttgatggaaaagatgcagcttccattcaccccaccatctgtcgaagtttctactcctgaatcttgccaactctatattttcaatgctgcccaatggaggtccttgaagattaagcagccgattcatcattaaggtagatgagattttccctcggcattggatcttatcggcaaaaaataagccaattggaagttggcccattccaaactgcctagcagagctcattggatgataaaattcatatgagacgtaagtgtttcttccttgataaatgccaacaggaaggatacatgggctgattgcagttgagaaaatttctctgggtttctgatatctgtcatggttgatgtcttcgaatctaaagtccaaaggattttccagaagcgttgaatcttcatagaggaaccagactcgagcttctttctggaatccttcataaaagctgcaaaaccaatctttgagcagttcggctgatagctttgctcctgcatcgattggtgtggaggcatattctccgaaggaggtgcatctccgatgagtgcgttcttctctgtcactgtctttaatcggctccagtcttgggaattcagcttctgttacaaatggccgattgacaaacttcatgactactaaattcaaccaggattgcagtagccaccatggtccacccgctccgactactgagccgacagctaacttagccgatgcattatttagcatttggtacaagtagccgaggaggattttgcctaaagggaattgtctctttgtttctaaggcttcggctacagattgccaattggttgtagggccacagcttgatccaaagaagaagaatttctctagccacatcagcaagaaagccacatgttctcggggggtgaccggaccctggcccatgtatgctgcaatatagcccgaccagccgcctatgctcttagtcttgaagtcatattggttttttgtgttcaggctcatagggttagccgatgaggtgatatctagacctgtgatcatgatgatatctatgagagttggggtcatcggcccttggttgaataggaaggcgttgatggtgttgaaccagaaataagtggcagctgccattaggggttcgtccttagctgagttggctatggtaaggtcgagtgcttggccgattccaatttcatcccaatgaactcttttactggccgataagcgtttgaaccatgtgatccagctcttctcgggtgaggttttctctagagatggccaagatttaaaggtattctttcagtgacctagatctgggttggccaatctgaaaggaatcctattggtttcgccattgatgaattcagtaggatcaagactaccgattggaccaagaaaatagtggttctcgtgtgacagacttggaattgcaaccagattggacagatgctacagatgcaagtagggatagagaagaagaatacaggataaggcgagagaaaatcaatctactgtgaaagaaagagatctagccgatgggtacttacctttgcatactcagccgatggtgcggaggacggattggcggaggttgacatcgccgagggcggaaatctggtcggggatgaagtcacctggggatcgccttatgcgtcggaggaatcgccggagagagagagcataaagtttcgcttgagcggtgaaggcggaaataacggtgtgagatttctcaaggacaacagttagtatttaaagagttggagtaacggttagaaaacggcggagtgcgaaacttactcggagttgatacgcggcaaatccggaacattaccaaatctcccgaacttggggggcttgtgttaatgaccaaatttggtaatatcagcatcggagaaggagattagatcgaagtggaatcgaagataagggctgtcgcgaaaacagagtaagaatcggctagagtctggattggctacggtcaggattggcagagttcgagtcagacagggctagccgatacagccgattccaagaatacgactcggtgtacattatcgggttgagttgatatgcttcaagatgattgccacgcatggatagagtcctgaaaattcaattatatctattaattagaatattttatgtaaatttcttacagattaatgtgggcaaaagtctgtcgtaaagacttgtggtatcttagagtttgttagagataatagtcgtgtccggtatggacatatcttgtaattctcgggtataaatagaccccgagctccatgtaattaatctaacacacacattcaatacaattttggcgcatcgccacccttttactttcgttttgtttcgacgagttcttgctttcgggttgagctgcatcggtttcgatcttcaacaagaggtaaaacttgttatggcggcttgtgttctcaggattagtgcttccatctctatgatactctaatcttgtttatgtaattcatcaagttatcatatatcttgtataatcttcggtaatatcgtcatctaacctacaatcagctaacatctgttagtagaaggcagccgattaggttaaatagcggtgttagctaggattgtacaagatacttaccactctatgaaacatccagcggcttgattgtctagatattgttcttcttttcatacttaatgctgcatcagttgagtttgatctatcaagtcgtgcttagaatatcaatctctagcttgcttcctggttgccgattagtatagcatcggagttttagccgatcttacctgatttaactatagttatcctatatgtttgattgacatgttaaatctgccctttatgttaagatcttgttgcatttaagtatattatgcttctgtctgatatattctatttgctttaatatcttaatataaagtggtatcggagtattagccaatacatgctagatctatttaatcgactacgctattaacgtatatagttttgttgttgatttatatttcgatctaagtgatttaaccaatcacttgatttaagtatatatcgacataagaattatatattgttaatgtctacagccgatcaagtaggtttagttcttccttaattattcatgactgccgatcgatgcacacatgacatcggcataaaataaatgatttgtcatctgtacccagccgatcggctatcatttatatatttaattacggtttgtttgtcttcgtttcttgttcattgtaggatcaaatcaactggcacgctcacatatccgaaggcgagttctggacctgcactggagttaagcagatctcccaggcctcgtgttttctgtcaacacgcttttggcacgcccattgggactgattagaagtcagaaagcagttttcctcatggccgagaagccgccaccatcgccgtcttcggctagcccaggttctgttaaagagaagatccagcaattagacctatctgaggttaatgagggcaacgtcatgaccatcactctggacaaattgacacctgatcagaaggagtttgaagcaatgatgcagcaagcacggaaccagttcttgaactcattcatgcagacccgcaagggaacagtggtgcaaaagtatcaggtgcgagtagtggctgatgtccccgggaccggttcttccaaggatggggagatgaaacaagccttaggtggctcggctcaaccgagcaacaaaggtgctacaaatggatcggctcaggagaatcagggtgaccactctcaaggagtacatggagttcaaggtgatggcactcaggggccacgaggaggaagtcttaatcaagatggcagtgcgtcacaggaatttttcaataattttcaagaccgggttgactatgctgtgcacaatgctttcatcaatcaatctggggtattagtcaataccttgtcaaacatgatgaagtcaatagccgatggttcaatagctaaacatcaggctgcaggcccagtttatttgccaggaggtacctttccgaattatcggcctttggtcaccgatattcatccacctattcaagcggttcctcccattgcatcatcagcctagccgacggcgccggtatcgatttccccatctactccgtcaatgtcggcaccaggtcagctggttaatcctcggcagttgatgagagagaacccacagcatagtgggcaggttgcgaatcggctaacgcaggatcaggttgctaccatgtttctaccacttcaacctactgttgatctagtccagcagcagccgattcaacaaacacccccaatccaacaggtcgtacaaccaattcagcaacaggttgtgcagtcagttgaacaaacgccaccaaggcagcagattgtacatccgattcagcagacgccatcaagacagcagactatccaaccgattcaccagcaaggcttgatgaatccatcggctgggcaacatactctgaatcaggttgttccagagcatttggtccatcacgtgcagctggatcatacggtagtacctcagattgtccctgagcacttggtacgaaatattcagccaaactagcagaattaccaggggggcaatttaagttatcaatatcaacctccttccccgcaagaccaatatcagcaagggggattaattcagcctcaatttgctcctcagtacagtcaattcgagcccatgcagcaacaatcgcaaggagcagctcaacaacgaccgtgggccgatgtaattgctgacgtgatgagggaacagttcgggcttaaaccaaaagagactggaaatttatactgacaaccgtatcctgaagggtttgagagagtccctctccctaaccggttcaaagttccagatttttcaaaattctcggggcaagatagtacatcgacttatgagcatattagccgatttttagctcagtgtggtgaagcatcggctgtggatgccttgagggttaggttgttccggttgtctttggctggatcggcttttacttggttttctgctttaccctatgggttgattaacagctgggccgatctggagaagcagtttcatagctatttctatagtggggtacatgagatgaagttgtacaatttgacagcaatcaagcaaagacacgacgagcccgtgcatgaatatattcagaggttcagagagatgaggaataagttcattagcttgagcttaactgatgcccagatagccgatttggcttttcagggtatgattgctccgatcagggagaaattctcgtctgaagactttgaaagcttaccgcatcttacacaaaaggtaactttgcacgagcagaggtttgctgaagctaggaggaattctaggaaggttaatcatgtctgttcttatatgtgtggatcggacgatgaggatgatgattctgagatagctgcagccgagtgggtaaggagcaaaaaggttatgccatgccaatgggtgaagaattctggaaaagaagagaggtatgattttgatattaccaaggctgacaagatttttgatctattactctgggaaatgcaaattcagctccctgctggtcatactattccatcggctgaggaattaggcaagaaaaggtattgcaagtggcacaattctggatctcatactaccaatgatggcaaggtctttaggcagcagatccaatcggctatcgaaggaggcaaaatcaaatttgatgattccaagaagccgatgaaggttgatggtaatccttttcccgtaaatatggttcatacagctggccaaacagccgatgggggccgtgcaaggggttttcaaatgaattcggctaagatcatcaataagtaccaaaggaagtataataaacaacaggagaagcattacgaggaaggtgatgatggtt

SEQ ID NO: 73839 - DNA, 39171 bp, Oryza sativa
ctatgcagggtgctggcttctcatgtactgtgaccgtagcgaagttgagcccatctcagtcatggtggttttcatcctgttcccgttgtcatagagccgcaactgcatatggatctagctataaatgctccagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactaattcagcagagtttgtgctatttggacgtgttgcgcagcaagttgttggccgtcctgttatgaatcttatcaaatttcagggcagatcagacaatattcctaaagaaattgctgctgttgtttcacagaaatttacctttgctgtctctgtcactgagcggagccttatgcacaggaatatatcttttcaagttaatggaatcgagactttctttggaagacagggttctattccgcagcctagggaatagggtccatctgcaggcccttctactcctttggctcttgctgcttctggtatggataaggatgacgcctctcaatctcatgagtcaaccccggtcgattcatctacttcgactgctgatccagtcgatgaacttcctggtgacagcaagaagcggaaatccattgtccgtcatgtacgcccttccattcatatcccatacattaccttttgctttttttatggcccttctttttatatgtctgattgctattccagcctctagcagcacagaaaaaattgacctttgaaacagctccatccagcaaagaaaacaccagcccggttgaccctcctactaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgagaaaccatgcattatgaacatattaatgtaggttccttgttaatctatattcctaatcatcctacctaggcctaatagacctaaataagtctttgctatttctcttgcttccatatgccattccgtacctctggtctactctgtactttgttccgccgtataaattgcctgtatgctaaatagaaccactttacattactatgacatggcctgctagctaatcaaaagaaacatgctcatagacaactacagaacattatttactacaggcagattagttgcttatttattatcttttatatgggatgtaatgcgctccaaaatgatctgcatatggcctaccatgttttgctaccactgaccattgcacgcagcctaccagttatatcttttgctttgcataggcatatcatgtaatattactaaccatgatggctatctgctatattgctcagttcttctcgcactgatgaccaagctgctgataagcaacatgttgtgcctcatgaggttgatgtttcttagattgcagctgcctctgctaaaccaaatactcaggttaagcataaatacaccactttccagctaatttagtggtcgaatttttttagtgacactggcaacctaattattcccgttctataggtcaaagatatcctaccaactgaagccaaaaagaaaaggtataaaactacatattcaagctgagaacgaataagaaaatccctatttttgtactagcggtggaagcatgtcacattcattgttaaatagactgcaccatttcgctttcgctgctctcccgtttttggttcttctagattaaccaggtgttcctctttgctttagtgttgatccaggctctacaggcacacgcaagactaagcctcctgtaccgaaagggaactaaatgctcaccttagcttttgtgctgatgtgagtatcctgttctgttatatatctatgggcatggcattagtttcacctagattgctgatcactttaaattatttttcaggggaacaataccctacatcagcgatcccaccctatgtctacatatttccttaatcttactgttggcgatgcagcttgacatggcacatcgtatcagacaatcttttgtttacatgattgctggcaccactgtgtccatgcatgtgcatgtttggtcctctacctgctgctctttcgccctttagtgtcagtgtgctttccataccgtagcagagacttcctatgaaacgctgccatacgactgcacatcaccccatcttttgcttgtatgttatttattgtaaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaagcttatgtttcatgtgctatgtgcctgtgcaggaatttgaaatttgtagcatttccatcctacccagctaatgtgataagtaggattttgtgccatcctttctgtcctaaagaaagggtgggcaaaatttgcagccaaaaatagcatacgcgttggatcgatctgcattttccacttctacagggcaagccagatgcaaatgacatgcaaatgaccatcgatgttctgtagaccacacgtgaatagtcaatgtattcaggaccacttaccagctctactgccactgctatgttaattagtgttgcaccttaagattattatcataggtactgcagcaccttacaaatatcagacatatgtatgttgttagcgctgcaatctacttatctattgccgtctgctttcattacttttcccccaccaacactttttaaccgttcttccctggctatcagcttattgggcggcacacgtgcgtacaggcggcacgccaagggtgcgccccaacctctagtagtgttaataggtgatttaccacacaactggtcaaactgtgcatttagagctagcaaatacttcttgtactcatttcctatttattgcttctccaaaattattttctagatcactacagaactgaatctcaacaagaaaaaacacaagttaccaaaacctaaatttgatgtatacatccaccatgatctgaatccatacttacatccaccatgcatgaccctacaaatgaacacaaattgaccatgcatgaccctgtgggatgaaaatataccctgcaaatttcccagtgaaagaaatgcgtctgtctaggaaaggtcaggaaaaaaacagaataaatattgctactggcatttgaattttaaatccatgcacacaataaaggaattttttttgaccgaacgaggcattcaacaggcacccaaatgaaccggtacgtcctatcgctaaacataaaccaaattaaccttatcctatcctatccaacagccacccaaagttctgtataatcccaacagcattcacatagtctcctctatcatcaatatcagtttgaagaaaacaggaaacatgtgtagactaatggcattttttttttcgctgggccggagactaatggcattttcatttggctgggcaacgaaaatcctaaatgatagagcagaactggacagtgaagcacgacttggtcatcaaacatcagtttcttatggccgcaaggtctcaactaatttgcaagctcaacaaacaaaagaatcaatatcctctcagtttatttttttgacatgtacttccacaattccatattacgctatctagcttgacaaaagattaggcctgcaatctaaatcagagaaacatattaagataataactttctttgccacactgcccacacattcgcataataatttattttctcacaggtttatgcacgtacacacataatagccatgacactgtaataatgaaggaacgggatcgagcgacgattaccttgttcgcgtcacggtggagagggctaaggtggcggcgcaacggagagcagatggcacgagggagtcgacggcggcgtcgcagtatagaagggggtgcgtgggtgagcagtcccggtggcggcgcgaggggccggggatcgacggcccgtgacaacgatctacattgtgtgggggcattggtggcgtaaatctggaggcgggaatcgacgacgatcctcgtgagggacgctggcggtgtcatctggaggcgggaatcgacgcgctggttggggcgtcggcgacatcgatctggaggcgggattcgacgatgatcggagtgagggtcgaggtggagagacgggaatcgacagcgacgcgagggggcgccggtggcgtcgatgtgaaggcgtgatggggcatcgatggcgtcaatctgaaggcgggagtcgacggcggctcgatggcagagcgtgggcggcgtcgcacgcgatggcggggcgtcggaatcaacggcagcatgggagagaggaggaggtggtggcgacgattagggttcgccagggggagtgcggcggcgcttgtggtggcagaggggaggcgacggagcgctgtaggttgggagacggttgggggaaggagagcgcgttggggattttcggttgaggtgggaggaggagcgatagcggcgtgattttcgtgcgcgcggaggttgagggggtacgtggaacaatatgtggcattggattggatgattctggaccatcagatttgatgaatgagtaatgtaggtgtaagagtgagttggtgaattatagggtagatcgtgaaacggaattgctataaagatggcgacagatttttcactaatctcagtcggttttcatgtccattggattcgttcgcatgcaaacgctgcggcaaccgtatccacccgatcttccggttggttttatatacggaattgctatatcttaatcgacagttttcttgcaacgaatatgtcacttttcatattttatacaaatttacacggtagttacacaccacttagatatgtaattagtatgtaattttgggatttacatacgtaattttagaacttacatatgtaattttgagacttacattgtaaatacactaaaattacatatgtaatttaaggacttacaatgtaaaaacataccgactattttttagtgaaaaatatggcgctataaatatagctactcccacggtgaaatggccggtcaagggtaactaacaaacctgttggaactttggaacctcggccgcatctaaaaaccaaaggatcgccactttgcttggggaagtgaaagaaaaaaaagatgccttttgtagcctgaacatggttgcaacctgaagattttttttttgttttcttctctttacttgtgatcgagatagaaattacgcatcacgaggaggaggaggaaatacatcacgagaaaaacaatcaaacggcatgctaaacaggacacgagatcagtctcgatcgaagaaccaccaccccaaccctttttctgcacctagcccaggagtacaccgccgccgctgttggaacacgtaccaacacatgcgtgagccgtgaggtcgtagcctaagcaccgtacttgtagctggcgatgtcctccgtgatcatctccaggtccctggccgccacggccatcgacattgcccgccggtgccgccccgcctgcatcctcgccggctgctgctccgacgacgcgtccgccgccgccgcgggcttccgctgctcggcgccgccgccgccgatgacgtccgccgccacgtcctcgaggctggcgaagttctccggcagcacgaacacgctctgcgacgccctcctctggtgcctcccggctctctgcgacatcttgaagcttagcaacacacggcagcagcaacaacgaagaagctcttaagctgcgcgacttggttcgctcggcgccttagcaaattggaagaagaagaagccgttatatataggctaacgcatgcacggacactacatttattttattattccattgattatgctcattactactgctgatctactggtacaattgtaacttgtaaatgaattttgtgtcagttcctggctcccccaagtgcattgacttgtacgcattgcatccatgtgaagacgtactctctcccttggattgattaggataatttggcgattaaacaaggcgacctgattgctgaaatgtcacggcgctcttgctgatttggtgctcgatcgtctggcaccttgctaagctaggatctatactcctacttggctagcgcgtatgccgtgtgatgtgatcgattctgcctgatcaggcctctaaactgaagccaacttggcacgtactgttaactgtggtagttgacctggttggtgagtgcagtgtttttatccatttctgtgcgtgtacgatgtcgctatgaagcttcctcgagagtaaaaatatggtattcgtgaggcgtatgtacaggaatctcaggaccgagctcgccatttttattggggtagtgctccgctcatgaatcattctgacattatcagcagagaaccacgtgcaaaccgaagagagaatccaccagcagaatcaatcacataatactactaaccagatcaatcgcaaaaaaactgaaacatgcaagtacggatgccctgactaatcatgaagtttttctaataacacttgcaagaaatttcctcgtaatcctttgtccctgcacaatactatggctctagttgtgtacagatagtgctgttactacccacaaacaattgctaagaaattagtatcagttagctgtttcaataatttttccgatggttcgtgcttatcgcaatggaatcttttcgttttccttttaaggagcacaccactctgtttatgtaggtgctacaacctgatcaagctggatgtgttcatgcgtgcggaaagaaaaaaagaaaaggaaagggaagttgttaactgtcaaagaaagcaccatgcatgttagaagattccaaattcctagctcaaatccagcctcacatgggcggtacacgtgggttgatcccccacgcatgtaatgcaaatattattggggcccggggcgttcgctcgtgtgcatctccaacaaatttgctgcaagtcgccaaacttatgagacagggaaatgtgcaaggcagcagcacagggcgtgtatatgctcttctcattccaccaattaaaaggattgatttgtaatgcgggtctgggaagtgggaactgaattgttcataggatacgttgtttggtttgagtacgtcgatgatcaaaactgtggtttggcaggctgatctagtgctgtaaactggtgttcagtttggtattgataaggagttcctcttctgccaagactggaggaagcgttcgatgcttgagctgaaaagggaatatattgtcagttcagttccttgtgcagattgggaactgcagccatgccggctagttgcctccttcctcattctgcgacgtgctcaacgccgtgggcagagtaggtatcgtggttcgtggacgccgttgggctcaacgccgccgccgtagaatgtcgcgttgtggcggtcgcggaagtaggcgtacggccgtgcatcgtgtacggtcctggtctttgctgtctccgacaccttgatctagtacatactgaactctcattccggctcccggccggcggccggtggtggaactgtcaaccgcgtcgcccactcccgcacgccggcggcgtcgacgtgggatttctttctcctcgagcggtcgtgactcttcaatgagcatctccctcgtccgatctgaacggagagcgcccacgacacgccatcctctgggttgaggccacatgtgcgatcgatctgcgagtccgttactccacccgtttcatccttttaatgagttgttatgattttttttctaattaaacttcttttatgtttaatcaaatttatagaagaaattaacaatattttttgacacaaagcaagcatattatcaaaacatgtcagatgtaagttttagcaaaattaatttcatgctgtagatattattttttttataaatttagttaaattttaaaatgtttaactaagaaaaaaaatcaaaacgagtcaaaatatgaaacagaaggagtactacaaagtggtcggcaacggaaagaccgcgtttgcattagtgcaatttatttatcctcggtggaaccaaacgtaaaatcgaaccgatatgaaaatggtaccggtctcaaaaacactaacggagccatcattttgcttattcgcaaaataagcgaaacggtatatttgcaaacgaaaagtaacttgtaaatacaaattatatatatatatatatatatatatatatatatatatatatatatatatatatatatatatatatatatatatatatatatatatatatatatatacttagcgatctacaaataagtgcggaaaaataaattcgataaaaaaaacctcacaatcaacttcaaatttaaagttaaaaatttaaattttgactgataagcataagcataagtgaaaagattaggccctgaaaaaaggaccggaatgaagatgttagaattttttttattttaaaatttttattttttaatatttacagaaatattatatcatccaaaatatttacaggaatggccactgccgtccaagtggagggcggcaaggtgtgcgcattttgtactaaggtcccttgccaccctctgcaagggctgcaagggggcaaatgcaaatttcgccttgccaaaaatgtatttttctaattttttttatcaggcctacttctgtaaatattttcgccggtacaatatttctgtaaatatttaaaaaataaaaatttaaaaatgaaaaaaaatcgaaaatgttatatacccgtaccataatagcgaaccaaaatagcactcctaaacagggaccggattgcaggagcccattgaatgggccgtacaacatatagtgatttatcagtgggccgttgcccaagcccaactaggcaccgcagatccgacggccactaacgcgcatcatctcaccatccccagcatccacaggggccgtcggggggtcggccgccccggacggcgccgccgcccaccgccgatcgccgttggtagtggtatggtgtggcagcagcggcggagattggcctcgtcctcgcacgccggagtcgccgagttcatcctgccgcggcccgcgggccctcgctcgggtgctcgggtcgggggaatcctctaaaccgtacggcgtcgtgtccgcgagggccgccgtaccagatgctgctcaagtagcccggcgtgcatctcgttagagatctatacgaaggggaggacatgaacagcttccagcagaggctcgcggggaggttcagagatccgaccacaccacattggtcatccctaagaaagcgtggaggcgtcgagctactagattttctgataatggcaattttattaggttcttaatttctccgtgtttcgagttcatacatggaaatgcaaaccatttttttgatgcattgatagggaacaagaagtcgatataatgtcgtcatgctaactcctggaatcaaaaccaaatggtgaaatggagaatcatagtcgtttccatgttcatagtagcatattgtcataactcataaattctgacaagtatttgtgtaggtctatatgttttatgcttcagagctgtggcatgctcattgacttatggatctatggataactattttaggtcagcacctagctgatgcttccagactgtgccgaagaaggtaattcctgtaattgattggcaaattatcaagacatcactgataatgcatccagacaaaatgaaaatcatgaagcatgtcattgaaagaaacattgtggatcatgatcgtagccattttccaattgctgttcaaattaaaggtttcaattaaacttttttttttgaaagatccagcaagagcgctggcattatattataagcaggagaaaaataaatacaaagtttatgtacatagacaaatggccacctcgacgggtgccaataggaaggtctaaattaaactcggatgatagttaagtaggatactaggattgaacctctcctaacatgtcaatgaaagaaacatgaacccaaaaccaattcatgcattctaatttcgaaataacacgtaagcaaatgaggatcaagcttaaaatatatggatacaactttggcagacaatatccatttgctaaggggctgtttggtttccagggacttattccaaatccctgtcacatcggatgtttggacactaatttagagtattaaacatacactaattacaaaacccatttcataacattggactaatttgcgagacgaatcttttgagtctaattacgccataattttgacaatgtgatgctacagtaaacttttgataattatgaattaattaggcttaaaaaattagtctcgcggattagctctcatttatgaaattagtttttttattagtctatgtttaatactctaaattagcgtccaaacatccgatgtgacatggactaaaaaattttagccccatctaaacaccccctaagttgttctggaatctgcacctttgaattaggagcgttgctaaactatatgtgctgttccatggcagcactgctggagttattgataccattttgtttcagtgacccaataacacacttttgtgtttcatatcaccaaactgcagtttctgcagaccctaggacattatttgggggacaaagtagcactgtaactaggatcatgaagtcaattttgtgtttatcatcaatctattgaattcgttcaaaaaaaatataatcaatctattgaaactttgtaactgtatgtaagataacctttctactaatatgatgcattaaatatcttagtataaaacctagctaatttaacatattgtgcaagtatagtattattatatcctctgcaagtatatcctctactgcctggggctttgctttgcatttcccagataacagtaatcaaacactcacttgagctttccaactaaagaaatcaagaaaagatgccatgacaaatactagttcaccacaaaagatacagtagtctccacaacaagagcactagttctgattattactattgtaatagaacaactgatacatgatgatgaattctatcaagagagctccggggatatagacactccattaccatcttcttgtcgagatggagaaggaagacctgccaaagttgtttagttgccctacatggcctagcacctgcctagtggataccttcgctgcatcggccgttgaggcatcatcttcaacaccaccggcgaagctgagaagtagtgagaacactgcatgggttgcatgcagggcagcggtgtcaggccattgttgggggtagagaggaatccagaagaagggtcctccatggaagatgctgtgcttggtttcatttatagagagtacacgaggtttctttcacaaagtggaagcttaggtggtggagtgccttttcgcagaccgaaatgaggtatcttccttagcatattccttagcatgtggaaacttctttttctgttctatgcttttgatttgctttggagtttttcaaagtatattccatgcttttgtgtgctttttggggcctataggtttatgaacaataatttagatgatgaatacactctagatgtattggagtaccttgacgaagcatgggctggaaagttggttttggtggtgatcacccggagcagatcttgcgtcatggacctacttagcaggtgcagtttggctggtcttgcattgtgcctgtcagattagtgctgtacttgatgcattgttgtcgtttatacatgaaaccaaatgaaatacaagaaccatatgtagattgcagaacaaattattttccttctaaagagggtgagatcttagtagaactttattgcttgtggtgccctgctgtttgacaatgtaattggtgcgagacactggcatatgatctggcctgagccttgtgtatgatgttatcagactggactaggccaggtgggccttatgcctgctttggtcttcatgccaataaacagagggagggcccaaaataagtcctttaacaggacactgatgttcatgttccaatgtatacttacggagttgtggacttgtggttataacttataagttgcaagggacagatattgcccaatacatttcatgagaaaaatctcgctatgcttttgcatctttgcacgctcatttggtgcatacggaggattggcctaaggctgtaaaataacaacaataataataaagctcaaggcttgcgagttgctcgagctcttaacgaaccgagctcgagcccaaccccaagctcgcaaaatttgttgagctgagctgaaagcatctaatgagtctggttatatgggctggtacattctaaattgtttttttactacgaaattatcatcaaatatatgttatcacgtacttaagccaagcccgcctgaaagcataaaggggaataagcttggctcaacctctagcataaggcagccttacgctctggcttgcttgagctcggctcgttgacagccctaaattaaggcgtgtgaacctctgtcaactaatggcaggcacatggtggtggttcttaaaaaaaaatcttcgtttcaaaaattcacattgaagttactaggttggtcacaatcaatttgatgcaaagcggatcaattactaaattaattgataataaggctaatttccccatctaactcagatactatattacgttgcaggcaccgctaattaacccaaaattaaaaagagtaaatttcacaaaactaaatatactttgactaaacgatcacaaaactatggatttaagacattactagtaatcgtgcacgtgcaatgcacatattaacaaatattatatgaatatgaaccattttgataagcatatcacattcaaacgattggcaatagaccaaggctacataaacccaagaaacatgtttttttttctttaagacattgtagttctgcttttatttttatatagcaaggacatattactatataaaaaagagaagaataaacgttgttccgcttgtcatagcatgttgactgtagcatccaggtgaatcctttggcgtggcagcataaagatttattttagttgtttattttggcaacttaaaatttacataaaacttaatctgagacgcatcccatctaaagaaaaccaagagataaatctttgagactatagaattgattcattcactatatgtaaatcaatctctcttgcagtgtttgtggcaaaagatgagcgatgcaatcttgatcgtttgacatagtttattctctttccatcgtttgtacacgcttgttttttggtctcctacacatcaaaagaagaaaacacaaaagaggtagcaaatgacaatacatgctttactgaagattactggccacagaatggtatattaatggtacttattgcagttttaagccaggcctatccaatggaggaatgggcatccagtaaaaataaactcaatggagcagaccatgaacatgattacatgaatggagtcagaggtggagacaccatcttttgcatccccttcactgtgtagaacttgttatcagtaatcagttttagctaaaaggaagtcagctagatcaaaatccaagcaattgaaatatatccaatctgatgcagagaagtggagaaccaacctcgtgcaatcgctgagcactgctacacacctatgaattcctacttcaataggaaagaccataaacatagtagagctacctgttttccttcaattcaagaatttttggtttcattaatcgaaacaaaaagaagaaccgaaaaaattgcaaggagaggaactaaagattttctttagtacaagagccttcatcctcgggatgttgctttcaaaataaaagatatagagcagtgcaaagaaatatttttcacaggttaaatcgcaaaccaaatttcagtacagccgaaaaaaaatagatactccaatcatgcacagacatgaaaaaaaacatatttcaacaattagagcccatttcaaaagaagcggtttcagttctcacaaatatgacatgcaatttgttaatcttaatactggtgggctgaccatatcaaggctaacatggaaataaagcacatcagttgaacttcagattcggtagtggtagaaaattggcatatttagccattttattatagtagtagttttttgagcaggaagaaactttcacttcatatagcaatatattagtaactccacttcatgtagccagaaagtaacagaggagcttgatgaaatacatgtgcaacgctgattagaaatagcaggatgatgcttgatgataactcatccagataatgcaatgctatatgcagtggctgtttaatattccactccatgattcacatgacttttttgtcaataaaagaagacaggtaaatataataaggtaatactgggaagggtatatcatcttactttacatttgatagaacggacttagagagttcttaatggcccatctgtcacatctcgttatctgtggacttccaaatcagttgcagttgaacaatatgaagaaatgaagtatttgcctgcaccatatgaagtattcgagaccaaagaacaattcagctttagtttacacaagcagagctttaaatcacaacatatagtgcaaaatagagtaaatatgagataataataaggattcaaagagtaacatgagtgcacctcgaccatgcatttcatcaaacagttggtgtgctgcccatgggcacaacaaggaaccaccatgatagctgatctggaagacatcctcatcgtaatggaaggataccatccgcaacatgcagtcgctacagccgctgaaggcctaggtgcaaacatgaggctttcctgcgtggcttcagcgatggtgacatggaattctacatatctatcgaacccaacttttaaaacaatctatgcacttgtgtaatcacttgaacaccatgtggattagtttaatgataacaaaatgaaacacgatatataatcttatgattatacctagctgttaagtttgtattcttattggtccctgaaagataaattttcagctcctgcacttgaatcttgcatcatttatataggtaaaacaaattgacagctgcatttataatttcatttaggatttatcatgtaaattcagggtgaaagtgaaacaatacctcagaggtactgtcattgtgtgcaaggatcaaaaacaaaaatggccaactgataaaattatgaaatttgggatctggggcaatgacttttgttgttgattaagtacccaggatatcaatgatttacatatagattgatcttttcattttgtataatttccaaagcataatcaaacattttatcaaatttttaatttttgatatctattggaattgcattctaacatgtatcaatcaagcaaatttgccacaagtcaaaatcaatggtgcaataaacataccatttgagcgcacagctatttctcttatgcgccgaaccagtctagttatagagaaaacactttcgtctcaagatttccttccagataaagaatagaactgaaatgttgcaatggtacaatttacttgtgtttggggagtcaatcaaccaaagaattttaaaaaggaactgcacaaagctaaaaccttaaaacattattgccatgtcacttatatacaaattgacaactgcgaaagatagaccaatatatttagcttctaactacaagggtaatacagtagaacagtgatataatcacaaatgagaggtagagtaaattcaagtcgatagattgacacaagagaaaaaggcatctgccaatccccactcatgtagagctaaaggaatataccaaactctaccccaaggaaaccagtaacaagcatatcaagtataattataacagacgctttactcaccaacaaatcaattgcaacagagctatgaagttgaaccattgtaactaagaatctaatccaacatacaaagtctgaggttgtcacgctcaaacatcaggaaatgaccctttactacgtttacgcgatagctcgtctgcagaggcaacagagggctcaccaagtcttgacgtgcttgagcgcgaggctgccggcctgccgagccggtccgggtagatgcagacgcggtgccactgcacggagcagcgttcagcgtactggtgcggctcctcgcagtccagcgggcggcggttgttgcggatgccgccggtgccgactgccgagcgagaacagtacgaccgttctccctctccgcagccgcttctgtatcggctcctgccccaccttccccaccattatcgcctttgcgattcccacccacccaccctcccacacacacaaaaaaaaaaaaaaaatccccaatcaggctatcagctcctacctccgcggttggagtcatccctcctcgggcgtgtagatgtagataacgaagaaggcaaggacacgatggagaggaggatgatagggatggaagttgtccggtggcgtggaggtgggcagcgggcgttcgactccggggcgtcgagggtgaagacaactaaacatggcgcacgacagggatgcgcacgatgaagacgggggatgagtgcggcggcgacggcggatggggaagatctcggctccgtggggggttggggaagacctcgcctccggttcagtgcgcggtggcggcggcagcagaaggggacgacctcgtgggcagcggtggactgcggcgacgacggcggatggggaagaccttgtctccggcggcggcggatggggacgacgtcggctccggccgcagcggatggggaagctccggcggtggctggggaagacctcgcctccggttcagtgcgcggaagcggcggcggtagagtgcgcagtggcggcggaaggggacgacgatgcgaggagcgagccgcgcattgagagggtgatgaggcgtaatcttcgcccggccttcgcgcctggagagtgggaatcgtgcggtggagaaggctggacggtacagattacatctgatttacgaatggacggtagggatgtaaacatttgatttggcatgtaggattagagggggcaactcatttttatattagtatagatatcacaaaattacatattaaggttaaggatcacaaaactacaaatttaatattgaagttatcgcaaaatacatattctaggatttaaatacctattactaacgttatattggatctataaatgttgtagatctgggatatgtactaaacctgtcatttttgtaatttttttcctaattaatttttatttttatgatacttcatcctaaatatgtagttttatgagaaattttgcgctaaatatataattttgtgatacaagaccttaatatatgtagtttttgtgatagtttggtaaaagtatgtgtagttttgtgaaatttacttaattaaaaatggcgactaagaacgaacaattcactcacactttaccattctaatttctaactataaaattaatttattttagtttacttggaattgagttattgtacaaattgattgctcatttctactttcagtttcgaatttcgttatttttttaaatagagatgagtttttatacaaatataatttttgatatgctttcaattttatttggaatatcagttatcacatattttaaacttacttggacaattctttttattgtggattaattaaccgtgaaagtttgatcccacaaaagttgatgaatgatgaatgagcatatataccctttttctgtctagaaaaatatcggattagtgtgttgaatttcaaaggagtgaaagggtttgatagctcgatattagcagtacgtagaaatatcaatgattaaaaaaataatttaggggtagatctttatatatgtagccaacgctgaaaaatatatgagtatgacaagaaccccaaaatcaacttctaaattaaattttaaaatttaaattttggttgtatagctaataagtcaagaaacaaatggtataaattgacagatactctctctacccctaaaaaatcaatagtaccatatgcgacacattgtcacaatatgtctagttaaacatgcatgttatgatctcacaaaggtaatcgcctctaaaagtaataaaacaatgttcgatctacaactcacgggcaactcaattacacattgtcagagttgaatcgaggttgtcgtgttacaactgacgtcagaaatatgcaacggaggaatgacaagaaaaaaccataccactaactttcatgaatttattgttatttacaacaaaaatacaagagttcatctctgagttcattctcaactaccctggcatattataaaaccccccaaaattacatcaattctacgaaatgttaaaaagtaaataaagaaaggtaaagatcaaaaggaaaaatcagcggtgtatattttatcaagaaacaaaggaataatcggcaacagctatcatgcaataatatgtgcagtttgaacggctcaaaggaaacaatccaacatggcgagcgccttgtgtacgccctgcccgccggcgccgagacccaccacgttccggcactttgcgcggttctccgacggcgtcaggttcaagtccaggcagacaccgccgccgtcgcaggccttcacggccgccgccttgcctacgtcgccgttcttcgtcgtcgtcgtcgtcgttgtcgccgccgcctcggcctccgcgcggtgccgacgcatgtgcccgccgagcgcctgcccgatggggaactcgagcccgcagacggggcactcgtgcaccctcggcttcgccggctgcggccgcggcggcgtcggctgcctcccgaggcatagccccgcgtcgtcggcgccggcgccgccgccgagcgcgtgctgctgctgctgcctcggccgcttgtggctggcgcggtggcccccgagcgcctggaacgtcgggaactgccggttgcacgtcttgcactcgaacacgcggtcgtgcgcgccgccgcgcaccaccaccggctgcgcgccggcggcgaagccgccgccgcccagcaggccgtgctggctctgctgcgcgaggagcatcagcacgcgggccgtgtccacgctgccgacgaactcctgcatgtcccacatgctcctgctcctcttgctcatggctatagctagcttaattagccacgtaattaattaacccagctgatcactaacgtcgccgatcgaaatctgtatatccgctgcactgtgcaacaatacttgcacatatgctgcgcgtatgactatatatatagagagagttagaaagaccaaatggcagcaaagctgaaacttgtggtttggtgcacacgtaggaaatggatcgagctagcacgacgaacaacggcccggcttgcttctagatgtggatgtgtgtgtacttttctaaccatttgaccacgagagagcatgatcagattaattagttcctcccgtagtagtagtacatgggacgaacaccttgttttagtacaagtagctagctagctttagtcaacatgtgtgtgcactgcatatctgtggtggtgacgggctatgtcttgttgtcttctagagtggctgcagcagcagcgccaagttgcctccaaccactcggatggatagcgagagagcgagctcgcggcgccggaggcggttgcgagtgacgtgcgcggcgcgcggccggggtggcgttctggctcgggcaattcgccatgttttcttgcctcagcgcgcgacgtcgcgtgcgggcgtggcctgctcgccggccggtcgttcaatcccaagcctgcacactgaagctgcagagcacgggtttcacacacgtacctcaagctgctgacgacgacgcatatactacatgctacggccgttccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatgagaaagcatatatgctattatatgagagaaaatataatgatgctagccgcgcaatctgcgcgggccaccatgctaattgtattaaaacgtttaaccaagatgttctgtacggacaaaatgtgatcgaacacgagctgaattcagagagagctttaaaaaactagtgcagtactgtactagtgtgttccgttgggactgcataaggtactcgtggttagctagttatagctgtttgacacggcaatgttcatgccttcattcacccacaaatttcttgactggaatagtggaatgcatggtctttatttttactttctgatgagcacttcatctggattaaccttgtatgaataatcagcttgacagctttgcagtagctgagtcaaatgccaatccgtgttaattagctcacgttctgagctttaccgaggaattcaaacttacatgtttaaacttttggaacttgcgaagattattattgtggtgggcacacctaacttcagatgcaactccgcaattacgcttgtaacagaattcagaattgagaaagaagagagaaagatgagtttggtgatgcagtccaggtcttggcggcaaattaaacgatttgaccggttatcagtggggcgaaatggctaggtgtgtgcattttgtttggctgactgggcccatccaatattccaatgattcagttaatgcctttctctgcacactacttaacgcattctacgcttttaattgttgcaccgcctgttcataggtgagaacagcagatgccactacgagaacatgtcttcaatgcaactactcccccgtcacaaactactaattgccaatagtcaaattaagttttgatagtttgactaaaagatttccaaaattataagaaatcatagtgcctaaacttgataaatagtagtagaagggatcagctgaactagatgaactcccaagatcggtcaaatggtcaacacacacgcatgtcttaggctggtagcctggggcgttctctctctcaaaaaaaaaaaagagagaaggtattgagctgaacctcaaaagctaatttttgcagcacatatagatatagaacgaccactatcatgcatgactcatgcgtgcaaagagttctagttacacctaccatttgttcctgaatcctgcatattttgtcaacacaaacatcacgagtagtgagtaccatgttctaaccaagaaccaaatcttggactccgactgactgactcaccagtcaccacagcaacacacacatcaatgtgcggcacgatttcacgaaacgtgttctttgaattttcttgcagcagttgtacatagagcactaataaattagcttcttttaaacaactctaattaggcaagtgccgaagagataagtgttaacgtacttgctaggtcatgcttgcataagttgtattccgtttttataatataaaaaatataacgtcttccatgtttcatcattcgtcttttaaaaaaaaaggtaaatatgtcaaaatataagtcacacttatttaaagtacatttaatactacgcccatcccaatttatgtataactgtgggtttttgtgtccaacgtttgatcgtctttcttattttaaaaatttatgaaaaaaatttaaaaaatagtctcacatgaagtactattcatgttttatcatctaataacaataaaaatactaataatatttttttcaaataatatggacagttaaacgttggacataaacagtacaaaattacagtctttctgggatagaggtagtaataaaatactacctccgtgcaaataagtgcagttgtgggtattcgtgtccaacgtttgaccgttcatcttatttaaaaattttatgatttttttaaaaatagtgacacataaagtactattcatattttatcatctactaacaataaaataactaattataaaaagttttcaaataagttgaacggtcaatattggacataaacaatacaaaagtgcacttattatgggatggagggagtaaatcataacaaaataaacaacaatctctgtgtcacactattattcatatttaataatattattactatatttatatagctgcacgatcatctgagtgccaaaggtcaactcggcatatttaatatcggacgacttctgtgatagtggctcaggtgtctggaatggttgtctttccaaggtctggttgcttctagctgatggaatttgcaaaaatgtctaagaaaattaggtcacaatgttgtacagattttgctctagaagtatacgactggactgactgcatggtaattctctatgagcaactcagcatgatggttacgctcgcggctaatcatcattgtggaaaaagaaacgccgaacttaattaatatgcattttctcatctagtatacccgattggaacgtacgatgcgaaaaatagagaaatcgattttgcacgattcaaatcatatagggtagttccgacgtcatttggaattaattagtgggtgaccccaacattaatgtttttctttttaagttcctagccatggcttgtcctttagggcggtcccaacccatgatatccataagcagtgtctatgataccatttcaataagacatcacaacataaactacactttacaacccatgatttcttaaagtgggccattaataaatacatcatctctcttctctaccaataatatttattcttcatctattatgaagacactattctctcccaatgcaaaacttgatagcgttgaagctatgtcatgcatgagacccagtttcttcctctcttcactctttctcttaattaatatagtgtcatataagttaaaagtcctacatagcaatataattaatgtcatacacaccatcctaggtggagggttaggactgcccttaatagtaatgacaaaatatgaaaagctaagactattttttgtgggttattacttattactagcgtaccgtttaactataccgtacagcgttttctagtctgtacatatgttttttcactgtgctgatgaagagcgcggactgcatttgtaatagttagaggttaacttctccaatttttgagagcaaaaaaatttccgttttaatttaggtgatgaccaacttaaactattgcatgattaaaatttgagaacaaaataaaaccttttcatttccaacattagactagaaatgtcatcaagcttttgagcatacacgtgcataatgcatgcctaggctcgagtaccttgtgcatttggattttggtctcgcttttcataataggtctcatgagcataaactaaaagggttaaaattactaaacaaacctatagttaatcttgggtgataacatgtggacttaatattaaactcaaatatcatcttctcagcccaaaagaagtttaatgtaatccctgtaacaatattaggtgcaattatgaagtgggaacacatatacaaagtaaagtaatcctaattctctaaaatattatgtgcaagttaaaaaccatggaaaaaaattagatagacaatgtttagcacaagcaattcactataatattggtacaagttaataactaagtttaataccacaaattaatcagtcaaagcataaaactaaaaggaatcaaattaaattttaatcggctaaagccatacttcatccaaaagtacatttaactgctcataagtgaacatggaaaataatttattcaaatactagattatttatcatgcctaaatataacttttctagaattttcctcctctatttaagcctcctaaaaattcaatctagctttctaatagcccgtctttgtttaatttctatgagcagtctacccattatttttaagtgcaatcaaagaaaatggaatctagatataaacatctaccaccagtaaaatctacactaattcttctggtccacatattaagatattgagttgcaaacttagggggaagaaataattccgaaaattatccaaaaactaagtctacccaaactcctacccatacctctcttcctagcctagcttccatcgacttggccccacctggcagcctctccagctcgcccttcttctgtccgtcatccttagccgaccaagaaacacagagagcaagagatcgagagccgaccgagtcctggacgcgtcgacgcgtggtgacgacgtgtcgacgccttcaagtcactgagtcatgcctccatctcctccagaccgagtcgcccaactccacacatcactctggagctgaagaagtcgagggagaggtcctcagcctctccgtcatcctcaacctcgccgccggtcatagtgacgacgaccttcgccatctccgtttgagtcaaggtcacctccatctctttcgcgttcccatctctccacacaatgccgagcatttcctcttttgacctaaacccctctcgtgcagtgcatcgctgggaacgcaagccacgctgacaacgccctggagcacgcaccggagcgccgccacttcaaccatcgtcgtcgtccggccattctcgaccacctcagagcaagccactgcgccatcgtcatcgcctcatcctcctcttcaatacgcctcaagaaccccagccggagatgtgaaggacttggagaacacatcttttcttcaccggcgccgatctagaattgcctccgccgtcatcatcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcggaatcgacttccatgcacacatgcactttcaccccaagaaccaccgccgctcacactcgccatcggcgctactccgatgtcctctaaccaagaaaactagaggaatggaatcgcgagagcttgctcttcattttatctcttgacctcaacctcaaacgagccaccgtttgccgccggcgagctcgagatcgagctcagccatggctagctctgctctgtctagagcagagggatgacttccgtgaattagattaagtgcagggatccgtttacaattgtagaaacacactgacatatgggcctaggactgcgggttgattcctagaaacctcaagggcctttgtgcatattggtccctcacagccatgtggaccccatcctttaaaatctgaagaataattaagaaaatgcccaaacaaatatatgtttagcagaaaaatgcacaaagttgtaaaatctatataaaatcaaatatagctcattttaaagtgattacagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcatgcactctctgattaggtgaaataaaagtaattacttactttgcatcaaattcctctaaaactattatatctaaaatgattagttttagataagctaaactttagaaattcatgtagaacccaatttagcttcaatttgaataaacttaagttctgtaggatcaccaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttccatagaaccagcaaatagttatcttcaacatagtaaaataaaatttggcaccttttgtagagaacatagatcaaaaccttaacttagtgaaataagaatttaaacacatagtgttgtttaagtaatacataaacatgtataagtatatatacactttaggtctaattaaacctaaataaaaacttgattgaccagtgaagccatagttccatcctcatccactaaaacttagaagaacttagctcatatgacaatttctaggttaatataatatattgctagtttagattagagcatctctagtttataaaatatgaaccatagtagtaaagaccataaacatgtgaaataaaaatgttttagttaaccaaattattccttttattcaacttaaacaggaagtagcatgttctgaacctataactcaaaagtcatgaacatataaaacactatatgcctaaaacacgttgtaacttgtaaaatctataagaaaatcattataactccaaaaattgtgaaaccaaatgtgttagtcttagaaaacacatctccacacccctgtgaagtctaatataataaaaatcactttacaaaagtattttataacactacctaagactatactactataaaccgataaaacttctaaaattcataactcccaaatggaataaaataaaataggaattatttcacctaaagtcattttagatcagtaccaacccactgtgcataaatcatgcattttagagcattttggattttcagctctttcggtatttaattgcatatcgtgtcctttatctagataattgcataatcggtgaagaagtggattaggtgctaacatttatctgatcaaggcaagttttctcctcccatcctttgaacgcattgaatcccatgatttgaggaatgaaaatatttgtttgcaaagttgcatgtgaacttaaactatattggtatttaaaattgggttaaggtagttatgacctatttgctgcattccctaccttgaataattgagcctcttgcagcttgaacccctagaaatggttacagtacactctttgtgctcaaattggtttatatatgctctatgtgcaactacttgcttagccatgcttagaaatatgcaaatgctcattccatctataattaaaatgtgattttcatatgtgaacctttgctggaataaaatgaatatgatgggtatttgcgaactaaaatatgtaaaatgtgattttatacttgggcggcaagtggtgtgcatatggtgttagttgcataccgatagggggagtgtttgcccaagtccataaggacagaacttgtgttacccatttaaagttattcgtacatccacatgtgctagtatgggatggcctaagctgattaatctatttaggaatagccttgcattctggtaggccggtgtgtatgagttcgtataattcagaggagcttcctatttaccccgacgtggtagtttaggtgactaagcgtgtccaatataacggtattgtgccacgtggtgggttcccgtcgtgtccgccaccacggcgttaagtttaaggtgtgggcccgccacttaacggttctaggtatattccaagtatgcctaggatggaggaacacgtatcgtgctggtgcaaggctaggctctaagtagtgtaaaggcttcgttatggcctctagatcacattcaacatgaagagtgtggtggagtcttgcaaactcaaaacaaactagagagttcatatcatgtgggtaaagctgtacaaactctgcagagttctttaaactaattgattagccatgctcacggtcatgagcgctttggtgatgtgtcatgagtatagactatgttttaaaaatgtgatcatgtgacattggtttgaaattgataaatgtgttgagttgtgtgtgtggtgatacattatgacttattgttaagtatggcaataagagattgattatgatggaattatgaagaagttaataatgaaacttaaaacttgtctttgttaattgaagcatcaactcctttacaaaagaattgcgaaacaaaacttgctttatgctgaaattgaactacatatttccttcctttgaatatatgccttacatgtagtatggtaggattgacttgtgcttgctagtacattaacttgtttaatgtactgactcttgctgttgatataaccttttgtttgcaggtttagacttagtctttgagtgatgcgggtttcgattgcttcttctaggatgagaacttaatggggtaaacccttagtcggtgtgcttgtgattgggtagtcaagcttccgctgttctctaataagtctatttggccggtcggcctatctaattattaagttgttgtatgtcttaagtttctttcatcttagttgtgtttgctatgtataatcatgcttaagatgaaagtgttaatctagtgcacatcatcctgggaactagatttacatgagtatgagttaggaatatttgagaggttgtagatctttagtcatttttgtcaagtcttctgaatgtgtaacacatctggtcgccgccttcgagtggtttgacgggcacatatcaggctgaagttgactggcaggctaagggctcagcaatgtctccaatatttctctctcgaggcgtcggatgtttcattatgcttgtttgatgacttgaattattcacttcatctctcaaatatctctcaaatataatgaaggtccggagagcctacgacagcatttattataagcacaagaaaaacattggtgttcaaaaaaatgtcgatcagattttttcaggtttagctcatctatattaatgccagtaaagacttatagtgtaaaatatataagttgaaacatttattagcgctaaaaaattatgaataaaaatttatcagaaatattacaaaatggtataccgttccaacgaaatagatgacgtcatgatgccgtcaatatgatacctagatatcggatctggtacatacgagatatcatatatatctaataccggaggtactagatccgatatctatgatatcatactgatactatcatgatacctagttatcagatctagtacatacgagatatcatatttgataccggaggtaatatattcggtacctacaatatcatgttgatgttagcacacattagcattctgttagaacatgtatatcgttctgtagtttccctcaacttttatacatgtgtttttagtgactcaagcaaaggttgaaaaataaattatgataaaagaacattaaaattaactttaaattcacattttagttgtggctgataagctgacgaataaacgatggtagtttatactttatagtagcatgtgcttgcaacttttcgttaggaattctaccaatatattatatcctctatttcttaaaacaactgaaatggctaaaaatgtgtttcccattttagaattttcatcgaaattctaacatttgaaatattgtatctatatattccaggcacttaatttcgcggtccaaaacacaccgcataatataattatttttttcaccggatgcataatataattattgcacttttgacttttatgtcatatgattgttttcttttagcccgtagcaacgcacatacattccggtagtcttctcaacaacagtaaaatacctgttttttcgtgtataactagaattctttgtaatcttggtggcgtgcaggcatttataaatccgtatctgctgtactcgaatgaattaattaggcgggactttcgctctcttcgcaaaaaggttctctgcgacataccctctgctttctagacacgcgtggccctgaacatcgatgtacacagtacactgcgttccaatgcgtacgaacacctgttgcaaatggcaataatactggctccacacggtgatccactctaacgtgaaacaatacttcaatctcagaacatgggaagtcaacaaatgcagatggaatgtacgcgccatatgatgtggactttggaattggtatggaattcatccgatgcaacttggatccaacaagcactcaactcggttaattaccaacgggatatcagaatatgcatgcagatgatggctaatcaccagcaatggacgcatggttcattgtatcaggatgacgactcctaaatccggcaagtcaaaaaaatataatagtaactacttgaactacatatgcataattgcaggtatgcatgtctctcttccatgttttgatgtttaatctgcatttgctttgctgtttcactgagtcaatgaaagaatgtgtctctgtcaggatctgtaattaattggtatcaactgaaggttcatccagaagaaatcaaatgaggatttgtgcgaatgcgattgcatcatagatgacatagcagtaccaaggtcagagtttatttttatgccttgtcatatctaggcgcacaccatgccaattcatgatttcttacttagtacattgcaccttgcatcatcacgttgatgatatgttaatggttagcgacgaacatatctattctaggcatggttgtatctagtaaacgattattgttttctatcttgctatataaatgcaggaaaccaaatttgcagaaactgaaggttcaccaggttttggcaatgcgtcgtggatgacatgaaaccagttacagctgcagtttcagttatgtcaaagatgcttcatttatattagtgtttcttgaattgtgagccatatactttttctccttgctaatcttgtgtggatatgaaacaccggaacttctctgcgcctacttgtttatatctttcgtgagaaaaaccatttgcctgaattttcagagagaagcttgtttgctgcaactactcgattccaacccaaagtacaggctgtggaagcagaacaccatcgtccttgtcttacttttccttgaactcatcctcaagccagccaacttcccagtattttcaggttttcaaagagcaattcgagacgaaataaatttcacacttaattttcgttatactactattcttaaccgattaacatgtgcacaagtcgaacctgaactagcccgtttccttctactacttttcagtagaaaatacccttgaaccccttttgtttcagaccaggatgtgcccaggtcaagagaaaaaacttaactacccagctgttgctgtgtctgcaactctgaatgcaatcaagacatcaagatcagaagataccgtgctgcttttgaaggtgatttactgagttctgacttgattagcagtcgactacgtactgacttagctatccagtgggaaggaagtcaacacacgggaaggactagtagtagtgacctcgccactgatccaatttgcagcttctttttttcagagttattcggtttacttgccggagtagacgactttaggaagctagcttgtgcagtacttctcaagttgtcgctgaaaagccttacctgatgaaagagagaagatgagataacaagttgcttctgagattgaagtcttgtttcaggttagctaagagtgctgattaagtgtgtaaggttgacagctctcttcaaccaagctgagtttccagaaaaagaacccaatgaggcaaggatctatggaccatttgaaacttggcaggacattttgcaagtatagcacatgccctaatatttttgtatctgatctatttattaattttagatagagaaaggaccaaggatatgctaagagaaaatgttggggctgtttggttatttgccaaattcaaccctaccaaaaaggttggctctgccagaacatttgccacttgtttggtttgctaccacaaatttggcgatacctttttttttccgttactagtctaactaatcttgccagcaatccaagcaatcatctttgccaaaaaaataatttgcaatagccaaatcttgccaatggttgccattgtaaaaatgttagcaatactaaaaatggaagagaatcaagtaggcccattaaggctgcgttcttttgtagggttccctactcccctctcgtttttcatgcacacgttttttaaactgcttaacggtatgtttttttaaaaaaaaattataggaaagttgctttaaaaaattatattaatctattttttaagttagttttagttaatacttaattaatcatgtgctattgtactccgttttccgtgctggaagagaatagaaggttttcaactagcacaacgaacacagcctaagccctgctacttcatcaaattattgctgtgaattatttgctctatgctacttctcaagaaaaaaaaccagcacttattctaagtcatttgttaagtttatcttaaaatattgtattattcctataatcaagtagataatcaagtaaaaatttaggtctcatcttttcgcttatacttatacttatacttatcggccaaaatttaaatttaagctgattttaaggtctttttaatcaaagtttattttttagcctaaaaacacgtatataaaaattttatttacaaattaatttacgtttacaaatatgccgtttcgcttattcaaaacaatgccttttttgaatgggctctaacgcccctggccgaaggatttatttattgatattcttatctttttcttaaccgtaagtctgtaaccagcccaataattatgggccgttgtttgggctttgggccggatcatgatattgcagttatcggatttgtacccgaaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggtaatttccttccgccagtctctcctctcacgatgtttaattgcgcgcatctctgtttcttcggtctagttatgtcgtttagggtttatgaccaagagcagatggtgaaaaatccggagttcttggtcactcggcgtgccattccatatcttttatgcgtaataagaccttttttttatgtttttgtttcccaaattttgctgtctggaaataatttcttgaaagggttggctttgatcgtttgctcgtgcaggaatcctgtccttcggtgaagaacattcttgtgctggattccgaagggaagcgcgtggcggtgaagtactacagcgatgactggccctctttgtcctcgaagcaagctttcgagaagtcggtctttgctaaaacccagaaaacgagcgctagaacagaaggtgattaaaatatacttttattctagttctgttctggaagaatcaaaacaatgtttgtttcttttttttcaaaaaaaaaaggtgctctgtgctacttgtgtagagaacaactgccttatccctgagaacatcaattagcaatttagcatctcacaatatggcattgttgattattgtaagactcctgtggaatattctagaggcatacacatatcttccagttcgagcatcattccattgtttggctcatcttctgtaaacctgtggtttgcttgttatgagatgttaattggtcgatttctgaattttggcagagttatcaccagattttgctgtggaatactaaccttatattatagaataacaggttatctgttttttactgctcatgaattccgttgcatttcttaaaattgactgaaagattcaagtttcggaaaaatgaatttttgttccaacaaatgaaatgatctcgatgcctgtgtcatctgaaatgccttatttttggttgatcattcattttgggggattttagaataattgcattgcacatgagtgtaaaatttgcatggtaggttgtttagttcaagtcatccaactatattcatccagtgatttctttcttttctttcccaatttgcagctgagatagtaatgtttgacagttacttcgttgtatacaagttcatccaagatctacacttttttgtaactggaggtgatgaagagaatgagctcattttagcatctgttcttcagggcttctctgaagctattgattaccttctcaggtgtggacatttcctgtgccgtacactcctatcttttttaacatccattataaatgcttgtcagtactgtatactattttaacaactctctttcttgttttcagaaacaaagtgcacagaagggctgcgcttgaaaacttggatcttatcttcttatgccttgacgaagttgttgatggagggtaattactatgtttgcattgcaatatgctaacctttgctttccatcaattgaacaagcccagttttgataactatcacatttttacgttcatatcaaaggcaacagacaaggtcttgggcttgtattgctgaaatgtgaggttaggcactagttggttaatgtaaagaaactacactctggccttgtttaggtgatgagaattgagccagaattttacacaaaatcagcattgacagctatcagttatctataatatttttatagttcattgttgggtatgctcagttcacagccaaccaattttcagataaacatttgcacaaatgctatgctaatgtagaacatctacaatcaggcatattaaacatttgacaacctgtagttattgattgacgctactaattgtttcttcacaatcgggttttgcaggattgttctggaaacagatgcaaaggcgattcttgaaaaggtatcaggtcatggattggaaggatccgggtctctcactgagcaggtatggcaagccgtcgcatcaccttaagtgcaattgcacaatgagatgcaatcatggtgtcgtaattgccaccaaaccaacatgagaaaattcccaagtgaattaattcttttttgtacatgcagaagttaagcagtgccctagcaacggcaagagaacactttgcgagatctattttcagctgatggcgtgtcatccttcaggttgacgatgagcaagcctcagatagtgtctctgttagcagatcagtactcccagtttgcaatgtcctttgaacatttgccacgggttagtggtaggtgcagcttaactggcgatcattgtcatcctaagaaggttgtggtcggcacacttgttactcttgtggtttcatgtcgatcttggctgtaatcgagcacagtaaccatgtagcaacatgtttctgctcaaagacgagccagtttccaaattgtcttcagtatacagccgccatgttttgacgtagtactacatacatttacttcggcctggtttggaatttgaatggtattctttatagctaagttgcttaataatgtttgactaatttcagaatacttgctatcaaaaccgaccaatcatcgaaagtaaccaaaattcgcattacaattctatcacctgttggtatgtttcatctcatgtcaaggtaaacaaaaagagacaaaagtaatcaagcaaagcgaccagaatcacgccggcaaactgctgccaatcctgctcacatactggcacagctggtccctcagcgcggccgcgccgacgtcggcgacatcgctgaactgctgccggtagccgtcgtcgtggttgtgcgacggcggcatgccgcccctcgccgcgtcctcgaggtcgatcatgatgttggtgagcaggcagcagacgtagatgatcctcggcagccggtgcttgtccggcctccacagctctcccttgagaacctgccacctctccttcagcttggccagagcaccctgcaccaccatgatcgtcgcggcgtgccgcttgttgaagtcggctttcgccggagatagatccttctcacggtatggagtcatcagccagggaaggagagggtagcttgcatccccaagaatgtagtctctgaccactgacccagctggctctcctggaagctccgtttgtccgtccagcctcgcgcctttctcgcagagcctgtagaatcctgaggtgcgcaggatgcacgagtcattcaagctgccaggccagccactgacaacgtctctgaaccgcatgtcggcatcgacgatggcctgcaggaccatgctgttcctgttctcgccgtcgagccagacattgctgttaggctgagctgaagagcacatgaggatgtgcgttgtgtctatggcgccgcagcagttggggaggccctgaatcttttcaaacttagatttgacggttgccatctcctcaggagtaggccacttaagatgattggcagcgcgctcctccaaggcctcaataaacttccaagtgatgtttgagatagctgagtggttcatcccgaagcggttccctatgctcaaaagcgactcaccggtggtcaatcttaacagagcaacacctacttgatcttccacgcctagaattgccttgtctccaaacctgaaatttctgaaactttgtgtctttcttgtgaagtccccactaatcagagagcaaaggtagtcaaaggtcttcctcgacatcttgaagacggactcaaagttttggcagtctttggaaaattgtcctgtggacataagacatagtcaaagatcgcagtggcgttagtcgagcatatcataaattatttggcagggaacttgaaagcataaaagggaaaattcagatatattgaaattcaaagaattcgattcgttctcctcatattgaaattagaagggcagaggaagaaacggggtaaaccttatgatagcaaatttaacagaagagattcaaatctaatagaacatggtccacaagtgtcgagaacagaaaatgaacaatactagcaatatcatgaatgaactgagcatattatatgagaaaaggtttagctgttttggcaatacagtgaatatcgattcaaaatttagaagaatcatcagtagaagggacactgcccttgttaaatagatgactagaatgctatcattcctgtatctaccttcttaaatcactcacacttgatgctcaggtttgtactaattgttcaaaatgtcactcttgtcaaaatttgaaaattctaacaatgtcacttgtcataaaggataggtaggcattcaaaaccaatgttttccagtgtttcagatcatttcagcaatcagggaagctcagaataaatatcactaacgacttcaagaattcaaaaatatattgtctatgtttttgtaagaacatgtatgatcaaaataagaatacagcagccagacaaatagctatacaaatctactttatttgttcaagctaaattgtacttgtatgggctgcttcacccaatgatctctgaaagactcacttgaacaccatacagagaggcctaatgaatctatactcctggatgatctatcacattgaattataaaacagtatttgctgtggtaccaggtactataagattcaagaaacttatcgtgggaatccatttctcggaacacatcattcaaccgacctacctttgagccacactaatcattttctggatttgccagtcaatctattggaacccaatcccctcacgtgtttcctttaaaaaaaaatattaacagccaatcggatgatgaaattggggaaactacctgtgaacagatgagctaattacttaaaaaaaacgcatatgctacactttacaattctggactgaacaggcaaagcaattcgatggcaagtacagactaattgttctccgggagatgttgttttccccttagcaaaatgaagttacttcataagttgcaaagagaaaagaagttagttcttgcaatgtcaaggcatgaacagtcaaccaacctattctgaattagattgacacaatgggcaaaagccaacagcacccgtaaatttctagccccaaaataccattgcaccaaaggcttcatagatctggattggagaaggaaacaacaaaaccacagatggcacaaccaattcttctcccaaacacggtctactcgatcgatacccatcagagcaacggcattca

SEQ ID NO: 73840 - DNA, 24758 bp, Oryza sativa
ttcaacgtgatctaacgtacgcacacaaagaaacgaccaaataagcctataataaaaatactacaaataaatggtaaaataaatattgtgaatcagagcccgaacaaaaaaaaatgataaattgagagttaacttaatttggaatggcaaacgatttatcctagggttatgatttatggcatgtgtaatagtggttgcaatttgagagtaacgctatagacaacaaaggtgaaaactgaaattgatttggtgttttagagcttgaacaggaggaaaacaacctaatagaagtgtttggactggttttattgtggttgggcactatttaggtggttttgatggggttggttgggttcaaccaataggaaatagtgctggccggcactgtttatcttcttcccgtggcttttctcgtgattaacagaagtggagagaaaggctccagaacttaagtgagggaacggcgacggagacgatagcatgatgtgttccacaggctgacacccccacaggacgtggacgctgggctggaagacaacaaagctagccggaacgcaagttctagatctgcagctatggtgacatcgggcatggaagtggcagccccggtggcgaacgcgggcgggtgagcgcgtcaaaacatgttcccggatgagaaggttccatttttgtggttagttgatagaggtgaagcgtcggccatgccgaccacggtggcagccatggtgacggacaggagcacgatgggagctcgacacaagcaaggaaagaaggttggggaaaattctcaccagtgagaggtgatcctgctggtgctatggggaggaggcagaaaagtcgacgacggcgaaacgggtgcacagccggccttggccctggcaggagaaattttgggatgaaaacgtacgagattagcacttgatgtctacagaggaatagcagacttcggctcgttcactttgaaggagagaaggactggaggaggagggaaaacaaaggagggatggctacgagcagctgcgtggctgtttcggagccgcacggcacgacggccattggagatcggcgcgtggttggcgcgaggcggcacgaggctgcacaaggcggtcatgagttgggctcagggtggcacaaggagcagcgtaggcaggtgcaaggcggcacgcagctagcgcgtgcggacacgagcaggacacagggcggcacgagcggcggctagagcgaacgaagcgagcagcggcttggctggggtggctgcctcggctgggccaggacatgagctagaacagcccaacacagagagtgacaagggaaaaagaaatccgggatatgggctggaatgcaaggaactcggcccgagaaaaaacacagtgatctatttgaatttttggagagatttttgcatagaattttggtaggatattttttaataggaattgatgggatttggggtcttagaatatttgcatgatgactctgggataacttaaaataaacacgagctcttctgatgattttgggaattttctttgggatatctcggattttgtttggagagggaaactaaacaaggttatgtgggagtaggaaacttagagcgaacaaaagaaatataaggattgggagactccaattcgaaagaacgaagaacatcgactttaaatattttcgcaaaaattttaccctgaaaaatctagtatgttacagtatgtgatacaatcatctctatgattgtctctagggcatatcactaacactatgagccgcccacatatatgagtcccatcctatccaccgagttgatcaagcaagaacagacttgcgcctcttgttcttgcccgatcagctaaagaaggtgtggttttgctccttttttttttaaagattgaagcctgcaaggtaaatattcattatttctcactccattcctctcttactttatgatttgaattaccatgtgctatgtatgcatgtaaaattatgtgttgtttttagagataattcttatcttttttggtgcccattaatctcattagatctattctcggatgacatgctaaatttgaattaatgttttcttccatatgtaggatcgaattactagaactaagccaaccagagaggagtgaatggttggtgtacccaaaaaatcaaactttttacggaattaaaagttaccctcaaatcgatgtagatcggtctgaccgcgcctgtgctgccggtctgaccgatctggatcacccggtccaaccgcctgaaatcgcctctgcctcttgacgctgccgccggtctgatcggtgtgtacccgccggtctgaccgccgtgatgccgtcggtctgaccaccggtgtttcgtcggttagaccgccgaacctgagcaaacacaaatcgaagatctctcaaagtagatgacaactttattacttctctctgtgtttacaaagtgcaacaaccacactccttatgaaaatctcaactaaactcgaaaccctaactcaactatcaactcaatgctctcaaaagcgatactgggaggccacgccctccctctctatttatacatgaggtagacagtctaaaactacgaacccaactcatacaagaccacactttacataaccaattgtaccaaatttggactccttccaaattcgacttcgtatcccatacgcacacaatatctccatcgtatgccatatggaaccttcaccaaccatttgcattgaaccctagcctaagtataccgcatgatatctgatcatcacggacgtcgccttatccccaagtcgactcccgatccataaccggcaatactctcccgaggcatcaagtcacctacatatgaatcaaacaaagaaaccatattccgagaccaagctatctccaacttgactcattgttagcaaacaacagtattacatacatatagtatctatctagaagccataaacatgaaacaatcatggatatccaaacaaacaacccgaaaccgaaaccgacatagagtcggctagtcagactgcgggctggccggtctgacagctcgatatatgccagtctgaccgctcggtatatgctggtctgaccggcagcacttacccgatctgaccggtcccgacaaagcagtagtccctgttcaccgtctagaaatccatcatctccaaaaccacttcgccaataatctccaaatatcaaaaccaataatcacagatgccaattgttcatcacaaaataataatcaaacacactttgattttacgccatatctatgctatcaccgttagtcaattgttagtcaatctccgttaaggacaagaaattgtttgtcttttcgttatcccatatcccgtaagtggtaacctcaaaatattttttttctagcatatgtggcatgagtaatagcataacaaaattgcagagaatccctgtgtggtggagatggtactattgggcaaacccagttgcctggagcctctagcgtctgacttacatcgcagttaggggatcgggatggcatgctggacaccggcgaacccataagggcattccttctgcggtactttggtttcgagatgggcttcttgaagcttgccgccatggctgttcttggcttcaatctcctctttgctctcatattcgtagtgtccatgaaagtgctcaactttcagaatagatgaacatcattgaccatctcccctctttcatgtacttcctgggcatgttagccctaaaatctaagctccaataaaaagaagaaacaatcttcttgtcttgaacgagagctagtctatcttttcaggccaacttgtgttgcaaagatacttgctttacttgcacaacatttcggattgattcagtgttccaggacgcatcagattatggaatacatcaacacttgcagcatccacgaaaacgtacacaaacagttggtgatacttaataaaaatgggagaaattaacatccaaggctccaagccattgaattcggaaatcctaattggcgatcgatcgtctgggacgggggtagcgatcaattcccctcccccctccctcactccactggtttccttttttggtaccgcattacttttctattttagtaaatttatgcacctcaagtttatacacctcaagtttacacatctaaagtttagagacccaaagtttacacatctaaagtttagagaccaaaagtttatatatccgattcaaatttgaatttgaattcaaaattttttatatatagtatttctatacatctaaagtttatagaccaaaattttatagacccaaagtttataagtcaaaagtttacatacccgattcaaatttgaatttgaattatatctgatttaaatttgaatttgaattcaaatattttctatatatagtatttttatgcatctaaagtttatagacctaaagtttataagtcaaaagtttacatacccgattcaaatttaaatttgaattatatccgattcaatttgaatttaaattcaaatattttctatatataatatttctatacatctaaagtttatacacctaaagtttatagacccaaagtttataagtgaaaagtttacatacccgattcaaatttaaatttgagttcaaatttgaatttgaattcaaattttttatatatagtatttctatacataaatttttctaactttttgtttttttaaaaaaaattatgtggtgtactgtagtaggaagagaagaaggggaggagaaaggggggagagaagggaggaatgtatcgagtatagggggaggggggcggatatgatcgctggatcgatcgcccgcccattagggcccccccactgaattagatcaagggaagggtttctttgcatcctgtttggcgatggcccaatgtgaagccaggaacaagcccaacatctggtgggcgttggccttcggagaatgattcggttttctgggctgcatctaaactttgaagagttttttttccccttcttttgttcaccttgagattcgttttgaaacatattacaatcgcagtcgcttacaatgcgcgcacactcaccactataaaggcacatatgcacaccctacgcctatgacgcagtcgctcataacgcgcgcacactcacctatataaaggcacacatgcacaccttatccctatgagcacctccggaagactgagccggcatatattgagattaacgaagtcaccataggtatctcactgtcgacgtgtatgtcacttactactaaaagaataaatagccataaatgcgagcacctatatcaagtttaaaacttgaaccagttgaactatactctgaaaagctagctattgagactttttttaaggggaaacattacttaaggaaagttgtttttctcatcttctagatttagggttatcttctaaaatctgtaggtagtaattgtaaaaaaaactagagattttacagaaactacatgtgttataggattcctcaaaaggggttcaatttctaattattttttttctttgcgaagaaaagggttacaagatttagggtgagtttgaggagaaggagattgggaaaatatgcaaaacgaggtgagccattagcgtattattaattgagtattaactattttaaatttcaaaaatggattaatatgatttttttaaacaacttccttatagaaaatttttgcaaaaaaacgcaccgtttgttagtttgggaagcgtgcacgcggaaaacgagttgttttctcaccctatctcacatgaactaacacagccttacagctcttgcttatcccttcctaagcattctccccttgtctaaataaaaggattttttttatatggcagtagattataatttggtagtgcaacaacttacaatttcggtacagtttagtcgtaaaggtctgacggctcatgtttattttggcggttgaaaaaccatggccgaataatgccagtgaagaatcaagcataaatcatggcctcatgggtgcaacaactatccagccttcttgtgttgtgagacagatttttgcatcatacagttaggtgttcagccaacctaactttgagagctcgattgaatgtgtgctttttctataacatagtatgattcttctgtcctctaaaggaacatccgttcttttcccttttatttttttttgaataaactgtattttgttgtacggcacacggggtacacagatgcacctaacagtctatctatcaatcaactatggctggttattatacatacatggtgtgcttagctagagcaacctaatataaccaccgccgtccaaggttagatcgccaaattaagtgacggaattccacaaaacagaccaagcgtacgtataatccgtactccctctctcgatcggtcataaaaacatgtactccctctgtttttcaagccattcatattagaattagaattttgaccaccgattagatcattagactaaacttaacaaaagatttactattatatctaagtacatggtacactttagtaacataaaattattttaagtatttttaaatattttttaaaaagataaatagtcaaattttgaaaatgaatagtatccgttgtcatttatttaaatatgaagggagcatcttttcagcattgacgggtatccagaatataattttgaccattgatttctacacaataaatacttacaaaatctgacataataatattatgaaagtacaaatttgaacacataagtttcacacgcccagtctaaatatttgaaaagatatattcggcacactatgtatgttttttttatgttctaacatagttggatctaggggtgatcatgggaaaaaatattaacccaatttatatatatatgcatatataaaaatacttttgaaaaaaaaaacaaaactcttttattgatatattttttgcggggtcttttattgatatattatgatgcatatttcatcaattcatacttctaactttggtatgtttagggtatttaataaaattatataaatttgatcaactatataaaaatatatgatacattgcgttttaaacgagttctttgcccagtttgctactagtaccatgagctaagatacaacaagtaaaagtctttcgcgtggcgcgtgactcctgtgtcgtgagaaagtcgtcatggcatcttgctctgtctgtccgtagtgaatctccccgtctttacgctcggatcgatcggtttccgttttctctggcccatgccaacgcacccagcagtcgtactgtcggctgaaaaatagcaattttccatgttgaccaacttgtcgactataaaaatatttggtcattctggcaaggagatgctctcccctacccaccggttcatattcataacctgctttttctttagagtattttgttttttacatgcttttgtgatagattatggttatgtttagctcacactgaaatttggaagtttggttgaaattggaacgtgtgactgaaaagttatgtgtatgaaaggtttgatgtaatggtaagttggaagtagaaaaaaactttgaaactaaacaggcctatatatgggtgaagtttgtaggtgacctagctaggcagctagctatattttgcttctgagctttgtttggggtcatataatgtctaaacgtcaagtactacctgagtcttaaatatttgatgttggtaacgtcaaataaaaagtagagggagtatattagcgataggaaatttggtttataagtgaagaaggtcctgtgtcccagatttaaataaaagatatgtgtctttccaagaaaaagaccagaagttaaaactttacaaaagtggtataaatggatttgtatttaaaagtattttctatgatattaattccatagtcgttgataatatattacgaaagaaattcatatcatcaggattttttgcactaccgctatgtcggtgacatgggaccgggagtatcatgactagaggcttgggcaggagcaatcacccacgaggtctgaccccctcgggggggtcgggtccgagggtgatgtggccgcccccctctttgtctccccgaggggtcggaccgctcccgtttcggccccgagggctgaggcgccccgacctcttgggggttttgcgccgcgtgtctgggttaggcaagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacacgccttgccccatcccgtcaagatgagagcctccaagcactcgtccctagccggagccggcgtgttacctcctggagatggcacgttggtcccggtcagatatatgccaggcttcatcctaaccattacaagcaagatattgtatgaagaagggcaaacatgcagattgttaaactgacacgtggtggacaagaatgaccgatttgtaaccggactgactatggtcatgtcatcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagggaggatgagtcccgacacaaaagaaagagagggagagatggtgcatgtggtatccccttgagatataaaaggaggaccttgcccacttagaaaagggggaaaaaacgatcccagaacgatcaggggctggcaggcactttgtagcttcttcatacacagatccaccaaaacacaggagtagggtattacgcttctcagcggcccgaacctgtatacatcgcccgtgtcttgtgctttttccattctcgcgaaccttccacacacagaccaggagtttagaacctcacccagggcccccggccgaaccggcaaaggggggcctgcgcggtctcccggtgaggagccccaagctccgtcagttgtttttttcaattttgctatatatttgtcgaaaaattttctcctaaaaatttgacaaatgtaaattacaatacaatcgtagtataattacactgtaacttatataacttttacataattttaaaccgttagatttgtttcaagatttatgcaagtgaagaaggaaaaaagtcataacacgcacacatgtgagaggattcgttcccacgacctccgtttcaccaagatagcatgttacgtagagattttaaaagttacattgtaattacatgcaagttacagtgtaattacatggtgattatattataattacatctgtcaaatttttgattgaaaatttatcgataaatatataggtaatcattttttttggaatttatgatgcaataggtagaggagaagggaaggagcatgcccgatcgctctcggtgatcacccacccattagccctccccgaacaaatcaagtgcctgccagttgggaacaaatcaagtgcaaactcttcattattcataaaaaaatcattaagagaacactacttgtcaatacattgatttcttgtgttgctatcacaagacaattatttttttatacaagatcaaaatacactcatatatattatgatgaaaactacgtgttgatgaatttttgcaaacgtatatagtaatagtattcttatctcacaaccacaaactagtcgataagagatccatgcatgcatatgtacgacagtacaagaccagcctcgacgttcgtgcgtccggccgatcagcaagcgccgacgcggaagccgaagacgcccccgccgacgtcgtacaggacctcgaacgtgcgctgctgcacgttgccgatggtgccgaaggccttgtcgtcgcgggtgggcgcgaacgcgaggcagccgccggacaccatgccgtgcgcgtcgaggtcgacgacggcgccgccggcgaacaccagcgcgacggtcggtatgctgaccttgtccaggccggtgaagttgaagcacgtgtcgagaatgcccaggggctccgccctcgcgtaccgcgtcatcccggctcggaacgccgacgacagcgccgcgtacgccgccggcggcagccgcgtgatcaccgtgccggagtccaccagcgacccggcggcgaacaccgacggcgacagcccgagcttcttcccgcccacggcgatgtcctccagggccgcgaagtagtacgtcgggaccttcttgctcctgagcatcggcgtcgtcgcgaaccgcgacgcgccgccgccgccgccgctcgccggcgcgcccagcgtgaggaaccccgacgaggccggcgtcgccgggaggcagtagaagaaggacttgccgtacctcgccgccgtctgcgacaccggcgactgcgcgtcgccgccgaggccgatgaagccgtcggtcttgtcgtccatgccggcgcccagcttggcgtggctgcacccgaactggaagcccctgacgacgtcgaagccggacagcgtcagcacgtcggagctgtacgtcccggttgtgttcgagccgtcgccgtacttgacgatgtactggcaccgcgacttggcgtcgcagccgttggcctcgccgctgtcgccgagctgcgcgcacgcggcggcgctgcagttgaacgccgcgtacgtgctcgacgcggccgggtcgaacagcgcgccggcgtgggcgtggcacggcgacggggcggggcacggctcgcactgcacccacgacacgtcgctgccggtgtcgatgaccaccctctgcgtcaccgccggcgagccgagcccgacggagatgacgtactccagcgtgtccagggaggagcccagcgtggtcggcacggacaccttggacgactggccgtcctcgccggcggccgtgccgttgctgccggagaacttgcgtcggatgtagtcagctcggagctggtcacggcggagcagctcctcgtcggttggcctcttctcgccggagttgggatccgccggcgagcatgggccgtaccggtggctcaacgtcaccgagctcgttccatctgaggatgacggaatggtcgctgcaaaaattaaatttcatttcttaggaaatttgaactttcacaagaagtatattaaaactttcactgcatgcaaagtatattaaactttcactgcatgcatgaaattttagttgcagaaagatacgagagatttttatggacagttcactaccattgggctcagagcagacggccctactaggattaaggtcaagaaccttgtaactctattcatttcctgcacgagcaacgaaagaatggtaactgcacaagaggagcagcaacacaagcgaaacagaagtcattgctgttcctttgcttcgtcctaggtagctaaggctatgggcaaacctgagctagatagatgcagcttcaaaaccctaccttctctatatataagaatcggagatcgattttcatcctccgatgggacatcctctcgtttctttcatttcatctaaatagttataaaaaaataaaaaaactgataacatagattaaatatgatatatatcacttcatagacgtcaaattcgacttttaaaagttgtaaaaaaactgaaactagttaacatacaatcatagttgtatttattgtttttgttacaatatgtaaaagtcgaattttaaactcgcatatctatggagtgatacatgccatattaatctaaattatcatttttaaaaaaaaaagtataactatttaggtgataaagagatattttcttgagggatgaaaacaccttctcataagaaactatcttaatcacagcccattcagttcagctgatatgctaacaggttccactagccaataaatattatagattataaagttaataaatagtaaaaaaactatggaccaagtatagggtggcacgaattagaaagtggattgtttctgtccttcgagggacatcctcttgttttcttgttttatgcatggtatttaaaaaatcataaatttttgttaaaaaaagttaaaataaaaaacatacaagttgaaattcaacttatacaaatttgactgtgattacgcgttctatccatagtcaaatttattttttttcaatttgtataagttgaatctaaacatgtatgtttgtgatgaagcgatatatcacatatttatctattttactatttttttaaaaaaatgatgatttttagactacatgtaaaaacaggggacattcttaaatgaatagagtttccccacgaattatccatatgcatctccattaactctaaaaaagacagaccccttgaccgagactcatagttgacccagtaaatcaaagttcttgcattttaaaactagatttaatttgttgaaagccatagcaaagaaatgcaacctaggcaagatcatcgcaagtacgtcatgcatgtatagcaaattaaatggcgacgcgcaaccgttagtatgagaaaaatcattgctgtcacctgtcacagcattctctgttcattttataaacttctttaaccacagaaatattaacatcccaaaaaatcagtaaagctatttaagttagcaagcaaaatatcccaaaatgagaagtttggattttgaacacaatatatagcaattagaaaaaaagatcataatacgagcaagaaagaaaataaaaaactaaataaaaaatataaatatcagtaacatttttcctgttctaggtattcaaaattctatctcgatctaaattaaattttattaatggagaactttttggatcacatttgatattttttatgcaacatttaataagttcatggataaagaaaggcaaatcttttttttttaagaaacgactcgcacccgatggtgcaaaattttatattgatatagcatgaaagatacaacattataacctttggaggttaaccgggaaaaaaaacaaaaacaaacacaccagcaccgcacgctggcagctcctcacacaacccaaaagaaggcgctagcaccaagccgaccgccatatgcgtgcgatcactgctaaactttaaggggggttgcaaatatttcccacataccgactctgtacagaagatagtcgaagtttatggttatcatcatgtagaggtgttgaagagagggagagggcgagagagaagaaaatacacatactcatccctcctgacaacatgatgatgacaatcaagaaccgccaacaatcaaaccgagagaaggcggcaaaggcagggaacaagacctcctaagcaacgtcttcaaggaggtcatgacatcctaggtgccaccgttgtccatccaactagactggtttttccagccgatgagatttgcaagtaggaggaagggtagctgcttgacaacggcccaaaaggggtcacggcgcccgaacacgttgtcattgctggctcgggaaatccaccctctcccacaccttcgatgccaccccagaactcctccgcccaacaatctctatcggccggcagctccaccacacccggtgccactgggccaccttcacgaccgacgctgcattccgtagtggcgtagagtcgttacccacgttgaccactatctcggccagcactgcgagtagccgttcctgccctctgcaacagccgcagccttctctgtccatgtcgacctcaccttcaccaaatgcctgctataggctcgtatcgggcttcttgccctttggccctggtcatggtggtctcctcccgtcgtcgcccacgtgggcctcctatcgccgcaagccatcatagcctcccgctatcattgctcgtgctgacctccttgccactaacccccgtggcatcttgttgctgctgcttcgttgcactggctgctccggccagatccggcacaagggccaacgaatacacacacgggccgaccagacctagctgtggtagagccggatccgtagtctccacgtcgtcttccctatgctccacgcaccaagccactttcctcgcgctgaaggcgaggcaccaccatggtttagtcccgccgccgccatcccggttgaccactcaattctccggtggcgagaagaggaaaaaaaggggagatggggcagcgagcgctagggttcaaccccctaggtaactctcatgtgcggaagaagggcaaaccaattatttgtatcatttttctctaacttgaatggatgctttgcatatggattgaaaaactatcgatcggtgagatggtacttttcagatttatgtgttcattcccgcaaaaaaaaagatttatgtgttcatttgcaatatcatttggctatgagagaattttcaattgtgtttttctaatacctaagtggctaagtcatgcttatatgcgatgggatttatcaaatttcctcttaaaattactccctcagcaggacaatatagtatgcattttgatatagaaatgtcaaactttttagaatttgatcgagtagtcaaattatagaatatttagtatataaaaattattctaatatttatattttaaggtgattttgcaaataatagagagctatgaaaagatatatagaatgagcccaatgcaaacaaggctcgaaagaaccgaatgaaatacatatatattttacgaggaatgcatggtcaaagttgactaaatgacttaaaaattaaagtaaatgtacgaaagggataagatcttgttaaattcatctggtgcgatgctgccgtcatcagggcaggaagtgatacatgaattgaatcgtacgtccttgaatcttatatactccctacgtactctaccatttaaatgcaatcacaggtttttttacaatatttaaccatccatcttatttgtaattttattattattattattattattattattattattattattattattattattattattattattattattatataatacatgactagtactttatgcatgattttttaaaatttttttataaattttttaaataagacgaatgggcagagggagtagataacgtgattggtttacattgaccggtgttctaccgctgttagcctgttttgattttgatcaccaacaaattttaagagagaatctattctatacaattgagtttgttcgagttcaataatttgtcattaacattttcactttctataatatatttttgactttatcaattattctacaataagtcattgggcctggggccttcttttcaaaaataccaaaaatacccttatggacatacaaggttaacaattaatttatctcattagaagtttaaaaaatatatgaaaactttcatgtgacctccttacataacatggaaatttgtatagaatttctttcttttttacatttttattttttaaaaaatataacttatctgttgtatgctatataaaataattttttattgttgtttttagtataaatcatctttcatacactacataagatattttgtgctattttctcttatataagcaaattctctctcatataccacatgaaaatattttctttctaaaaaataaatataccagaaaacacttgaaacatgtacacaaacttccatgttgtgtaaggaggtcacgtgaaaattttctctcttttttttaaacttttgatgaaataaatcaattgttaatcttgtatgtctcaaagggctcaaaacttagatttagatatgcaaacacgagattccctgtaatctatgacgggctgtccctattgtaggtattctcacgcccaatgacgtattgtagaataattgataaagtcgacagtatattatagaaagagacaatgtcgatgataaattgttaaagccgaataaactcattggtatagaagagattctctcaaatttttaagagagaattactgtttgtgccaggtaaagatgcatagctttatgtgaaaaccttagattggaggtagtccaaagggaaactttgattaaaaaacatgtctcaaactacaatttactcaaatttaaattatgaagttttggccaaagataattgaagatcatatttagatacagcatactttcatagtacagtttattgctaaaatataagtagtcaaacattatatagaaatagagtccagtgacaattgtttaagaaccgaggttgctagatgtagttaatgttatttcttattctcttatcatgcaacaatataccaaatatttataactattggatgattaatatatagtctaataaattgtccttcttctttatttttgcttctgtgacgaaggtaatcacatcgattatttttagccttcatccagagtgtatgtctttcctgctatatatagcttgcaccatctcaattatttctagctttttgggacaattgattaaagttcaacttgtgaagagcacataaatcacgtaatgtaactataaaacaaatccatcttgcaacccataattgcccattgtcaacagtgcatgcaaggttatcatatagtatattttaatagcattggcagtttttatatggtagaggcactggacttttgacgttgtagtactttagattatacatgttttacaaaaatagatcctctagaaaacttgtcgtatttgactacacggagggactttttttttattcaactgtgctaatcttggtatggaagatacataatcttggtatggaagatacatttaatacatgtttctctcaagttatttagggcctgtttagttccaaaaacatcacattaaatttttagatatatgtataaagcattaaatatagatttaaaaaactaattacacagttagaggcgaaatcgcgagacgaatcttttgagtctaattagtccatgattagccacaagtactacagtaacccacatgtgctaatgacggattaattaggctcaaaagatttgtatcgcggtttccaggcgagttatgaaattagtttttttatttgtgtcaaaaacccctttcgttatccggtcaaatgttcgatgtgacgttaaaaattttcttttcgcgaactaaacaggccgatgtgacgttaaaaattttcttttcgcgaactaaacaggccggtatagacctctacctggggatcagctaggtcgtggtcttgcactactacacagaaggttttcccatgtggtcgaacggattttcgcgtgcagagattcgggccgtctggagcaattcgtctgcgaaaattgctatttgtgcgtgcgagcggcacaaccgcacgcgaaaatccgattttcgcgtgcgggtgcttatgtcgcccacacgcacaaataaaaaaataaaaaaaaacaaaattgaaaaaacaaaaccctaaccctagccgtcgccgccttcccatcgccgtcgtcatcccgtagtcgccatcgccttcccgtcgctgtcaccgccttcccgtcgtcgtcgccgtcgccatggccagatccgccgccttcccgtcgtcgtcgccgttgccgtcgccagatctgccgccttcccgtcgtcttcccgtagtcgccgtcgccttcccgtcgccgtcaccgccttcccatcgtcatcgccgtcgtcggaggcccgccgccaccgtcacgccgccggatccgcgcggggggcggccgccgccgccggatccacgcgggggcggacgccgccgccgttgcaccaccggatccgcgcggggggtggccgctgccgccggatccgcgcggggggcggttgccgtcacctacgcccaccacgcgccgtcatcgccgtcgccgtcgccgcgggccaccgccctcgcctacacccgccgccgtcgccgtcggtgcgggccgccgccctcgcctacatccgccacgggaggagaggagagaggagtgaggagaggataggaggggcactgaggagagataggagagagagcactgagagaataaaggagagggatgggaccgaggcatggaaaaaggaaaattttgaagtgggtacgagggaaaggagggatgattacttttgcgttcttaataggcccgcacggaaaaattggtttatttttctgtgcggttcatttaggaggactgcacgggaaaattgatttttccgtgtgggcgacagcctgacaccaggcctctatttttctgtgcggttccacttacgaaccgcatggaaacaaaaggggatcgcgtccagaaaaatcaatcctctagtagtgttggcgctcattgttttggctctgacctctctcacttaagaacaactcctttctttagattaaaataatatattcatttgttttctaagttttagaaaaactgacatatcagtgtatcctaattcatttccgatagtttatttcaaaacacacatattatagtttaaattggacaaaaccacatggtgacacataactctgggtattataatcctaaaatttcacaaaatcacattactgatcattttgactttgatctaacatattttttagttatacaatcagatcttaaatttataaagaatttatccatcatgtaaatgataaatccactttatagaattttgatataggagtatgttaaaataattaatggtgtaatattgtaaatttttagaaacataataccctggattatgtgccatgtatcaaaatccacgtggttttgtataacttgaaccataatagataacattttataaaatttgctcttacttttatttttaaaaactcatttgggaggagaatgtgggtcccccccttcatgctttcagaggtgaaagttgtgaactttacctccccacaagcaaatccattagtgcatgattaattaagctttatctggaataaatctaaaagtattaatatgatttttaaagcaattttcattttatttttgcaacacacatgctgtttaacggtttgggaagtgtgcgcgtgaaaacccgaggaagtagaagttgagaagaggtgaaaatgaacacaactttaagttttattgatttgctttcgtattttctgaaaaaaataggggaattaaattatggcgcatgatttgtaattgttttctcaaattttgatacaggattttggtatgacaaggagggagggaaccatatcctccctaattaagttggatgacggcaaatttttcggagcttctttttctttaggttctatgtttacgtttatgttatatatgcaatggaaccaaatattttctatatttttttacggtttgattaaatgcaccgctggagatagcctaattgtatcgatcaaggatttagattttcgttgaatggaagctcataaattcaatgtgtttggtttaagggcaatacttgataggacttgaccatctatggttttcggatgaacaatccattaagggtttgtttggttgggtggatagaaagggttaatattttgtttggttatattagataaactcgagggtggatagattgagaatagtaaacaattgattaataatgaactactcattaacaataaagtagactataaccaatcgagtatgttatttagtaataataatcttattgtgataataccaatgatgcgaactaaaccaattatcactaatcaaataactaataattaattaaggtcagtgaagatgggtagtacttcgtttggccaattttaccatatgacctcgtccaacagcttcctagaatattcctctagctatcatccacccttattgtcaaaccaaacaggttcaaaacttaaaatggtcatctcctatctaagactgtgtttagcttcacaccaaaattaaaagtttgaagaaaaaagttgaaaatttatgtgcgtaggaaagttttgatgtgataaaaaagttggaaactaaacaagggctcaggataattatttactccgaatgtaccgtacatggtatgaagagggtcaaccttctagttttttctcctctggtgatgcacatgcatcagaaatgctcaaaaaaaattataaaatcatatggaatttttaaaactttgactctgatgtttaatacacttagtttaaaaatgtaaaaatggtgcttgtaaatttgtattgaaaaatactttcaacctcttataaactcctcgtgctttagaagatgataccccaatataaaactggaccaatgtcaatccttcatatccatatcaaaaagtcaaacatcaagtagaatttttaccgaatgaaatgttagtctatatttctttacccaactcttgaagctccggattcttcctttacaaattgcacggaagaacatcgccagagttatttatccaattggaaatatttgtgcaataatatgaacaggtcttggctggtttgaaatgttaaatggagtatatctacactaaccaaacaacgatggcaacacttatacataagtgcatgtttatacgcattgaaaagcttatcctttttgccattttgtgccactagccgcgtttgccagttcaaatggcggttgccagactgtataaagagtatatatagtagtgaaaaatcgagtgacgattgcctgaaataatggccaaatcaaataccggatgcttgtacgcatcatcgatcttaattactactacctccatattttaatatatgacgctgttgtctttttattcaacgtttgaccattcatcttattaaaaaaaattatataattatcatttattttattgtaacttgattcatcatcaaatattctttaagtatgatataaatattttcatatttacataaaaattttaaataaaacgaaggataaaaattgataaaaagtcaacggcgtcataaattaaaatacgaatacggagggagtacgtactatgtcaacttcttgctgagtttggtgatttgtgacattgcaagagaggacttggcgttgcctcgaactttctataaggtcgatcggtcgtcgtcgccatatatactaggcatcggtgcaccatcattcaagagctatcgatctctccttgaaaatataattgatctaccagacatctgtccgtgcaagatcagacgatgacaccaaaaacacgatgtttaattcataacggtgcagccaaagtctatatatatctccgaagcacacatcacgggtgtttctcttcaattagcatcaaccggctaagccggccaatcgtacctattagtgacggcttcgagaggtggtccatatagcccttgaggccttgaaccatccactaccacagaacccctaatacaagtggacactataagtgtcgaaagtggtaaaacaagcacctatagtatcgttcccgcctacccgcctgctcacgccaccccgcctaaaccctgaaaaccaacaccttttttcttcaaatagttgctggtttttaaaaagatctttcacctattacctctgtcagagaaaggtgccgttttgtatataaaatccggcaccttatattccccagcccatcggagtagttggtgcgggacccaccctagaaccggcatctttttggtgaaagagattgattttattttaagaaccgacatttttcacccttcacctcctgaactatagctgttgggggacccaccctgtaaaccggcaccttttgtactgtcaaacataggtgccggttttagtgtgtagggatacgcgtaagctacgatagcataaatcaaaattttctaccgcgtaaaccaggaaccaagcaagtcttagatcatagatcgttaccactcgacgcgctgcgcagtagaagaaagcgctaagaaggcaaaggaaccctcacgatgtagcgcgcgttgatgtagaggaagtagtcgatcgcaccggctcgaccttctcctcctcgtgcgttctcctcgccgtgctcccacgccgatcagcaccgcagagcagcggcgcctctatcggtatccacacgtatagggacagaacgccacgtgcagatgtgctagcacccgcgcgcggctaaggttttgctcggggaggggagcggcggctagggtttctcacgtgatgcaatacctccgccggtcacacccctcacgaatatatacgatccacgactcgggcctccaaggcccgtaggatttatattcggatccctatccgaattaagctcatattggatatccatccattccccttattccagcccattaagtgtgtaaccctataggttcatatacactcgcctgtaacccgaaaactctttttcggtccatgtgtcaatagtggtccctagccgaatgtattgacccaccggacatacataaagatcatatcggctgaacctctagtgtatacttgtatgaacccctttgcctcacgatatcgattaagcttaaggctagatatgtgccatcctctaatagctcattcactcgaacttgtgatagattatatattacttgtgattgactcctcaatcacctttggcatggccatgcactttcataatctataacatcgaggggcctagggatatcttttcataggaggggcaaatcccatcttgatttttcatatcccactacatgtttcatagcatacccgaaaactacttttataactacccaattacagagtagcgtttagcagtctctaagtaagctactacatatgttgggaaccatgataatctcaagtctaaggattcgacaccaacactaaatgagatcactgatgacagaacacatatggctcttgcagtgtctcatgttgggtctatccaacaatatgttccccaacatgtgtccacattattaatttagtatctctataccatgatccatgagacataatcatcaattaatacatgtgctgattatttaaacatatttgttccacatttgatatttgatcagtgatcctttagaaatagtgacatacaacataaagaatctcatgaaagaatcacatattcattaaccaataatgagttatctatttcaaggaacaatatcagataaatatgtaaacatagtatgtgtggggatacccggtttgagtatggtatcccgaaaccacccaaccgtccaggatttcgatcgcgcacagattgatatacagaacaactttcgatacgtatacccaagtttttatagaaattattacataaaagataactaagacaggttttaggggccgacagggcaaacacactccccacaaacagaagacccatacacaaaataggataaaaacaccacaggcaacgcctgagagcagatcgacctagaacaagaactcgtcagcaccatagaattcttccccttcctgcgcctcctcagggaagaaccgatcgtctgaaccacattttatgcaagaggtgagtaccgaggtacccagcaagccacatccataataatacaaatagaatatgtgcaaggcgtacaaagaagaatatagttcatcaaggaggtttcataacaagcctattataaatagttttttactactttgtaaaacatttcatttgcaaacagttgtaaatcattattttaaaatagtagcaatattaatcaccattcatcctcatcttcatcatattccatattttaatttaaaatctactcataccatgataaataggaatcacccaatgacatagcttcttaaccggaagcacggcacattcgaatgatttaagactcatctctgcagagactgcctagctttacccacctgatgtcaacagcgagctaggctgaggacaacatagccgttcgagagtcccacttactactagttactgcccagtgggatattgatccgtcctagcagtcgggcacttgctgggcctaagcaaggctagacggtcgctgctttcatgggttccaccgttgcggatcatgtcaacctggcagaagccccttccacatgtccaccccaaacctgctcatagagccaccctacagtctttcatatagtgggaccatgtactaggctaagtctgattacttggtcctgtggatgggcgcaaattacatcattttccatggcataagggggtagtccttatatccgagggaagccaccaaaactagcacaggcccgtgcatactttaagtgtaaatatacactttcaacaaaataattataacaatatgcacggcctaacacaccacaacatccatcttcatccggaattaatcttccatatcactccaggcgagtgactcatatcaaataacatattttatatcacccgacacgccaccacgtgacaacgggtaaaccatgtatatgagtatagatattttgtggtcttatccactagaatattattgtgaagtatataaatctacacctaggttatcaaaggacgtgatatagcaattcatggatctggccaataataacaatgtaatattgggtaataactaaactaacaagtttattcaaaaataattcatacgcaaaataattttataaatactcaatgcataaaataactaagtggttctctactaggtttcaatatgatcaaagattggaactgtggcttgccttacggaacgtggccttccgaagcttcagcgtagccttctaggtccacttcaattcccgtgagtccggtgggatcttcaacgtgatctaacgtacgcacacaaagaaacgaccaaataagcctataataaaaatactacaaataaatggtaaaataaatattgtgaatcagagcccgaacaaaaaaaaatgataaattgagagttaa

SEQ ID NO: 73841 - DNA, 553 bp, Oryza sativa
ctacatgagaaagacttctctttatctcatttctttaaccttattggttcatcatccttaataagctcctattgtacgaggaccctaactcatttctttgaaaatggtgtacatctgtgcagcttttatgttaaatccttccatatagaatccgtgcacggaccctttaaacctatgtcaatacttagtatcctgcagcagcacgcagggtatcatctagttgctaagaaatcacaagcgtacatccctaacaagagcattttaaatatctgatgtgttgtactgttgtgccttatggttaatggaaggtccgaatcggtgctagggaggacaaggaaagaatgtgggtgggaagcgaatagtcagtccattatagcattactcatatgctccgatgacacgagtattccaacaacatcctccaaaacatcatgtatttattcaatcttgtcacaaaaaaaaaaagccgcacagcattacataggtgtatccccgttatcttcaaagatgaagatctctctcatcctcatccgatcgagagcagataactaac

SEQ ID NO: 73842 - DNA, 30397 bp, Oryza sativa
  unsure (1)..(30397): unsure at all n locations
taggatatggttaaatcaggcaacaaataaagaaacagttgaacacatcaaccgagcacaaacttgtggaaacatttgattgcattgatcttctggttcaacttctgaatattttggtgattggcatacagagattatttttacagtctagtctaccaccttaatttccttattcttaagtatggagaatacaggctggttatccaccagtaaggtttgtttggattcctcggtgtcagtagatctcagcattgccatattccacgttgctacacgctccatgcgaccatgccctgttcctgcctcctgctctactgttgtatccatccttctcggaagaacaaccattttttttttcgaaaataggaagaacagcctttgttcccatgaggccatgacagccatgccgacatctctacgaagttgctagcacatccgtttcataacaactgatactaaacggtgaatgcttcactatagccaatgtaatagctaattcatacaatagtatagcccactactagctctatatcttctatagctaatgtaatagccaattcatacaatagttacttactgtactagtaatacctggtcctacatgtcatacacacattatgtcttgaagtccgtgcgtccgatttcgattattatttgcatttattaatttgaggaattagctctagattaaattgaacaatttcttcggacgatttattttacaaattttaaagctggaaaggggaacttcagggcgtgacacccgctgctcttctctctcttcctttatctctttaaaatatgtttatagctggcttatagcctgctattgtacctgctcttaaactttaaccactcatctttcttcttaaataattatgaacgctagaaatgatgttatggtattaaaatgggttatttcctaaatatacacataaaaaaaagtccatttcgatccaacaatatataggtaattaattgatggttaaagtttaaatgagaaagtcgaaattatcagttgctaaaacttggaagggggagtatgttttggacgtctaaaacttgctggcggtcatgaatgaattcagcccactattttctcgtcaatgaattcggtccactgactgattccaatgaattcggcttggttagttcatgtcagcaatttgggcccagaagtgaattcagcccacaaacatcccatcaacaaagtcagcccaataaaggctaaaatgaattcggcccacttaaattcccataacaaattcagcctacaaaagaaattggcccagctactgcgtatgaacgaattaggcccatgaatattattggcccaactttaattccaatctacgaactgggccaagaataaatatggcccacctaattgcagtcgacaatttggcccaccaatgaatttggtccactgaattctcgtcagcaaatgcagcccacgagggaatttggaccacaaaattcccgtcaccaaattcagcccactggaaaatttggtccacctgtctcgtcaacagatttcatcgcccgcggccaccggcggccggcgaacgcctccgtcgcggccggcgcaggctggggaattccaccggcgggttcgcccatggcctcccctcgcgaaccgagatccgggagcgctgcaccgccgaaagggaagaaggcggcggcggcgatggcggcgcctcccaattcaccgattgggtggtggcgcgaggtgagagcgcgcttgtggctgcacacggtgnaagtatgtcccccagaccaatggcttgtttggcgccgctcggctccgccgtgccgccgccaccgccctcgttttgcagagccggctggcccgccctggtaacgctttttcttaatcttagggtanagtctccgtagagtttttaaatgtcgcacatcggtgaagtcaatcatgtgttgtcctaagggaatgattagtggattagtggattattgagagggaatgaactaataggagttgagcgggtttgatgttattattaacatttttttttcttgtcagtggatggatgtaggaatttaacagggatggaaaatataagggattgatacaccatcatttcaataccattttttttcttgtctgttgatggatgtaggaattcaacagggatggaaatataagggatcaacaccatcatttcaatacaggagagaaatcctttttttttaaagcagagagatgagtagatcttagctccttatgatactacatccaagctaatttttttataaccaaccagatattttatattgtagttgcttggtaaaacgcaatcagcattacacacagagctaggattggtaatagaagatagactttaatcccacaccaacactttcatctaaactcctccccttcctcaagactctaagtggcaaaacagtctgtatattattttcttggcatctcatacggaacaatttgttagtaaaactttctccacagaccgactgccactgcctgctttgatgcatcggaagccaaaccgctggaatttcacggtgattccacctattctgctaggtggagtgtacctacctccgctctccagctgttataagatttggttggtcgtctctttggtcaacccggctaataaagccctccagctgttgtttgtgtgagaacgtgggatgcatacaagatacggagtaattctttactcaaagttgaaaaaacctctccttttttctttgtttgaagaggtggaagtcaactttcttgcacatccatttgtggtttactcccatttccctctgtttgaatctggctctcctcctagtttctctctgaaagcagccttgcatttgatcagcaagaagaaagatcaagggcctcttcttctaggagtgagctgcagttctgatcttactactagtcaggtaaacaatatttcaataatcactagctggcagttgtcctattctgttttctgactgcatcattgaagaatgaagacaatatttactcttactcgtgtatccaatttttgccgttaaagttgcaaatttgtgtttgaggcccatatttcggtcttcttatacatggcctgatagagtttaagagtagagtagcccatattgactgcatctttgagcaataatttcttattttggttagttctaattattttcaatgtttattaggtgaatggattattgagtttcaagctgtatggtcatttgaagaaaacagtatattttgaaaaaaagggaaataggtttgtacattgaccaacatggctacactaccaatagccaccggcattgggtgggtagtttgtcctatcatcaagcttatctttgagaaggtccaatcttatacatcaacccagtacaagtggcaatctgacttggaggatgatctaaaaaagatcgaatccactttgataaaaatccaattggtgctgggtgctgctgaaaggtcgcaaatgctagattgcaaccaagaagctctactttgccaaaatgaaagattctgcctatgatgccgacgacgtcatggatgaatttgattacctgattctgaaggcaaatgctcagcagaagagcaagctaagtagcttggcctccagttctcttgccataggaaagcgtttggttggccaagacaagttcagatccaagttaaggagggtcctcaatagcctgattagagtaaaagaatgtgctgacatgctcatcaaagtgattggggctgaaaactctaattcatatatgcctcctcagccacttcaatggcgtgtcaccagctcaatttctcctggccaaattatcattggccgacaaaatgagcaggatgatctagtgcaccgacttctgagagaagctgatggaccagagccaagcagaggactaacaatatcaccaacaccatctataattaccatagttggcagtggtggcattgggaaaactgcattagctcagcttatttacaatgacagaagaatagtcagtggttttgatctgaggacatggatatatgtttcaaatatcttcaataaggtcaaaatcaccaaagagattttgaaatcaattgatagaaacagtgatataacaaatttcagttttaacatgctccaggaagatcttaagaacaagttaacagcaaagaagtttctacttgtgctagatgatgtgtggtatgatgaaaagattggtgagcttacaaatgctgatagatggagagaattgtttgctcctctatgctatggagctaaaggaagcaaaattcttgttactgctcgaacaaatattgtttcaaggattttgggttgcccagcaccattccatttggagggtctgaagggtgaagatagttggaacctcttcaggatctgcgcatttggcgctgaagatccaggaaattatccagaactagagtctatcggtgaatgtattgtccaaaagttgaatggctcagcattagtcataaaggttgttggtgcacatttgaatgctaacctcaacgttgaagagtggacacgagttatgaaaagtagttcatcaaacaaggaagacattatgcaaattttgcgtctgagctatgaatgcttgccaggtcacctccagcaatgttttactttttgcagcctgttccccaaaggctattctcttgagcctgacttgttggtgaatatgtggatagcccataaatttgttcatggtcatataggcacatatgaaagtatgagagaaactggtagaagttatttcaatgaactattatctagatcattttttcaggaacttcagtatggccatacaatacgttatgttatgcatgacctcatgaatgaccttgcttctcacatttccagaggtgagtactccagaatagaaagagatggtaatcttgcagaaatttcaggaacaactcggcatctgtctatacctgtcgaaagagtaaatgaactccatggattccataacttgcaaaggctgcgcacgctaatagtttctgaacgaaggcaggtctctttgctcaaaactttgtctgcaggcggatgtttttaaggaattcaagtgcataagagtattggatttaagtggctgttgcttagaatttctgcctacatatattgatcatttgatacatctcagatttctttatctccaacatgttggataagtctttgtgatccttggttgtgattcttctttttgcttttggatagtttcacctttttcaggacagcatctaccctttagcatatttttcaggtgctaggacagctgcggttagtaggacagcaacagttagcatcttctttatgcctcctttatgctttattcagtttggatgccctctaggacagcatcccattcaaatttcgaattttagactaggagggtgtagcaataggctagcagccagctctggctatatatatgtatccaacctccctcgggtaggtatggcttttgtgtttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcactggttgctcctccttcccctttcccttccccctctccacgcagcagccccccggaggtgcgccatgtccgacgctcggtctcggcgtttggtcgcctcgagcacttggcgtcagcaggacgccgagctcgccgcagcagaagagcgcaggcgagcaacggctcagaccgctgcagcagcagcagcgagggtggccaaactggcggcagtggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagttggcaagaggaagggcatgggagcgggcagagcggtgggcagcagcccacctccacggcggcggcggcggcccaagggaccgcgcgcccgccgacgggaacccagacgggcgctggcgtgccggcggcagcccggagcccgcacgcggccctcgcaggcagcgcggctctctctcccctgactggcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacgggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctgcccttcaagccaggtgaggatgttgatgactttgctctccgtctcaacactctcttgcagaaaatggtgcagtacggcgacgacacctacgacgaggagagagctgtcgagaagctcttccgctgtgtccctgagaagtacaggcagatcgctcgctcgatcgaatctctgctggacctctccacgatgtcgatcgaggaggcgttaggtcgcctcaaggtcgtcgatggtgatgagccacagcctctctcggggcccatcaccatcggcgggaagctcaatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacaacgcctgccgcaactgtggcaagcttggccattgggccaaagactgtcgacagccacgacgtggccaggcccacgtcgcacgggtggaggaggaagagccggctctgctcctggctcatgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggctgacgggagttcttcaccgagttcgactccagcgtccaaggctccgtcaagttcggggacgcctccggcgtggagatcaagggtgttggctccgtcaccttcactgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcaactctacatcctcagcgcgcaggtcgcacaaccagtttgcctcgccgctcgtcgggacgacgaggcgtggcagtggcacgagcgcttcgggcacctccacttcgaggccctgaagcagctcagtgctaaggagatggtgcgaggcatgccgtgcctggaccacgtggagcagctctgcgacgtttgcgtggtgacgaagcagcggcggctcccctttccccagcagacgagcttccgagccaaggagcggctcgagctcgtgcacggggacttgtgtggcccagtgacagcggccacaccaggaggacgacgttacttcctgctgctcgtcgacgacctctcccgttacatgtgggtgatggtcctcggcagcaagggagaggctgcggacgccatcaggcatgcgcaagctactgcagaggcggagtgcgaccgcaagctgcgcgtgctgcgcaccgacaacggcggcaaattcagttcgcgtcgtactgcgctgatgagggcattcagcgccactacaccacgccgtacagcccgcagtagaacggcgtcgtcgagcggcgcaaccagacggttgtggggatggctcgggccctcctcaagcagagggggatgccggccatcttttggggggaggcggtggtgacggccgcctacatcctcaaccgctcgcctaccaaggccctcgatggcaggacaccgtacgaggcttggcatgggcgcaagccggcggtctcccacctatgggtcttcggctgcctcgcgttcgccaaggagcttggccacatcggcaagctcgacgacaggagcaccccaggggtgttcatcggctacgcggagggctcgaaggcctaccgcatcctcgacctggagacacagcgtgtgcgcactgcgcgcgacgttgtgttcgacgaagggcgagggtgggtatgggacaaggcggtggacgatggttcgactccgatgtacgacgacttcaccgtcgagtacgtccacttcgagggagctgggggagtaggcagctcttcttcatcgagcgtgtctaccccagcccccgaatctccaccgactccgacaccaacacaccctcgggccacgacttcgactacgacgagctcttcgtcgacaccaccccagccagtgactccacatgctccagcaccaacagtcactcctccaagcacgtctacttcgacgccagctcgtgttgagcgcagcccggtggagttcgctactccgctctcccacgacggggagcgcatcgcataccacgacggtgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcatgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccacacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttctagatgagtgatctggggcctctctccttctacctggggatcgaagtgcaccaggacgactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccaaggtgtcctggcaaggcacacttcgtcgggtacagcgacagcgaccacgccggcgacatcgacaccagcaagagcacgagcgggattctcttcttcctcggcaagtgctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtccgctctggccctgacaaagaaccccgtttttcacgaacggagcaagcacatccgggtgaggtaccacttcatccgaagctacttggaagaagggagcatcaaggcgagctacatcaacaccaaggaccagcttgcggacttgctcaccaagcctcttgggaggatcaagttcctcgagctctgctccaggatcgggatggcccaacttccccacaagacgacgcacaagacttagggggagaatgttggataagtctttgtgatccttggtcgtgattcttctttttgcttttgggtagtttcacctttttcaggacagcatctaccctttagcatatttttcagttgctaggacagctgcggttagtaggacagcagcagttagcatctcctttatgcctcctttatgctttattcagtttggatgccttctaggacaacatcccattcaaattttgaattttagactaggagggtgcagcaataggctagcagccagctatggctatatatatgtatccaacctccctcgggtaggtatggcttttgtgtttttgtgaatgaagaaaaccagaaaattgccccatctcgagtgccatcctcttctcaatgagagtaaccattgaaattctaacacaacatacgcaaaactcgcttccaaattcactctgtaaacttcaccatttacttgtgttgtccatacgctggcattcatgtttcatggacaggcgacttgttacttttcctaagtgcttgggcaccttgagcagcattttgtgtattgatgttcatcgtatgtgcactgttgatttagctgccagcagccatatgccatgtcttcgagcggctggggaattctgtgttgataagagtaaagtgcagggactagaggtgctgaagcagatgaatgaacttcaggggtcgcttgctattacatctcttgagaatgtgaaaagcagggatgaggcaactgatgctcaactattcagaaagagtcaaatctttaaactgaaactgcaatggggttcttctaatgcttctagcaagtctgacaaagcgaatgatgtgttcgatgctttaagacctcactcgggccttgaggaattgattgttcagggatatccagggtgtgtgtccccatcttggttggagtcagagtggctctctagactgagacacattagcatttctgattgcaagtgttggaagttgcttccatctttaggccaaatacaatctctcaggacacttcgtattgctagactgaatgcagtggtttgtataggccccgagttttatgggactgctggctttccctcactggagattctggaaatgatagagttgccagaattggcagaatggtcttctgtggactgtttttttcctgctcttcttgaggtgtgcatcagaggatgccccaagctgaaacaattgccaccagttgttctcccacctgtaagaatgagtatatatgtatctaccgaagtttgcaggctgcgaaatcataatcgcctggagacatgttttactcaggaggtgagcttaagcacactcttggatatgttgcatcttcgtcgtctggaacctgtgaaatgtgtaaatatcatctttgaaggagcaaacactctggaagatggacttaaagatgtaacaacaaatctgccatcccttgaagagttggttatcaggggatgttctgatctgcagcatgcttttgcagctagtaaacagcgggaagaggatgggaatgtcttttcttcggcatctattcaatgtctcaaaatgattggctgcaacctgacagtggacatttttcttagtgtgtttcagaacattagtttcctttcattgtggataaacgattgcaacatcacttattcaactcctgaacgtgtgttggccatgccaaagtcagtgactggagtacttgagaagctgtgtattttaagctgtgatgggttgacagctttcatgggcctagaaacattcttaaggttaagcacaatagaaattgcaagttgccccaagttaacgtcagtgccagactttaggtgtcttccagccctccagaacttgatcataaagaattgccctgagctcaaggaactacctgaaaatggtaacctaacaacattaactgcactggttgtggaacactgcaacgcgctaatatcactgaggaacctgcgagacctttctttcctctcaaaactggtggtcagaaattgtatgaagttaatggctttgcctcagatgattagtttctcttccctcagagtcttgatcataaaaaactgccctgaagtagtttctttaccagaagatggtcttcctgtgtcccttaattgtttgtatttggctggatgccatccagtgctggaggaacagtttgaccagaaaaatggtagtgaatgggagaagtatgaagtgttgccgttttgtttctttgctgataaatcaatagaagatatcgaaggtaaacatctcccatcctcggattgctgtctgtgaaattcaggcacataatatttgaattttgatgatgatgaatctacaatttctttgttgcaaaaataaaacgtcaattgactgactcctattgattccaatctactgcagagatagccaaagaagtacttatggcggatgatcttaccaggatttccattcagggcaatcgagttcatgcaactgattctgcagcaagctcgtccagtttcccttagtaagctctccgagggtaatatgagctgttgtgatatgttgatcattttgcatcatggccctacctgcgcaactgtgcaactgctgaaattcatgtgcttgtatatttgttccattttaaaccggactcgtttttcctaaaagacaggaaatcgaacatcgtattaccaatttatcatgctggtgcatttacggatgttaacacattggatgcaccacacactgttcaaccgaataatgattgtgcaactcattaaagttagtcacggttattcctcatcaaggaaattattttttattcttgaaggataacttgattgtgattctggaagaacacattggatgcaccacacacgttgcaacttatgctttattagtatcagttgatgtaacagccctatagaaccgcgtagcctagcccaaccgacgggtgggcccaattacacataccatttcacacttacattttcgtcctcgcttcgtgtaaaagggttaacccgagagtggcatggttgaagagacaaggcttataagttggtttcacctttactaaattagcaatgtgttaataaacatacgcacacagctctcatgggccacacatgccgcatcttaattggaccagaatgtcacgtacacctccctcaaaggacttatgtcctgtcggtccaactcaccacatagccacacaagcatataggcaaatgtacaggaacacgctccctcttagcattggaccaactcacccacataaccaccaagaagataggcaaatgtccagaaacatgccccctcttagcactggaccaactcacccacataaccacacatgcaaatgtccagaaacatgccccctcttagcactggaccaactcaccacatagccacacatgcataatgtccagaaacatgccccctcttaggaacacatgcatacatctcacccacatagccacacatgcatataaactcacccacatagccacacatgcatataaactcacccacgtagccacacatgcatataggcaaatatccagcaacacgccccctcttagcacacgtccaatgctggtgctatatgtcatgccatgtgtctcacatagaagccacatgcgccatgcaccataacacactaacccgcgcaaccgcgagggtcggctctgataccatttgtaatagccctatctccagaaccgcatagcccagcccaaccgacaggctggtctacttacacataccactccacttacacattcgtcctcacttcgtgtaaaagggttaacctggaagtggcatagttagagggacaaggccttataagttgtttcaccttgctaaactagtaaggtggtaataaacatgcgtacacagcttttatgggccacgccgcatctaattgggttaggatgtcacggttgattggttggtctcctagcggttgtatcataatttctccataaattggtcatgtgctgtcattttttttctgtacgattgatttaagtttttgtgcatgtagttactcaaagtcataatgaacgtctgatccatctcttgcaaattacaagggcgttatgatcaacgcgataagttttcccccctgcagatatgcagaattcttatggtttaattgcacggtgatactgagataaataccatagcagacgtagttttgcacttttgctcatgtttatccatatagcttatcaaaaacttaataatactgaatttctgagtaaaacttttatatatatgccatgattaaaaattcaaaagttaatgtagtaaaataaactatgattaaaaatcataaaattaactcatgagatttaaaatttggcttataggtataggcacaattaaaatgatgctcattaaacccagtgtaacagtgcaatatggcaggatcagttatccatgaaggcttaatagttctttgagcactcttgccccagaaacaggagaccatctgttcgtggcatgtcattttactaagcaagtaaaacgagaatctgctaacaacttttcctctagcgtcgtctcctctcgggcggcacgggaggtgcccaggccgccgtcgcccgccctccctccctcctcctctgcctccgccgcccgaccggccgccagtaaagccgcgcagcggcaaggacagcggcggcggggcttcgcttcgtctcgccgcacaagggcagggggaggtctgccggcatcgggaggcagaaaccgcccagatctgcgtcggccagccggagttcgcggggagttaagccggcggtggggcagtgtgctcgggcgcggcctttggcggggatggcggcggagctttggaggcgctggcggcggtggaagaggccgccagatccggcgcggatctggcggggaggtttccggcggcccccggtgggggtccggcgccggcggaggaggtcggcgtcctcagggcgatagcgacgacggtgccggtgccacggcggccggaactggcggcggtggagccggacgacgactgccgaggaggcggccggatccggcggcgacgggcgtgacggcgcggagacgctggagaaggaggtgcggtggctgcgacgacggtcgaggggtggccgggtttggtggtcggctggcgacagcagcagcggcggcgtcggctggcgacgacggcggagggcatggaggcggcatcggggcgttgctggctccttggtggcggagagcgacggtgcagcagcggtctgcggaggcgatgactggtgccggtggcagcggcgacggcggccgtgactgtggaggcggtggtgacgtcggcggcggggaaggagtcgggtgcgagtggctgggcgttcgacaacagtggctgtggtggtggtgactgcgactgcggtcaccggaggcatgacagtctcggacggctagccgagggcgtgggagacggctgcttctggcaggcgcggcatcgttcggtggaggggtcggagaccggcttggcgcagagagtcgcagtcgatggtagcggaggccggctcggcgcgagaggcgcgggcagcggagatggaggctggcttggcgcgagaggcgtggccggcagtggaggaggcgacctaggtgtgaggaggagttgccggtggatgtggcgtggtcttcgacgcatgaaagatggccggcgggggatgccggtgtaggggtcccacatgtcggcaaagcttatgtggtggtggagcatcggtgcgtcagccgtagatttgcagccggtgagcggcgggtgaaaacccagtccggccttggctggaccgacaacgatcctcttgagggcgttgtcgtgctgtctcacccctcaagggtgatagccgggcgaaagcccagtcttgattgagtcccgacggacggcggcggcggtttttccgtcgcttctcttcttgcagacatcgttttggcattccttagggggcgatctcgtctgtgtccctttgttggtctagtggcggtcggtcacgcttagcggtggccgctccggtgctagccttctcctgggcttgtgtgttggcgatgtcggtgtgtgggtggtggtattcttttttctttttcctggttacgatcctacagggttgtaatctcgtttttttttcctgctctatcaatataacttcgcaccgtctcgcgcgagccgttaaaaaaaaatttactaagcaagtttggacctttgaggggtcttccaccgagggtatgccaccttctcaaccacctgatgccatcgatcttgcatcttgaggcctgtttagtttgcaaaaagaaaattttggggtgtcacatctgatgtttgactgagggtataccaccttctcaaccacctgatgccattgatcttgcatcttgaggcctgtttagttcgcgaaaagaaaattttaggttgccatatcggatgtttgactgtatgtcggaagaggtttttggacacgaatgaaaaaactaatttcatagcttgcctggaaatcgtgagacgaatcttttgagcctaattaattcgtcattagcacatgtgggttactgtagcacttatagctaatcattggctaattaggctcaaaagattcgtcttgcgattttcatgtaaactgtgcaattagtttttttgtttaatctatatttaatgctatatacatgtgtccaaagattcgatgcgatggttttgggaaaaaatttggggaactaaaccatgccttggtggctggatgcacgtgcagggcttgacaagctgggcaagaaggcgtttgatgcggccttttccctgttttgatggatgatctggaaggaatgcaatgcgcgagtgatgctccgccctttggtctatgtttttttggcttgtgattgtgctccatagtatcttagcaccttgatactaagattttcttttcatcaactgtgttgttgttcacagcaaccaaatttctctttaatcttaataaattttggccggtttctctttgcggacccgacaaaattttttttaataaattggattaatttgatcgtaccattgtaaatgtgccaattcctataaatatcattacaattcgtctattcgtaaccgcatcactcaaattttacaaagtcggaaccatgccttcgctgtcacattttgcatcttcttcctcatctacacgtggggcccatctgttagattcatcttctttctccatcattccctcttctcttggggcatgtggggcgcactcagaacgccacgggggcgtgaccgtcccggcatagctcccgcgtcgacgacagcgaggcggagcgatggggacgacatggaaggatcgcgaggcgtgcacaatttcgcttcggatttctgttgcaccggagcgcgctgcccaccgatgggtggtgatgttgttgcgagccgtgggaagatgatagattggtggagaggaggctaagaaggagagagatgggaaaaaagagaagaggcggggatggaggaagaagatgaatctgacaggtggtcccacctacgaatggggaagaggaggaaaacatgacgacgatggcatcattctaattttataaaattttagtgccacaactacgaatagatgaattgtaacattttaatatatgacgacgttgacgactattcgtcttattaaaaaaatttatataataataatttattttattgtgacttgatctatcatcaaatattatttaaacatgacataaatatttttatatctaaaatggtccaacgttaaagaaaaccaggggagggagtaacatttatcatctggatatacacatttgcagtggcaatggttcaaatagttaaatgcccgggttcatcgcctggcgctgcgccgccccggccaacggcggcgggcgaacgcctccgtcgcaactcgcaagccgggggatccgggagcgctgcgctgcccgacatggatacatggaacgggagctccggttcaccggctggccggcggcgaggggagcggccgcatcgatcctccgcttacgccggaagcaatgtcttgtgtggtgtcgctcggccgtggtaagggtttcgactgcaatcaatctctccacccgtattttaatgatctaatcaactgcgtagacagcttttcagggcccagcgaagcaaccactacattggcgtcgtcccgctgccatttacgaccagatcgggttcttcgccctggcggctagcgcacgggccatgaatttcggtgattttcaatcgctctccctgtctcataaaaaatacctaacctcatagtaaaatgagacgcatcctagtaccagtggcaaagccagaacaaattgaagggggtgcaccactcaactgtacatgtagtggcacgtagaattttcaagccatgatatataaaacgtacgatgaaatgtgattaaaaattcctacttaaaaatgtaaaatcaagggagccataataaaagagatactcagtattgcatcgaaccattaaataagggtgtgtttttgtgaggagaggaaagtagaagaaagcgtatgattaattaaatattaattattttaaacttggaaaatgaattaatatgatttttaaagtaacttttctatagaagatctttgcaaaaacacacggttggggaagtatgtgcgcaaaaaacaagggatttttctccatgcttcaaaccaacgcactctaaaactggtggagtatgaatactagatattagaatgtgataaaattcaaaagtcagggagctagtgccataacttctcaaattgaaattttagtacttaattaggatcaatatacaattactccactttcctaaatcccaacgtaaatcctaaactagtatgtagaaccattaaaataataactgaaattgaactctatatttaaactttaactctttaaggtttgaagtgaagaattcagataaattgaggaaatacgatgaggaagatctatgcccttgcctctatgtcattaacataagcacatacgggagatacacatgatcaataaaacgataaaacaaatgaacaaagcagtacgctgatgcagcaaattgggcaccaactgaacgcgtgcggccaagtgacctcgcggccgtgcgtccgtcgtcctgccgcgctttggccagccgtcggggggtgcacgtaagggagctgaggggggtgcacatgtggcaaaaacaggatatcaagcactgtacagccaatataacttcgcccctgcctagtacaacgaatttagacgtagagtatatctagatttattgtatgaggttggtttttttttttgggatagggagtatgcccccatctctgcactattcaattcgagtctattctcacttattaaattgttcacactccacactgcaaactaatcatgcgccattgtgaggattctccacctaacctcaacttggtctggttccgagttgcttagtgctattgctactagctagaaccagaacacgctctgcctttctcctgctggctgctgctctttggcctgcttcagccttcagcttctccatggttttctttttgtttgctccagcttctccatggttttttttgtttttgttctgagaggaaaaagggattttatatattgataaggtattattcttggtttctttcacttgatagcatgagttcagcatttgtaggctgtcaaatttttaaggatttctcaccatagtaaaacgattatattgaatttacttggtggatcttgatccgtatgtagctcctctttgcttcccaggcatatgagttatctatgtttcccttttgctgaaatacatatggagttaattttgcaaaaccatagatatttttgtcaaaactatagatttatgccgctgtattgcaaaaccacgtactccctccattctaaaatataatggatttttggagggatgtgacgcatcatagtattacaaatctagaacatagtattaccacgaatccggacagcctctctatccagattctagaactagaactaggatgtgtcacatccctccaaaatcgcttatatgggacatagggagtatttagcatatggagttccataattcttgacgtttggacaaaattgagggctatctataacttttaaaatatttagtttgaagaagctagaacatgatatagattattcttaaaagtattttaacaaaattaaatatttcataatttccctcctaggaaattttaggaactgaagtctacttaacaaaagacaactgcagctgagacacagagagtccgagatagctgcaacattagtactaatttttttggtgtctaggggtctactggtttaactaattaatggaatcaaggaataatgggaaattttatatagttccatctctgatagtaatcttacatgcatttgaataatgcggattttatttctgaattgttctattaaatgtactgactaatggacaccagtatgcctcacttcgacatgttttctttatgttcttatatttaattaattatcttatcaatgctaggtacatcagttgaaagctgtaaggagaaactgaagagccaagagacagtatattgagcaacatggccactttaccactagccactggagttggatgggtagtatctcctgtcatcaagcttatgtttgagaaggtccaatcatatatatcaactcagtacaagtggcagtccaatttggtggatgaccttaaaaagctggagactattttaactgaaattctcttggtagtaggcactgcagaaaggcggagaacacttgattgcaatcagcaagctttactccgccagctgaaagatgctgtctacgatgccgaggacatcatggatgaatttgattacatgtttctgaaagcgaatgctcaaaagagaaagctaagaagcttaggctccagttctatctctattgccaagcgtttggttggccatgacaagtttcggtccaaattgggaaagatgctcaaaagcttgagtacagtaaaggaatgtgcccatatgctcgtcagggtgatgggagtagaaaactttagttcacacatgttacctgagccccttcaatggcgtatctccagctcgatttcaattggtgagtttgtagttggtcgtcagaaggaacgggaagaactagtgcaccaattgctggaacaatctgacaaacctgaatctagaagcaaaggagcaaggtcaacatcattagaggtaattactatagtcggcaatggcggaattggaaaaactactttagctcaacttatttacaatgataaaagaatcgaggataattttgatatgagggcatgggtatgtgtatcacatgtctttgataaggtcagaatcaccaaagaaatcctaacaactattgataaaagcattgacctaacgaattttaattttagcatgctgcaagaagaactcaagaacaaaataaccatgaagaagtttctacttgtattggatgatgtttggtatgatgaaaaggttggggtacccataaatgctgatagatggagagaattgtttgctcctttatggcatggggcgaaagtaatcaagattttagttacaactcgaatgggtattgttgcaaatacattaggatgtgccactccattctgtttgagtggtctagagagtaaagatagctgggaacttttcagaagatgtgcatttagcactagagatccaaatgaacatctcgaattgaagtctataggtgaacacattgtgcaaaaattgaatggatcggcattagctataaaggctgttggtgggcatcttagttcaaacttcaactatgaagaatggaatcgagttctaaaaagtggtctatcgaatgagaaagatattatgacaattttacgcctaagctatgaatgcttgccagagcaccttcagcaatgcttttcgttctgtggtttgttcccaaaaggttattatttcgagcctgacatgttggttaacatgtggatagctcatgaatttattcaggatcgtggacgcacctatggaagcttgacaagcactgggaaaagttattttgatgagttgttatcaagatcatttttccaggcacttcgatatggaggtacagtgcattatgttatgcatgacctcatgaatgatcttgctgtccacgtgtccaatggtaagtgttacagagtagaagccaatgaacctcaagagatttttccagaagttcaacatctgtctatactggctgaaagagttgaccttcttcgtgcctgtaagttgcaaaggctgcgcaccctaataatttggaataaagaaagatgttattgctaacgagtttgtgtgggagtagattttttcaaagagttcaagagcttgagattattggatttgactggttgctgcttaagatatttgccggacttaaatcacatgatacaccttaggtgcttaattctcccaaatactaaccgtcctctacctgattcactctgcagtctttaccatttacaaatgttgtttctacaccggcattcatgttttatatgtgcaaaacatgtcatcttccccaaaaacctggataacctgagcaatattttgactattgatgttcatagggatcttactgttgatttggcttctgtggggcatatgccatacctccgggctgcaggggaattctgtgttgagaagaggaaagcgcaggggctagaggtgctgcatgacatgaatgaaaaaaaaaactagaatattagggaaggacctaatatcaaataattaggaggggtgaggctttgaacccaggtcgtctagcccaccaccttgtggagctagccggaagacccctgggcatttctcctgcatgacatgaatgaactccgagggtttcttatatttacatctctcgagaatgtgaaaaacaaggatgaagcaattgatgctcagttagtcaacaagagtcaaatatctaggttggacctacaatggagtttttctaatgcagatagccaatctgacaaagaatatgatgtgctcaatgctttaacacctcatccttgccttgaggaattgaatgttgaaggatactcaggctgtacatctccatgttggctggagtccaagtggctatctagattgcaacacatcagcattcatgattgcacatgttggaagttgcttccacctttaggtcagttaccatctctcagggaacttcatattgatggaatgaaatcattagagtgcatcggcacatctttctatggagatgctggctttccctccctgaaaacactagaattgacagaattgccagaattggcagattggtcttcaatcgattatgcttttcctgttcttcacgatgtactcatcagtaggtgtccaaagctgaaagaactgccaccagtctttcctccacctgtaaaaatggaagtgctcccatccaccatcgtttacacacagcatactgatcatcgcctggacacatgtattactcaaaaggaggttagcttaactagcctttcgggtatttttcacgtatgtcaccaggaatctgtggaaattgcagaaattagctttgacggagcagacatggtgaatgatgggcttagagatctaggccccaatcttccatcccaccaaggaccatttatctgctggtatgctgatttacaccgtgcgtttgcgagtttaacagaaatgaaaattgttggttgccccaacataacatcgttgttggacttcagatattttcctgtcctcaagaacttgatcatacaagattgccccgaattgaatgaactacaagaggatggacacctaacaaccttgacagaggttcttatagagcactgcaacaaactggtatcactgaggagcttgagaaacctttctttcctttccaaactggagatcagaaattgcctgaagttagtggctttgcctgagatgtttgacttcttctccctcagagtcatgatcatacacaaatgccctgaaattgtttctttaccggaagatggtcttcctctgacccttaaatttttgtatttgaatggatgccatccattgctagaggagcagtttgaatggcaacatggtgttgagtgggagaagtatgccatgttgccgtcatgtttgtttgctggtgaatcgataggatatggtcaaggtaattcacagcagcttgaattttgaaaaggataggtctagcaattatttgttgcaaaaatattaccacaatccactgatttgtgttagtgccaacctattgcagatatagctgaggaaatacttcgcgagaatgatataatccagcggtcaattcaatccagtctactgcatccaactgattcttcagcaagttcttccagttttcttcagtaaactatctgggctgtcctccgaagctgtaggcctgccggtgatcacctacagcttcatcacatctacctgtgtggctgtgctgacctggccaaaaaaaaaaaaattccacctgtgggttctattttaatcaagccaacttattatgaggcttgtgcattttcacatctaaacctattatttatgcattacagaacattcaccattcattgcttgcgttttatactttttctacaagatgcaatgttgccatctgctcaccaggagtatctttcttgtggagttattttttcccttttctttggaataatcagatatgtatcacacaatatgtatgctggcttttgagataaataccggagattgaaatgacattttgagatttgagcatatcacattaagttgagaaaactcggcagccttttttgcctgcatcatggtctttctaaccatactttctatgctactaatgtattatatatgatatactgctagtatgtgatcatgagggatccaagctgcatttatagaagtcgtagctagttcgcaacattcttactgtttgtcattcacagaagtcatttatatcatttacagaagttatactaggcttgtccgtgtagttgtagcctgtttattttgctgccatgttattagtagctttcagtatgaggatcagcaaaaagatgatggtccccccttgcaaaatacagtgatcactgatcaggttgatctcctgaatcctgggtaaggtcaattttgttgtctgcccggctttttttttttggttgtctgctcaattttcagggaaaatacctctcggctcgttaaaacacttgccaattctgatggtttttattgcacggcgtgatatatagctagatatatagcttttgctcgttaaacccgttataatggcaggatcagtcaacaggcaacccaatcctccatccgttaacatatacgagtatatgattcaagaaataggtaaggcagaagaaaatttaagaaacagctgagcaaatcaaccaagcagcaaccttttcgaactatatttgacgaagcgaatactttgccattttgccaactgacctatttctgccacctctttagtcgtaactacggtatggtcttctatgtttacataggggagatttgctctgaaccagtaaaaatatcttacggtaccaaatattcctctcaatatattcggcccacaaatgaacttggcccacctaatagccatcaaaggattcagcccaccactgataattcccgttaacaaattcagcctgcgagataatttggaccacctaataaccatgattgaatttggcccattactgaatttgcccccacttaattctcgtccataaatccagcctactaatctatttggcccatcagtttccagtaacgaatcaggcctactggattcagcccatctctttctcctcaacaaatttggcccacgtgttaaaaaaacaaaacggcccatatacagaagagagtgaactcatgggtgtattttttggcccacgagaacgtggccgacgtggccaccggcggcgggcgtacgcctccgccgcggccggcgcagaccgggcgaatactccggcgaggtcactggaggtccatggcctgccctcgtgagccgggatccggggggcgctgcaccgcctacgtggtgcgggtgctccggttcaccggcttggccgggcggccgctggcggcggggcgggcggccgtatcgatctacacgctttgtggcggaagcatggcttgtttggcgccgctccgccgatcgccgtggtagggtttcgaatgcaatcaattgctgcatcctttcccccattttctatatggatttcgagacaccacccgtattttaatgaattgcataatgtgcataggctttttcagggcccagctaagcaaaatcatacagctgcctttgaagactagatcggcgtcttcccgtgtggctggctgctggcgcgcttccgaccaaaccgcccagggattccgtgcatttgttatgtagaaaaatatatgtgagaggaagattgagattaatgggacaattgtggcttggtgatttagtgaccaatccaattctctaaagataagtaaagaccaaatcccatcaaattagaatcgatcataatctggtataatttatttattgaattagtgttcacatgacaaactaatcatgtgctgggggaagaaaatgacaactgtatggctcaccatttaaccccatcttgctttggccaatgcccaccactttgtcaatccccattgcttgcagtatcgctacagcttctttatggtttcttgttctggaagggaaaaaagaatttatgccataatactgatcaggtattattcttggtctctttcgcttgatagcaggagtttatgccataatattgatcaggtattcttcagagtttaaaggcttctaaatttcgaaggatttgttttttgaagcaggagcagtgctattcattagcttgacggaagtttatttacaaggaaaaacaaatcaactaagacatgtacttagaattgaagttcaacattgctacgctattgcttcctagaaggtttcaatttcttccttgatcatgaagcgctcatctaccatcttcagttgatgttcaacaattttcctatttgtctccttccattattccaaactgtgtatgttcctattgttattatcctccttctcctgctttatttttcctaccgtcagtgcattcccatgatgccagagtataaccataatttgttggatagagattaatgtccagccaaacagagatcttgggccaaagttgtttggagaatggccattgatgaagcaagtgttttgctttttcctgtacttgatcacataattgaaaaatatcatcattcagaaatcatcttgcttgtagtttgtgagctgttaatattttctcctgcaatagtagccacatgaagaacataaggttttgttatgtttccaacctccagatactagctaggcatgtttgctgaacagcgcaacaaattgtactctataatctgatctagcactgtggattccagaatggcagaatgatgtccatttccaggttatggagtttggatggtcattagaacttatattttgcaattttatccacaagtagaagattgccaggaagttaacatttttacttctatgcaatcctctcatccttttgttgcctgtaaaatttcgaaggatttctcagcataataaaactcacaaaatcgaaattttcgaaggatttttcaggacatatgaattatctatgagtgtgctggattgaagttggtatccccagcagttcatgttgtgcccatgcttttgttttgtttgggctgtataagactctctatttgttccttttggctttctccaaaaaaccgggtaattaaaattacctgttatctaaaataagtatgatttatctatgctttacttggtcgaagtatatatgttgaacctaattctgtcttttgattactcaaatagattttgtgaactataaggaacttgtgaacctgtgtggttttgcataatcaatatgattgcccttctgtctggactgtttcacggggagaggattatttatgtctcagtaacagttgctgacaattgaatttgttggtcccaatcatagtttagtatctttgttctgaaacacctaaatcaggcttacacaagcttttatattttacacattgggctcctaggttgtttcatcctctctagaaattaagcttctgaaaattctttgcatactgtgttttcggctattttggtccccatagttataacaattcattatttatgatatcatgcagggaatttctgattacatggctgagttttcagcaatgagttctgtaggatggattgtttcacctatcattcgtaaaatggtttctgtggtgcagtcctatatatcaagccagttcacctggaagtctgagatgatgtctgatctcaagaatttggagtccactttggtacagattttgttggtggttggcgcagcggaaagacgaagtagaaaagacagtagtcaagtgatgtcattgcaccaaatgaaagatgcagtctgtgaagctgatgatgtcttggatgagtttgactatctgatcaaagaaaagattgaagacctaggcatgttctcatctgttctctctattggcaagcgtttagttagcattgataagctcagatcaaaattacaagaagttataaaaacactgggcagagttagagcttccgcagagatgtttgctcaagttatggcaggggaggtctctagcttcagtcagtctcctgagtatgctccagcaagagccacaggatctcttttgcgtgaagatacaatttttggacggaagaatgagattgatgaactagtaagtatattggtgaaggattgtgatgaacatttgtcttatgattgtcagttatttaatacagtggtgcattctattgttggtgttgggggcatcggcaagactacactagcacaagctatttacaatgatgagcggattactgagatttttgatctgaagatatgggtttgtgtctcccataattttgacaaaactagactaactaaggagatcatagcatgcacagctggcacagaacatattgaattggccagtttcaatttcagtatgctccaagaaaagcttcgagatagactgatgtgcaaaaggtttcttctagtgctggatgatgtgtggtatgatgaaagagttggagagcacatgaacagagaaacgtggaaggagttgatagctcccataagaaatatatatataagttctgaggctttagagagaaagagaacaggaagcaaaatactagtgacaacccgggcagaattggtagcaaaaatgctagattcgagaagcttatttttcttgcagggccttggaaaagatgacagcagaatgctcttccggaaatgtgcatttggaaacaggaatccagaagattacccagagttgaagataattgaggaccaaattgttgaaaacctaaaaggctcagctctagccattaaggtgactggaggccatttaagtggcaaatacaacgctctggaatggaacaaaattcttcagaaaagtgtactcaaccctaatgacattatgacaatcttacgctcaagttatgaaagcttaccaaattatcttcagcagtgttttacgtactgcagttattccctaaaggttaccgcattgatccaaacaggctgatccatatgtgggcagctcagggttttgttcattcagacagaaatatcaatactagtctggaggatattggcagaggctatttcaatgatttgctacagcgctcatttttccaagtgttccgatgtggagaccaaatttactatattatgcatgatgtattgaatgatctggcacttcatggggctgcaggaat

SEQ ID NO: 73843 - DNA, 1020 bp, Oryza sativa
tgctcaatcagagatagaggccaataataacacactgccatcttgacatttatactctttttcgtcatcattttctaaaattaaattgttgtcactcttttttgatctcttgccaacttactggggatgcaagaaaatgcagattttgtatggaaatctaggccaatggaggcactttaacctactacctccattccaaaataagttaagctagtacgggaagtgacatatcctagtagttatatcgcactactgtgaatctggataggatatatcatattccgtactagattaacttattctgagacgaaggtaatatatttcattttgcatttctgaaaagcaacacggccatattttaccaaaatttaatcacagatgggaaacggagatgactggaaacccaaaataatttcaactttctttgtgtgatgaacaattggcatatgagattattggttttcatatttagagattattggtgaagtggttttgaagatgattggattttcaggtgatgaataggtgctgctgattgtcaggtccggtcagactgggcaagtgctgccggtcagaccggaggtatgtgaatggtcggaccggcctgcccacggtttgtccggcggactctgtatcagtttcggttttggtttcgggctgtttctttggatatccgtggatagttcatgtttatagcttctatatggatactatgagtatgtaatactgttgtttgctaacaatgagtcaagttagagatagcttggtctcagaatatggtttctttgtttgattcatgtgtaggtgacttgatgcctcaggagagtattgccggtgatggatcgggagtcaacttggagataaggtgacgtccggatggtcaaatatcatgcggaatacttaggctaaagatcaatgcacatggttggtgaagattccatatgacatacgatggagatattgtgtgcgttgcggagtcaaatttggaaggagtctaaatttggtacaattggagtttgt

SEQ ID NO: 73844 - DNA, 4788 bp, Oryza sativa
tgaccgatggatccaaatgaccctaaaatcatgaaacaaacctagtcgatgcttcaactcttggattattaccccatacatcgatctattggcgttctcaccagtcaccattttctgaagctttcagactgtcgttacaaggattaattttgaaacacctaattgtaaattttgtttgcggctcaagagccaacaagcagattctcagttaagatggtagaactactcaactacagacaaaaaaaaaagtcaaataagtcagtgctatgtttcatattttaagctaaacccttagccatcaacatctggtgttgaacttgaatttaattgtttgcaaccggtacgatcaacagccattcgcatcattatctaaaacaaatgatcatcaggcattgcatatgttgagtatgaaaactttcttgctactgaaaaattaacgcagaatacttccaagaaagggtaagaaaatattaacatataacaaaatctaaaaaataatattactacctccatctcaaaatatagtaatcttatactagatgcaatggaatctactttcctccgtttcacaatgtaagtcatcctcacttacattgtgaaacaaagtgagtatctagattggaagtcctaacatgtattacattggtcctaaaagtgatatattttaggatggaggagtaacatgcattattaaagcagctcatcaatgccactctggttcttgttagagcatgtagcccagctcacacaagtagtccaacttgtcacattagatccgctccaccatatatctaatcggaaccataactttaggtttcgagactacacatcccaaaagacgttatatatagtcgcctcgcgttgtccatggatatacttcatctatcattgaaagtgttggcaccttttttggcaagaagacaattatgatcgggacacctaaacatgttgtggtgatatggagtcacaaccacctcgatctagaccaagaagggtttttttaaaactaaaccggctagcggagccggtttagagatcaaaatcagcctctaggtcgatttagattgagatggacgaactattaaaactaaacccatctcgtgggtgaattggaaagtttaaagaacaaacctacaaagggcatcacactctcacagcgaaggcggacaatttatggcgcaaatcaacaaatatggatgaactattactaggtagaagataaagtagaaagcatggctaaaaagcaaagataaaagaacgattcaatagattatagggattgtggtctatggttagaatcgaaccagccatagcccttataaaggggtcgctcttgccatctacggaccctttccatgtcttacttggggtagagaccaattagaactcaagaaataccttccgaagcaaggaaacctgagacccgacaaaattggactcggcgtcagactgagccagtctgaccggcccaacaccccggccttatgacggcggttagaccggccccgtgaaggataccggatcatttccaaattcgtccatattttcctatttttgttctaggtgccaaatttgggtgttaacacatgccccctacctttttggcgaacttgcgagccgaaaagcatacaacacatggtcttagggtgacaatctatattggccataagggcttccaagtgcctagtagatctttctctttagagcactgctcccgtcctgcattttgtaccgcatggtacatgtaccatgtggaaccaaaacccatccagccgttgattttgcaagggtaggattggaacaggcaaagaagcgaggcaccgctccatcctttgattttgcgcgacttctcccccaaatcagacacgagacccgcctaccagacatcgtaaaccctagccgccgaacaaatgtccgccttctgaatcacgccacaaatctcgccgacgtcgccgcccgaaatcacatcgccgccggaaacatttgccgccccaaatcacatcgccgccggaagcatctgccgccacaaatcacatcgccgccggaagcaactgcagccccaaatcacattgccagaagcaactacggcgtagcagttgccatcgtctgagtcgctggagcagccgccattccccttgagcggtgtacatcaccggcgaagaagcccttgcgatgcggcggctcaattgggacaaatcgctagggttaccccttcactccagcactcatcgatccagatattgtgaaaagacatcagtgcctttgcaccaaacgttccaggtggtaccgcgtggtaccgtgaattcctaaccattagatctgtgcgaatcaacggcgcagattttgtacctcgttggtaccgcgcggttcctcgggggtgtgctgtacgataaaattcctattctctttatagtgtcctaacatattagcaattttcttagagtgattcacataactcagcatagatattcccaactaaatgattacccattgagcacctcgcacttggaccctaacggtaaaatcgttttttgatgccaagtccctaatcttgaaacgatcttactccaattataaaacttggctatacttctcctttcatctttttagtccattccaaagtcttcaagccttcatcggtccctttgtcactgttagtgtcttataactattggctgataaatcaactcactgaacataggagaatcaaccagctgaataatacatcccccaagccaattgataagttccacgatgccttatagcatttcatccataagatttcaggttgaccggtatctaaacatgtatcttgaaaatactaactccatggtttggcaatgcaattctttattaaacaaaatatatttaaatgcttattgccgaactctccaatagatcttatccgatcaaccatcttgcttagatcatggaagtattaaactagtggaatcctccaattggtaaaattgaatttcatagcacatcaaccgaattttataggatcaattcggctatataatcaaatttaagctcatgcccccagctacatactgtgggttgccatccccggtcagggcggcattaaagttatggtctgaccagttctatattcggtcagaccggtcgagaagctacgattagatcattcaagaagcattggtcagaccggtgtggttgcggttagaccgacctgatctggagtaatcaagcaccggcttttagaacatgcctctcctatctttatggccagatgtttggtgtgtcaaattactggtcaacatgatttctcaagtggctattttaaataactaggaaggtagccgcgcattcgcgcgggcatgtgtcgtacgcttagttcgaaacacttataagagtgaaatattaaacggataacatctgccacgatttctccaaaaattgtttacgtcggcattaattgcttttataattttctaacttatattatatcataattaagtaatatctataagcaattgaaaagaaggtagacttattttcttaagaaaacatgtcaacgaaagtaaaagtaaggtgtttttcttttcttagttgcatatattatcatggattattagaggatgaattgtgttagacacgaagctccactaaatgtatgggtttatatagacactaataattgatgtagtttgagaggtgatccatttatgaacatttcatgtagagtgggtcagaacctccacgcagcttaacatgaatacgataaagatgaaatataattgcgcagtaatatttttgaaatgtgatgtaccatgaatacacacttgtttttttaataagatagatctaacaattagaaataatggttctaccggtttaaaaggcataggtgtattccaaaaatgtagcataaaaattatagttgttttagtatccaacattattataaagcaagcgtagctcaactggttaggttacttgttctggaacttgccacctgggttcaagtcctatacttgatatgggtgcttgcatttacgattaattgttctttcagttgtaggtgacgtacccatcaatagtgaggcatccgtggtgatttctttaatctcaaaatatgccggcccagtttttcggagatagtcataatggtaggtatgtgtgtgtggattcatagtatgactttttacgaaataaagacaaaatatattacttcataaatataaatatacttagttaaatcatatagtaaaattattttaacatagcatgatttcatagtagcaggactaatttctttcctatttttactttacatatttatgattatttgagcgaccggtaaaattttagaacatgaaccaacacaaaatatttccttttcaagaatacctatgaaatagatttttttctcgcaccataaatttaatcgaagttgactggcaggctaaaggcccagcaatgtctccaatattcttctctcgaggcgtcagatatttcattatgtttgtttgatgacttgaattattcacttcatctctcaaatataatggaaggtccggagaggctacggcatttaattgtaagaaatataacggtgtgagcgaataataattgtttgggtacctaaaagttgcttttttgagatttattatgataaattaaaaatattatctcaactacttaaaaataaggagtaaaggggagataagacgaggtgaggagaggggtggtgggacagttggcagaaaggcattgtgtatatttctaatgatagaaaggcattgcatatatttctaacggcat

SEQ ID NO: 73845 - DNA, 1134 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgc
